United States Patent 11,098,302 (IDENTIFICATION OF POLYNUCLEOTIDES ASSOCIATED WITH A SAMPLE) - sequence listing, part 111

SEQ ID NO: 382550 - DNA, 712 bp, Homo sapiens
  misc_feature: GZ8MTXP02JGYUZ.13.76.G10.1.454.CMB.2.raw
  modified_base (282)..(282): a, c, t, g, unknown or other
  modified_base (379)..(379): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggctttcctgttgctatttaaaaggtgccagtgtgaggtgcagctggtggagtctggaggaggcttgatccagccgtgggggtccctgagactctcctgtgcagcctgtcggttcaccgtcagtccacacctacatgancgtcggtccgacgagcgtaccgaggggaacggggctggaggtgtcggttcttctttttaagttattaggtagttaggtacgtaactataccgtccgngaacgtctccgggtggacgggggctacgttccaccgtatcctacccgagaacgtacaattacccaaagaaccctacgtcgttacgttttacctaaactaaagttacgaaaccgttacgacccggttaggaacgtaacggaccgaacggttaccggaaaccgtaccgggggtacccgtttaggttaaccttaaccgttaggtcggacggtaaccggaaaaggttccgggggtaaccggaccccgttaaaaccggtaacccgtttaaaaccgccgggttaactacggttacggtaaacccggttccggttaacgggggaccctaaaacccggggg

SEQ ID NO: 382551 - DNA, 717 bp, Homo sapiens
  misc_feature: GZ8MTXP02FX0RF.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcagcgtggtggagtctggaggaggcttgatccagccgtgggggtccctgagactctcctgtgcagcctcgtggtcaccgtcagtcacacctacatgacgcgtcgggtcccgccgaggcctccggaaggggaacggggcgtagggagtcgtccgtttctttacgtttttatttagtagtaggtaggtagtacctatacctccgacacgtaccgtccggtgggacggggcctacttacccacctactcctaccgaagtactaaccctaaacttacccgaaagaaacctacggtactttacgtttacctaacaaaagttcgaaaaccgcgtacccgtaggaacgacggacccggtaatacccgggaacctacggggtccctttaggtaaccttaggtcggtaggaccgaagggtacggtaacgggtcccgggggaacccctaaaacgggttaaccgttaccggtaaacgcgttaacgggtaccgggtaacccgggttccgggtaccgggggaaacccgtaaacgggggaaccccc

SEQ ID NO: 382552 - DNA, 761 bp, Homo sapiens
  misc_feature: GZ8MTXP02F5QOF.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcagcgtggtggagtcgtggaggaggcttgatccagccgtggggggtccctgagactctcctgtgcagcctcgtgggtccacgtcagtcacacctacagtgacgcgtcgggtcccaccgacggccgtccggaggggaacggggtcgtggagtcggtccgttctttacgtttttatttacgtaagttacggtagggttatacccgtactaccgtccgacgacgtaccgttccgggtgggaccgggggacctacgttaccgacccgttaactccgtacccgaaaggtaacgaaccgtaaacgttacccaaaaggtaacccgtaccggtcctttaacggttttaccttaaacgtaaaacgttcggtaaaaccacggttacccttaagggaacgtacgaaccggtagtaccgacgtaccggtcgttacgttacgttaccgtgggtacgaccgtaggtacggtaaacggtccgggggaaccctaaccggtaaacgttaccggttaaccggaacccgtttaaagggtcggggtaacccggttaccgggtacgggggtaccccggtaaacgggtaacccccggg

SEQ ID NO: 382553 - DNA, 600 bp, Homo sapiens
  misc_feature: GZ8MTXP02JJK1L.13.76.G10.1.454.CMB.2.raw
  modified_base (175)..(175): a, c, t, g, unknown or other
  modified_base (402)..(402): a, c, t, g, unknown or other
  modified_base (430)..(430): a, c, t, g, unknown or other
  modified_base (475)..(475): a, c, t, g, unknown or other
  modified_base (480)..(480): a, c, t, g, unknown or other
  modified_base (486)..(486): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtnccagtgtgaggtgcagctggtggagtcgtggaggaggcttgatccagccgtgggggtccctaagactctcctgtgcagcctgtggttcaccgtcagtcacacctacatacgagcgtggtcccaccgtaggcctaccgaaggggaacggggtctgggtaagtcgtccggtctttagtttttatttaacgtagtaggttagtagtaacatacctcgcaagacttccggngaccgggggctaacttcaacctattccncccgaagacaacaaacttccaaagaactacgcttgttttacaaanaaagngaaacncgtcagagtacgacgtacgagaccgacggtactagttatcgtgtacgagagacgacggtacggaccaacgtaacctacgaacgtacgtacgacggacgtacggacggaacgacg

SEQ ID NO: 382554 - DNA, 628 bp, Homo sapiens
  misc_feature: GZ8MTXP02JPTIR.13.76.G10.1.454.CMB.2.raw
  modified_base (487)..(487): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacagtcgagccgtcgggtcccgccgaggcctccggaaggggaggggcgtaggagtgcgttctttcttttattatagtagtaggtacgacctataccgtcgcacgtacgtcggtgggacggggctacttccgaacctatccgtaccaagacgtaacctaaacttaccgaaacgaacctcgtcttcgtttactaacaaattacggaaacncggtacctaggaagacgccgatacggacgacggtcgtagtattacgtgcgtacggagacggtacggccggggaccctaacggtaaccgttaccgaacgtcgtaaggtcggtacgttcggacgggaccgaacgggtaccccg

SEQ ID NO: 382555 - DNA, 909 bp, Homo sapiens
  misc_feature: GZ8MTXP02J0669.13.76.G10.1.454.CMB.2.raw
  modified_base (258)..(258): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgactccgagccgtcggggggtccctggacgtactctccgtgtcncagcctcgtcgctcaccgtcacgtcaccacctacatgaggcgtcgggtcccgccgacggccgtccggaagggggaacggggcggtgggacggttcggtccggtttcttttacgtttttaagtttaagttaaggttaggttaggttaacgttaacctacgttaaccgtcccgtaccgaacggttacccgttccggggtacgggggtaaccgggggtccctaacgtttaccccgaacccgtaaccgtttcccctaaaccccggaaaggtaaacccgtaaaacccgtaaaaccgtttaaaccccgaaaaacggtaaccccgtaacccgggttaccctttttacggtttttaaccctttaaaacccgaaaaagtttacgaaaaaccccggttacgggaccccgtttaggggaaacccggtaaccgggtaccccggtaaacgtaccggggtaaacccccggtacccgggggtttacccgggtttaagtttaacgtttaaccgggttcgggttacggaccggggtagggtaaacgggtaaaccggggtccgggggaaacccccgtaaaccgggttaaaccgtttacccgtaacggtaccgttaaacgggcgggttacccgggttacgggacccggggggtaacccaaaacccggggg

SEQ ID NO: 382556 - DNA, 590 bp, Homo sapiens
  misc_feature: GZ8MTXP02G4HCW.13.76.G10.1.454.CMB.2.raw
  modified_base (294)..(294): a, c, t, g, unknown or other
  modified_base (438)..(438): a, c, t, g, unknown or other
  modified_base (479)..(479): a, c, t, g, unknown or other
  modified_base (490)..(490): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctcgtggttcaccgtcagtcacacctacatgagcgtggtccnccaggcctccgaggggaagggctggagtgcgtcttcttttatttatagtagtggtatacatacctcgcagtctccgtggacgggcgattccacactctaccagacactaataccaaagacagtcgtattactacaaatgaaacnggtacctaggagacgccagtacgacacggcttagtatacgngtacgacgganaggacgtaccggggaccctaacggtaaaccgtttacgaaacgcgttaaaggtccggggaaacgttccgggaccggggaaccggtaacggtaaacccccgg

SEQ ID NO: 382557 - DNA, 770 bp, Homo sapiens
  misc_feature: GZ8MTXP02I9KHS.13.76.G10.1.454.CMB.2.raw
  modified_base (291)..(291): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtcgtaggaggaggtcttgactccgaggccggtcggggggtccctgagactctcctgtgcacgtcctcgttcggtcaccgtcacgtcacacctanatgagccgtcgggtcccgaccgacggtcccgtaccggacggggaacggggcgtagggtagtcggtccgtttctttacgtttttaatttacgttaggttaggtacggttaacgtaccctaacgtaccgtacccgacgaacgtaccgttaccggtggggaccggggtaccctacgttaccaccctactacccgttaccaacgtaacgtaaactaaacgttaccgaaaacggaaccctaccggttctttacgttttaacctaaccaaaattacgaaacgtcgtaccgtagaaccgacgtacgaagtcgaccgaccggtcgtagttacttactgggacgtacgaggacggtacggtacccgggggaacccctaacgggtttaaaacccgttacgtaaaccccggtaacgttacgggtaacggggttaacccggtaccgggttaaaccgggggaaaccccgtaaaacgggggtaaaccccccgg

SEQ ID NO: 382558 - DNA, 723 bp, Homo sapiens
  misc_feature: GZ8MTXP02FXK4F.13.76.G10.1.454.CMB.2.raw
  modified_base (256)..(256): a, c, t, g, unknown or other
  modified_base (387)..(387): a, c, t, g, unknown or other
  modified_base (392)..(392): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctaattttaaaaggtgcccagtgtgaggtgcagcgtggtggagtcgtgggaggaggcttgatccaggccggtggggggtccctgagactctcctgtgcncgcctcgtggtcaccgtcagtccacacctacatgacgtcgtcgggtcccgccgacggccgtccgggaaggggacggggcgtggagtcgtcgttctttcttttatttagtagtagtaggtagtaccataccncgacncgtacgtcgggtgggacgggcctacgttaccacctactccgtaccaaagacgtaaacctaaacttaccgaaaagtaaacccgcgttcgtttccgttttaacttaaccgaaaacgtggaaaacccgtcggtaccctaagggacgtaaccgacccggtaagtaccggaaacccggtcgggtacccgtttagtacgtttacgtgggtacggacgtaaaggacggtacgtacccgggggaacccctaaacgggtaaaaccgtttaccgaaaccggtcgttaacgggtaccggtaccggtcgggtacccgggggaaccgtaacccgggggaacccg

SEQ ID NO: 382559 - DNA, 604 bp, Homo sapiens
  misc_feature: GZ8MTXP02HTAS6.13.76.G10.1.454.CMB.2.raw
  modified_base (303)..(303): a, c, t, g, unknown or other
  modified_base (343)..(343): a, c, t, g, unknown or other
  modified_base (378)..(378): a, c, t, g, unknown or other
  modified_base (408)..(408): a, c, t, g, unknown or other
  modified_base (431)..(431): a, c, t, g, unknown or other
  modified_base (471)..(471): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggtttttccttgttgcttaattttaaaaggtgcccagtgtgaggtgcagcgtggtggagtctggaggaggcttgatccagccgtggggggtccctgacgactctcctgtgcagcctgtcgggttcaccgtcagtcacacctacatgagcgtcgggtccnccgaggctaccgaaggggaaggggctggagtgcgttcttntttttattatagtagtgtaagtaccatactccganagactcgtggaggggcatcacatctcaganactaaactcaaagaacacgtctnttttacaacaaatgaaacacgtcctagaagaacgccgaangaaccgacggccttagtaacttagtgagacgaagaggtacgcgggggaccccctaaagtaaaccgtttaaccacgtaaccgtaagttcggggaccgtcggttacgggggaaaccctaaaacgggggacccccg

SEQ ID NO: 382560 - DNA, 730 bp, Homo sapiens
  misc_feature: GZ8MTXP02IHH7M.13.76.G10.1.454.CMB.2.raw
  modified_base (240)..(240): a, c, t, g, unknown or other
  modified_base (242)..(242): a, c, t, g, unknown or other
  modified_base (271)..(271): a, c, t, g, unknown or other
  modified_base (351)..(351): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagcttgggttttccttgttgctattttaaaaggtgccagtgtgaggtgcagctggtggagtctgggaggaggcttgatccaggccgtgggggtccctgagactctcctgtncngcctcgtggtcaccgtcagtcacacctanatgagcgtggcccgccagggcctccggaggggaagggcgtggagtgcgttcttctttttatttaatggtacgtggttaanactaatacctcccgactagacctcggtggacggggacctcgttccaaccattcccgtaccaaaggtagaaccctaaacttaccaaacggtaaaccacggtacttacggttttacttaaccgaaaattacgaaaccgtacgtaccgttacggaaccggaacggaccccgttaaagtaccggaacccgggtaaccgggtacccccggtttagttaaacgtttaccggttaggttacggaccgggtaaagaaacgggtaaccggtttacccgggggaaccccgtaaaacgttaaccggtaaaccgtaccgtaccgttagtacgggtaacgtaccgggtcgggtaccgaaccggggtacccttacgggacccttaacccccgg

SEQ ID NO: 382561 - DNA, 569 bp, Homo sapiens
  misc_feature: GZ8MTXP02F5MXD.13.76.G10.1.454.CMB.2.raw
  modified_base (295)..(295): a, c, t, g, unknown or other
  modified_base (365)..(365): a, c, t, g, unknown or other
  modified_base (400)..(400): a, c, t, g, unknown or other
  modified_base (486)..(486): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtgggtcccnccgaggcctccggaggggaggggctggagtgcgtcttcttttatttagtagtagtggtagtaccataccncgcagactcggtggacggggccgattccaccatcnccagagacaatccaaagacacgcttgtttactacaaatcgaaacagccgtagagacgaccgatacgacgacggcgtagtattacgngtcgacgtagaggacgtcggggacccaacggtaacgttacgacgaactagtacggacgtcggtacgggaccgaacggtacccg

SEQ ID NO: 382562 - DNA, 606 bp, Homo sapiens
  misc_feature: GZ8MTXP02FP9AK.13.76.G10.1.454.CMB.2.raw
  modified_base (476)..(476): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtgggggtccctgagactctcctgtgcagcctcgtggtcaccgtcacgtcacacctacatgagcgtcgggtcccaccgaggcctaccggaggggaacgggcgtggagtcgcgttcttcttttattatagtagtgtagtactatacctcgacagtacctcggtgggacgggcgtacttccacctactctaccaagacaaactaacgttaaccaaagaaccctacgtctttcgtttaacacaaaagtcgaaaacngcctagagacgaccgtatcgacgcggcgttatattacgtgcgcggagtagacggtcggggacccctaaacggaacctttacgacgtcgtagtcgggacccgttggaccgggacccgaaagggtaaccccg

SEQ ID NO: 382563 - DNA, 723 bp, Homo sapiens
  misc_feature: GZ8MTXP02H5ZOG.13.76.G10.1.454.CMB.2.raw
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggtcttgactccgacggcccggttcggggggtccctggacgtaccgttccttccgtggtcgcgtcgccttcgtcggggttccaccgtcacgtccaccacctacatgacgcgtcgggtccgccgtacggcctccggaaggggacggggcgtgggagtcggtccgtttcgtttactttttatttagttaggttaggttggttaacgtacctaactaccgttaccgacgtacgaccgttaccgggtggggaaccgggggtccgtaacgttccgaacctactcctaccgaacgtacgaaacctaacttaaccgaaaacgtaacctaaccgttcctttacgttttacctaactaaagtacgaaacgtacgtaccgtgagaccggaccgtacgttacgacccggtacggtccgtagtttagttacgtggtacggacgtaggacggacggtacggggaccctacggtaacgttacgacgtcgtacggtcggtaccgtcggacggggaccgtaaacggacccg

SEQ ID NO: 382564 - DNA, 609 bp, Homo sapiens
  misc_feature: GZ8MTXP02IAWF7.13.76.G10.1.454.CMB.2.raw
  modified_base (229)..(229): a, c, t, g, unknown or other
  modified_base (291)..(291): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccagcatcacctgctctaggaaatattggnagataaatatactctgtatcagcagagtcagccagtcccctgtgctggtcatctatcaaagntagaccaggccgccctcgaggactccccgtgagcgtattctcgtcggcctccctaacgtccgtaggaacctcgacgcccactctacgacctcgtaccgacgacccgggtacccaggtacgtagtggaagtcgggaggtccgtacggttacttagttaccgtacggttaccggaacggggtccgggtagggaaccgaggccgaaacggcccgtaacggtcccggccccgttagttaccgttcggttacccgttaccgggtacgtaccggggaacccgtacggacccgtaccgtaccgtaacgtacccgacgaacccccg

SEQ ID NO: 382565 - DNA, 544 bp, Homo sapiens
  misc_feature: GZ8MTXP02I9H4R.13.76.G10.1.454.CMB.2.raw
  modified_base (256)..(256): a, c, t, g, unknown or other
  modified_base (269)..(269): a, c, t, g, unknown or other
  modified_base (390)..(390): a, c, t, g, unknown or other
  modified_base (394)..(394): a, c, t, g, unknown or other
  modified_base (400)..(400): a, c, t, g, unknown or other
  modified_base (411)..(411): a, c, t, g, unknown or other
  modified_base (420)..(420): a, c, t, g, unknown or other
  modified_base (427)..(427): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtcctgagactctcctgtgcagctntgggtcaccgtcngtcacacctacatgagctgggtccgcaggctccgagggaagggctagggagtgcgtcttcttttatttataggtactggtatacatactccgcagacgtcgtaggagggccgtattcgacngtcncagganacgatacgaanacacgcttnttctaanaatgacacgtcgagagacgccgagtacgacgacggtcttagtacttacgcgcgagagacggacgtcgggaccaagtaacgtaacgtacgtacgtacgacggacgtcggacggaaccg

SEQ ID NO: 382566 - DNA, 670 bp, Homo sapiens
  misc_feature: GZ8MTXP02I1T0T.13.76.G10.1.454.CMB.2.raw
  modified_base (173)..(173): a, c, t, g, unknown or other
  modified_base (250)..(250): a, c, t, g, unknown or other
  modified_base (266)..(266): a, c, t, g, unknown or other
  modified_base (550)..(550): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttcttgttgctattttaaaggtnccagtgtgaggtgcagctggtggagtcgtgggaggaggcttgactccgaggccgtgggggtcctgagactctctgtncagcctcgtcggttcnccgtcacgtcaccacctacagtgacggtcgtcgggtcccgccgacgggtccgtaccggaaggggaacggggtcgtgggacgtcggtcgttctttactttttaagttagtagttagtacggttagtaactactacctcgacgacgccgttcggcgggtacggggcctacgttaccaccgtacttcccgtacgaaagaacgaactaaacttacccgaaaagaccgacgttcctttacgtttactaacgaaattacggaaaccagtaccgtaggaacgacgacccgngtcgaaaccgtcgggtcctaggttatcggtgtgacggaaagaggacgggtccggaacccgtaagtaaccggtttaacgcggttaacgtacggtcggaccggttgggaaccgggtaaccgg

SEQ ID NO: 382567 - DNA, 694 bp, Homo sapiens
  misc_feature: GZ8MTXP02HTCKY.13.76.G10.1.454.CMB.2.raw
  modified_base (255)..(255): a, c, t, g, unknown or other
  modified_base (528)..(528): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggtcttgactccgagccggtcgggggtcctgagactctcctgtgcngcctcgtcggttcaccgtcagtcacacctacatgagcgtcgggtccgccgaggcctaccgggaggggaacggggcgtgggagtcgtcgttctttactttttagtttaagtaggttacggttaggtaactacctacgtacctccgacgacgtaccggttccggtggggaccgggggacccgtattacccgaaccgtactacctaccgaagtaactaaccgtaaactaccgaaaacgtaccctacgtcttttacgtttacaataaactcgaaacncgtcctaaggagtaccgaccgtagtaccggacgtacccgggcgttagtttaactcgtggtacgacggtagaggtacgggacccgggaccctaacgtaaccgttaccacggtcgttacggtacgggtacggttaccggaccgggggaaccgtaaacgggtacccccg

SEQ ID NO: 382568 - DNA, 822 bp, Homo sapiens
  misc_feature: GZ8MTXP02JHQ04.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgactccacggtcccggtggggggtccctggacgtacctccgttcctggtcgcacggtccctcggtcgggttccaccgtcacgtccacacctacagtgacgcgtcgggtccgccgagggcctcggaaggggaacggggtcgtgggacggttcggtaccgtttctttacgttttttaagttttaagttaagggtttacggttacgggtttaaacgtaaccccgtaagttaacccgtccccggtacgtaacgggtaaacccggttcccggggtacgggggtacggggggtaccccttaacgtttacccctaaccgtaaccgtttcccgtaacccgaaaggtaaccgtaaaaccttaacgttaacccgaaaagtacccgtaccgtacgtttctttaccgtaaactaaacgttacgaaactacgtaccgtaggaacgacgtaacccaagtcgaacccggaccggttcgtagttacgtacgtggcgtacggaaacggtcggtaaccggtacgggggaaccccttaacgggtaaaaccgtttacgtaaccgtaacgttacggtaccggggtaacggtccgggttaacccggggaaccggaacgggtaacccccgg

SEQ ID NO: 382569 - DNA, 600 bp, Homo sapiens
  misc_feature: GZ8MTXP02FNHDZ.13.76.G10.1.454.CMB.2.raw
  modified_base (300)..(300): a, c, t, g, unknown or other
  modified_base (319)..(319): a, c, t, g, unknown or other
  modified_base (323)..(323): a, c, t, g, unknown or other
  modified_base (360)..(360): a, c, t, g, unknown or other
  modified_base (404)..(404): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcaagtcacacctacatgacgctcggggtccccncgaggctcggaggggaggntggngtcgcgtcttctttattagtagtgtaggtatacatcncgacagtaccgtcggtggacgggtcctataccacatccacaganacaactacaaagacacgtcttagttactaataaactagaaacagaccgtagacgacgacgtagtacgacgcggtacgtacgtagttacgtggtcggacgacgggaggtacggtaccggggaccctaaacggtaaaccgttacgtaccgcgtaacgtacgggtacggttacggtacggggaccgtaacgggtacccg

SEQ ID NO: 382570 - DNA, 710 bp, Homo sapiens
  misc_feature: GZ8MTXP02HI0EA.13.76.G10.1.454.CMB.2.raw
  modified_base (557)..(557): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtgggaggaggcttgatccaggccggtgggggtccctgagtacctctccgtgtcgcacgcccgtcgtcgggttccaccgtcacgtcaccacctacatgagtccgtgggtcccgccgagggcctaccggaaggggaacggggtcgtgggacgtcggtccgttctttacgtttttaatttagtaggttaggtacggggttaactacgtactaccgtccgaccgaacgtcccgttaccgggtagggacgggggtaccccgtattacccgacccgtaactccccgtacaacggacgtaaacctaacttacccgaaacggaaccaccggtctttacgtttacctacaaaatcgaaacncgtcctaggacgacgtaccgatacggaccgtacggtccggttagttacttacgtaggtacgaggaacggaggtacggtacccggggaccctaaacggttaaccgtaaccgtacacgttacggtacggtaccgtaccggggtacgggaacccgg

SEQ ID NO: 382571 - DNA, 669 bp, Homo sapiens
  misc_feature: GZ8MTXP02FJEFE.13.76.G10.1.454.CMB.2.raw
  modified_base (331)..(331): a, c, t, g, unknown or other
  modified_base (511)..(511): a, c, t, g, unknown or other
  modified_base (536)..(536): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttaattttaaaaggtgcccagtgtgaggtgcagcgtggtggagtcgtgggaggaggtcttgactccgacggtccggtcggggggtccctggagtaccttcctccgtgtcgcacgtccttcgtgggttccacccggtcacgtaaaccaccacctacatgacgtcgtcgggtccncgacggcctaccggaggggaaggggctggagtgtcgtcttcttttattatagtagtggtatactactaccgtcgacacgtaccgtcggtgggcgggggacctagttccacctatccgtacccaagacgaactaacttaccaaaggaacacgtcttagtttcctaactaaaatcgaaaacncgtaccgtaggacgtcgacccgtanacggaccgacgggtcctagtacttacgtgagtccgagagtacggccgggtacccaaacggttaaacccgttcgtaaacgtccgtaacggtccggtacgtcccgggtacgggggaccgaaacggggaacccccg

SEQ ID NO: 382572 - DNA, 657 bp, Homo sapiens
  misc_feature: GZ8MTXP02FLZA5.13.76.G10.1.454.CMB.2.raw
  modified_base (509)..(509): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggtagttttggctgagcttgggttttccttgttgctattttaaaaggtgcccagtgtgaggtgcagctggtggagtcgtggaggaggcttgatccagccgtgggggtccctgagactctcctgtgcacgcctcgtgggttcacccgtcagtccacaccgtacatgagtcgtcggtccgccgaggcctacggaggggaacggggcgtggagtgccgttcttcttttatttagtagtagttggtagtacctatacctcgacacgtaccgtccggtcgggcggggaccgtacttcccgaaccacgttccctaccgaaaggaacgtaaaccctaaacttaaccgaaaacgtaaacccgtccgtccgttttaggtttaccccttaaaanaaacgtacgaaacgtcgaccgtaggacgacgaccgagtacgaccggtacggtcgtagtactcgtgacgacgaggacggtcgaccggtaaccctacgtaaccgtcgtacgaagttacgacggacggtcgggacggaccggaacggaccg

SEQ ID NO: 382573 - DNA, 730 bp, Homo sapiens
  misc_feature: GZ8MTXP02JWT4D.13.76.G10.1.454.CMB.2.raw
  modified_base (289)..(289): a, c, t, g, unknown or other
  modified_base (304)..(304): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgccctagtgtgaggtgcagcgtggtggagtcgtgggaggaggcttgatccaggcccggtggggggtccctgagactctcctgtgcagcctcgtcgggtcaccgtcagtccaccacctanatgagcgtcggtccnccgagcctcggaggggacggctggagtcgcgttctttacttttattagtaggttagtaggtacgtaccctataccgtccgacgtacgaccgttcgggtggggacggggtaccctacttaccaccgtactccgtacccgagtaacgtaaactaacgttacccaaagaacccgtacggttcctttacgtttaaccgttaaacaaaagttacgaaaaccgtcgtacccgtaaggaaggacccggtacccggaagtaaccggacccggtaaccggggttacccgttaggttaaccttaccgggtgtcggaacgggacggagtaccggggtaccggggaaccctaaaccgggtaaaccgttaccgtaccgaagttaccgggacgggtacccggtacgggtaccggggaacccggtaaacgggtacccccgg

SEQ ID NO: 382574 - DNA, 634 bp, Homo sapiens
  misc_feature: GZ8MTXP02FRFCN.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctggggtcaccgtcagtcacacctacatgagcgtcgggtcccgccgaggcctccggaggggaggggcgtggagtgcgtcttcttttatttatagtagtggtatacatacctcgcagtacctcgtgggacggggccgattccacctatcctaccagagaaaccaattaccaaagtaaccacgtcttgtttacctacaaaattcgaaacagcctaggagacgaccgaagtacgacgaccgggtccttagttattacgtgggtacgacggaaggacgtaacgggttcgggggacccccaaacgggttaaaccgttacccgttaacggcgttaaacgtcggggtaccggttacggtccgggggaaccctaacgggggaaccccg

SEQ ID NO: 382575 - DNA, 615 bp, Homo sapiens
  misc_feature: GZ8MTXP02IW4SN.13.76.G10.1.454.CMB.2.raw
  modified_base (371)..(371): a, c, t, g, unknown or other
  modified_base (381)..(381): a, c, t, g, unknown or other
  modified_base (385)..(385): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggctgatccagccgtgggggtccctgagactctcctgtgcagcctcgtcgggtcaccgtcagtcacacctacatgagcgtgggccccgccgaggccgtccggaggggaggggcgtggagtgcgttcttcttttattagtagtagtggtataccatactccganagaccgtcgngggngggccgtacttcaccactctccaagagactaactaccaaagaacacgtcttacgtttactacgaaatcgaaaccagtcctaggacgacgacgaagtcgacgtacggtcgtagtacgttgcgttggtcggacgtacggaggtccgggtacgggaccccgtaaaccggtaacgtttaccgaacgtacgtacggtcggtaacccggtcggtacgggggaacctaaaccggggg

SEQ ID NO: 382576 - DNA, 587 bp, Homo sapiens
  misc_feature: GZ8MTXP02G6381.13.76.G10.1.454.CMB.2.raw
  modified_base (248)..(248): a, c, t, g, unknown or other
  modified_base (266)..(266): a, c, t, g, unknown or other
  modified_base (272)..(272): a, c, t, g, unknown or other
  modified_base (304)..(304): a, c, t, g, unknown or other
  modified_base (306)..(306): a, c, t, g, unknown or other
  modified_base (317)..(317): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttcgtgtagctatttaaaggtgccagtgtgaggtgcagctggtggagtctggaggaggcttgatccagcctggggggtccctgagctctcctgtgcagcctntgggttcacgtcagtcanacctantgcgcgtcggtcgcgcgcgtacgaggaggcgngngtgtcgtcttntttattagtagtagtagtagtactatactacgacacgtacgtcgtcggacggacgtactacactactctacgacgacgactaactactaacgaactacgtacgttacgttactaactaacgtacgaacgtacgtacgtagagacgacgtacgacgacgacgtacgtacgttacgtacgtcgtgtacgaggacggtacggtacggtaccgtaaccgtaacgtaacgtacgtaacgtacgtacggtacgtacggtacggacggacggtaccg

SEQ ID NO: 382577 - DNA, 711 bp, Homo sapiens
  misc_feature: GZ8MTXP02JT1KV.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtgggaggaggcttgatccgagccggtgggggtccctgacgtactctccgtgtgcacgcctcgtcgggtccaccgtcagtcaccacctacatgacgcgtcgggtccgccgaggccgtaccgggaggggaacggggcgtaggaggtcgtcgttctttactttttatttagtaggttaggtggtagtacctactaccgtccgacacgaccgttcggtgggacggggtccgtacttccgacctctacctaccgaaagacgtaaacctaaacttaccgaaaagaaccctacggttacctttacgttttacctaaacgtaaaagtacgaaaaccgtcggtacccgtagggaaacgccgggtacccgtaagtaccggaaacccggtaccgggtccgttaaggttacttacgtggtacgacggaacggaggaccgggtccggggaacccctaacggtaaaccgttcacggtaacgtaggtcggtacgtcggtaacggggacccaacggggtacccc

SEQ ID NO: 382578 - DNA, 642 bp, Homo sapiens
  misc_feature: GZ8MTXP02IVFK7.13.76.G10.1.454.CMB.2.raw
  modified_base (235)..(235): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcatcactctcctcgctcactgcacagggtcctgggcccagtctgtactgacgcagccgccctcagtgtctggggccccagggcagaggtcaccatctcctgcacgtgggancagctccaacagttgggcacgattatgatgtacacgtggtaccagctagtttacccgaggtacgcgacggtcccagtacctcctacatacaaacgtacgtaaactaacgaaactccggccccgacgacgggggtcccctaggacccgtacttcctcgtacgggccctccgtacggttctacggcctaccttccgacgtccctcccgtcggtacctacgtcctaacgtcggtcctaccggaggtccgtagggaaggagtcggtaacggtcttaggttaactttacgtttctcggttaccctacggtttaccctagttacgaccgtacgaccgtaccgtaccgtgtaaccggttacggttcgtttaaccggggttcggtttaccccgggggtaacggggggtacccccg

SEQ ID NO: 382579 - DNA, 773 bp, Homo sapiens
  misc_feature: GZ8MTXP02F8OEW.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaggtgccagtgtgaggtgcagctggtggagtcgtggaggaggcttgatccagccgtgggggtccctgagactctcctgtgcacgcctcgtggtacttctacctttgatgtattatcgaccatcgctacggtcgggtccggacaacggccgtaccggaaggggaacgggccgtagggtaggtcgggttctacgtagggttagtttaggttaggtaaagttaggtaggtaagtacgtaagttagggtcgttaagtcggtacggtaccgttcgttagggtaacgggtaaaccgggacccgttaactttacccaaacccttacgttcccgtaacccgaaaggaaaccgaaaccgaaaacccgaacccgaaaacggtaacccttaccccgttaggtaaccttaccgttagaaaccctaaaagtacgaaaaccgacggtaccgtaggaacgtacggacgtagggaaccggtaaccgtaccggggttacctttaagttaacgtttaacgttaggtaaacgaaacgtaaaaacggtaacccttaaaccccgttaaaaccccgttttacggtttaaggtttttacgggtaacggtttacggtttaaacccggg

SEQ ID NO: 382580 - DNA, 736 bp, Homo sapiens
  misc_feature: GZ8MTXP02JW72N.13.76.G10.1.454.CMB.2.raw
  modified_base (383)..(383): a, c, t, g, unknown or other
tcagtcacgtactacacgaccggtgctcgatttagtcactcatacagggggggagagggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagtcctcgtgggttccaccgtcagtcaccacctacagtgacgcgtcgggtcccgccgaggcctccggaggggaggggctggagtgccgttcgtttacttttattatagttagtggtagtaccatactccganacgacctccggtgggaacggggcctattccacctatcctaccgaagtacgtaaactaacgttacccgaaaacggtaaacctaccggtactttacggtttttaaccttaaccgaaaagtttacggaaaacccgtacggtaccccgttaagggaaacgaccggtaccccggtaattaccgggaacccgtaacccggggtcccgttagttaacgtttaccgtggtacggacggtaagggacgtacgggtaccgggggacccctaaaaccggggtaaacccgtttacgaccggtcgttaacggtacggggtaacccggtttccgggaccgggggacccgtaaaacgggaacccccgg

SEQ ID NO: 382581 - DNA, 640 bp, Homo sapiens
  misc_feature: GZ8MTXP02GAZYE.13.76.G10.1.454.CMB.2.raw
  modified_base (380)..(380): a, c, t, g, unknown or other
  modified_base (393)..(393): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagtttggctgagctgggttttccttgttgctattttaaaaggtgcccagtgtgaggtgcagcgtggtggagtcgtgggaggaggtcttgactccgaggccggtcggggggtccctggacgtactcctcctgtgcagcctcgtggtccaccgtcagtccacacctacatgagcgtcgggtccgcgacggcctaccggaggggagggcgtggaggtgcgttcttcttttattatagtagtggtagtacctatccncgcagacctcggnggcgggcatccaccatcctacagacactaactaccaaagtacacggtcttagtttactacaaaatcgaaacacgtccaagagacgacgagtacgacccggtacggtccgttagttacgttacgtggacgacggaggacgtacgggtaccggggaacccaaaccgggttaaccgttaacctacggtaacctacggggttcggtaaccggtcgggtaccggggaacccggtaaacggggtaacccccgg

SEQ ID NO: 382582 - DNA, 656 bp, Homo sapiens
  misc_feature: GZ8MTXP02IOGBY.13.76.G10.1.454.CMB.2.raw
  modified_base (250)..(250): a, c, t, g, unknown or other
  modified_base (298)..(298): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaggtgcccagtgtgaggtgcagctggtggagtcgtgggaggaggcttgatccagccgtgggggtccctgagactctcctgtgcngcctcgtgggttccaccgtcagtcacacctacatgagcgtcgggtccnccgaggcctccgaggggaagggctgggagtgtcgtctttctttttatttagtaggtagtggtagtacatacctccgcacgactccggtggcgggggcctacttacgaccctatcctacgagacgaactaattaaccaagaacacgtcttcgtttctacaaatcgaacagtccaggacgacgaccgtagtacgaaccgtcggtccgttgttaacttcgtggtcgacggaacggagtaccgggtaccgggggtacccctaaacgggttaaccgttaaaccgtccggttaagtaacggttcggggtaaaccggttccggggacgggggaacccgtaaaccgggggacccgttaacccgggg

SEQ ID NO: 382583 - DNA, 654 bp, Homo sapiens
  misc_feature: GZ8MTXP02GGTTW.13.76.G10.1.454.CMB.2.raw
  modified_base (252)..(252): a, c, t, g, unknown or other
  modified_base (457)..(457): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgactccagccgtggggggtccctgagactctcctgtgcncgctcgtggtcaccgtcagtcacacctacatgagcgtcggtccgccgaggccgtccgaggggaaggggcggtggtaggtcggtcgttcttcttttagtttagtagttaggttaggtacgtacctacgtacctccgacacgaccgtccgtgggacgggaccgtacttccgacctactctaccagtacgaaacaacttacccgaaanaaactcgtaccttgttttactaacgaaataggaaaccctagaccgtagacgtacggccgtagtacgacggtaccggtcggttaagtacttacgtggccggacggaggtagacggtaccggggaccctaacgtaaccgttacgtaacgcgttacggacgggttacggtaccggtacgggggaccaacgggggtacccc

SEQ ID NO: 382584 - DNA, 803 bp, Homo sapiens
  misc_feature: GZ8MTXP02FM2X3.13.76.G10.1.454.CMB.2.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcacacctacatgagcgtcgggtccgccgaggccgtacccggaaggggaacggggtcgtaggggtaggttcggtccggtttcctttacgtttttttaattttaagttaaggtttaaggtttagggttaacgttaacctaacgttaccgtaccccggactaacggtacccgttcccggggtacgggaacggggggtcccgtaacgtttacccaaccctacttcccgtacccgaagaacgtaactaaacttacccgaaaagtaaacccaccggttcttacggttttaccttaactaaaagttacggaaacctacggtccctaggaacggacggaccgtaacgttaccggaccgtaccggggtaccgtttagttaacgtttacgtacggtacggtaccgggtaaaggtaacgggaccgggttaccgggggaaccccctaaacggggtaaaccgtttaaccgtaaccggttaccgttaaacgggtacggggtaaaccggtttccggggaccgggggtaacccggaaaaccccggggg

SEQ ID NO: 382585 - DNA, 564 bp, Homo sapiens
  misc_feature: GZ8MTXP02HWGKM.13.76.G10.1.454.CMB.2.raw
  modified_base (229)..(229): a, c, t, g, unknown or other
  modified_base (250)..(250): a, c, t, g, unknown or other
  modified_base (297)..(297): a, c, t, g, unknown or other
  modified_base (328)..(328): a, c, t, g, unknown or other
  modified_base (377)..(377): a, c, t, g, unknown or other
  modified_base (452)..(452): a, c, t, g, unknown or other
  modified_base (473)..(473): a, c, t, g, unknown or other
tcagtcacgtactacacgaccggtgctcgatttagtcactcatacaggggctgggcctcaggaagcagcatcggaggtgcctcagccatggcatggatcccctctcttcctcggcgtccttgcttactgcacaggatccgtggcctcctatgagctgactcagcccacctcagtgtccgtgtccccaggacagacagccagcatcacctgctctaggaaaataatgganagaataaatatactcaggtancaagcaagaagtcaggccagtcccctgtgctggtcatctatcaaagntcgacaagccggaccctgaggactcccccgngacgcgtattcgcgtcggtcctaccaacgtccgtacgggaacctccganacccctactcacgaccctagacccgacgcccgggaccacggtactaggtcgagacggagtcgtagacttattcgngtacgagggtcgacgggaacncgacgacgacgtaccgcgacctacgtagtcggtacgtacggaacgtaccggtaaccgacggtacctaccgtacgaacgtaccaccgacccg

SEQ ID NO: 382586 - DNA, 810 bp, Homo sapiens
  misc_feature: GZ8MTXP02FR1M0.13.76.G10.1.454.CMB.2.raw
  modified_base (259)..(259): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggtcttgactccgaggccggtcgggggtccctgacgcttctccgtgtcgcncgtcctcggtcggtcaccgtcacgtcaccacctacatgacgtcgtcgggccgccgacggccgtacgggaacggggtaacggggccgtaggggacgtcggtccggtttaccttttacgtttttaagtttaagtaaggttacggttaggttaacggtaaccccttacgtacccaccggtccgaacggtacccgttcgggtacgggggtaccgggggcctaacgttacccaccctaacgttacctacccgaaagggactaaaaccctacttaaacccgaaaacggtaaccgtacccggtcctttttaggtttacccttaaagaaaacgttcggaaaaccctacggtaccctaaggggaaccggaccgtaccccggggttaacgtacccggtaaccggtaccggttacgtttacgttacgtttacggtgggtaacggacgggacgtacgggtaccgggtaccgggtaaccccgtaaccggttaaccttacggtaccggtaacgtacggtcggggtacccggcggggtaaccgggaacccggtaacggggtacccg

SEQ ID NO: 382587 - DNA, 688 bp, Homo sapiens
  misc_feature: GZ8MTXP02F5KDP.13.76.G10.1.454.CMB.2.raw
  modified_base (217)..(217): a, c, t, g, unknown or other
  modified_base (236)..(236): a, c, t, g, unknown or other
  modified_base (246)..(247): a, c, t, g, unknown or other
  modified_base (250)..(250): a, c, t, g, unknown or other
  modified_base (283)..(283): a, c, t, g, unknown or other
tcagtcacgtactacacgaccggtgctcgatttagtcactcatacagggggcctgggcctcaggaagcagcatcgggaggtgcctcagccatggcatggatccctctcttcctcggcgtccttgcttactgcacaggatccgtggcctcctatgagctgactcacgccaccctcagtcgtccgtgtccccaggacagacagccagcatccactgctnagaaataatgcagataatntactctgtannagnagatcacgccagtccctgtcgctggtcatctanacgaagatcgaccgaagccgtacctgacggtacctcccccgtagacgcgtacttcgtacgtcggtccctaacctaacgttcgtacgggtaacctccgagtacccctaccgttcgacccgaacccgtagtacccgaacccgggggacccggggtaacccgtacgggtaacgttaaccggtacggggtaacggttagggaaccggtaccggttaacggttaaacctttaacgttaaacccgggttggtaaacggcgggggtaccggtaacggggaacgtaaccgacggacgtaacccgtacggtcccgttacccggtctttaacgggtccttacggggttacccggaacggtacggtaaaccggtacgtacccgtaccggtaccgtaacgtaccacccgaaccccgg

SEQ ID NO: 382588 - DNA, 692 bp, Homo sapiens
  misc_feature: GZ8MTXP02GZIJW.13.76.G10.1.454.CMB.2.raw
  modified_base (172)..(172): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgcccaccctnagtcgtcccgtcgtccccaggacagacagccagcatcacctgctactaggaaataagtggacaagaattaaatacttacttcctaggtactcgagacaagaacgtcgacggccctacgtcccctggtcgcgtggtcctagttactaactacgaaagtacgtacgacccgtaacggccccggtaccccgtacgaacggggtacctcccccgtagacgtcgtacttctcgtcgcctaccacgtcggtacggaacctcgaccgtcccgtactcgacgaaccacgtaccgacgggacccggacccgaggtccgtaagtggtacgtacggacgtacgtagttaacgttagttacgtgtacggacggtacgggtacggacgacggacgtacgtaccgtaccgcccggtaccgtacgttaggttacccgttaccgggttaaccggtaaccgggtaaccggtaaaccgtaaccgggttacccgttaacccggtaccgttaaccggtacccgaacccggtaaacccccg

SEQ ID NO: 382589 - DNA, 676 bp, Homo sapiens
  misc_feature: GZ8MTXP02IDU97.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgatccagccgtgggggtccctgagactctcctgtgcagcctcgtggttccaccgtcagtcaccacctacatgacgcgtcgggtccgccgaggcctaccggaggggaacggggtcgtgggagtcggtccgttctttactttttagttagtaggttagtggttagtaaccactacctcgacagtaccgtccggtggggacgggtccgtacttccgacctactcctcccgaagaccgaactaaactcccgaaaagtaacctaccgtctttacgttactaaccgaaatcgaaaactcggtacctaggaacgagacccgatcggaacccgcggtccttaggtaaccttgaggtaacgcggaaagcggtaacgttacccgggggaaccccttaaacggtaccgtttaacaccggtaacttacggacggtcggttaccgcgggggaacccgaaacggggtacccccgg

SEQ ID NO: 382590 - DNA, 685 bp, Homo sapiens
  misc_feature: GZ8MTXP02JWIXO.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccgagccgtgggggtccctgagactctcctgtgcacgcctcgtggttcaccgtcagtcacacctacatcgacgcgtcggggtccgccgacggcctccggaggggaaggggctgggagtgtcgtcttctttattagtagtagtggtagtacatactcgacgacgtccgtccggtaggacgggggtcctacgttccaaccgtactacctaccgaagtacgaacctaaacttacccgaaagtaaacccacggttaccctttagttttacctaacgtaaaactacggaaaacctcggtaccctagggaacggtacgaacccgtagtaacggtacggtacgggtaccgtttagtacgtttaaccggttgtacgggcgtaaaggtacggtaacggtccggggaacccctaaggtaaacccgtttaacgaccggtacgttaggtcggtaaccggtcggtacccgggggaacccgg

SEQ ID NO: 382591 - DNA, 636 bp, Homo sapiens
  misc_feature: GZ8MTXP02IPIDH.13.76.G10.1.454.CMB.2.raw
  modified_base (520)..(520): a, c, t, g, unknown or other
  modified_base (527)..(527): a, c, t, g, unknown or other
  modified_base (541)..(541): a, c, t, g, unknown or other
  modified_base (570)..(570): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgtccagtgtgaggtgcaagtggtggagtcgtgggggggcttggttaagccgtgggggtccctcagactctcctgtgcaacctctggattctattttctctgacgccctggttgagctggggtccgccgaggccgtccccggggaaggggccgtggacggttggggttgggaccgttaagttaaaagggtagaaagacgtagtgggtcgggaacaaacagactaacgagttcggttacccccgtaggaaaagggccaaggtaattacacgtactctacaaaagaggaactaggaacttaacgaaaaaggtaaatggaatatatctagaacaaatagaactaacagaaaangagacanagggctagtatacncgtacacgtagagtgggaccagatcgaanaaaacgtcgggacgccgaacgtaagttacgaccgtacggtcgggggaccggaacggacccttacgg

SEQ ID NO: 382592 - DNA, 667 bp, Homo sapiens
  misc_feature: GZ8MTXP02HRERM.13.76.G10.1.454.CMB.2.raw
  modified_base (273)..(273): a, c, t, g, unknown or other
  modified_base (471)..(471): a, c, t, g, unknown or other
  modified_base (489)..(489): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccaggccgtggggggtccctgagactctcctgtgcagcctcgtggttccaccgtcngtcacacctacatgagtcgtcgggtccgccgacggcctaccggaggggaaggggcgtggagtcgcggttctttctttttatttatagttaggtggtaacgtacatcctcgacacgtaccgtccggtggggacggggccgtactttccgaccctagtcctcccgaaagacgaaactaattacccaaaggaaccaccgtntttaccgtttacctaaanaaactacgaacgtacgtaccgtaggacgacgccgagtacggaccgtaccggttacgttagttacgttacgtgtacggacggaacggacggtacgggccgggaaaccctacggttaaccgttacgacgtaacgttacggtccggtacggtcgggtaccggggaccgtaacccggtaccg

SEQ ID NO: 382593 - DNA, 844 bp, Homo sapiens
  misc_feature: GZ8MTXP02HDZ9O.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtcgggtcaccgtcagtcacacctacatgacgtcgtcgggtccgccaggccgtaccgggaagggggaacggggcgtaggggacgttcggccggtttcctttacttttttaagtttagttaagggtttaggttagggttagtaaccccgtacgttaccgtccgacgacgtacccgttcgggtcggggacgggggtcctacgtttaccaaccctactcccgtacccaagggtaactaaaccgtaaaccttaccgaaaaggtaaaccctcgttacgtttacgttttacttaacaaaacgttcgaaaactcggtaccgaggaacgaccggacccgtaaagtccggaaacccggttccggggtacccgtttaaggttacccgttttaacggggtacgggttaacgggaaacgggtaacgggtaacgggtaccgggggttaccccgggggtaaacccccgttaaaaccggggtttaaaacccgttaaccggttaaaccgggtaaccgtttaaacgggggttaaccgggttaacccggggttacccgggggaaacccgggggtaaaaccccgggtaaaacccgggggtaacccccg

SEQ ID NO: 382594 - DNA, 624 bp, Homo sapiens
  misc_feature: GZ8MTXP02JJA02.13.76.G10.1.454.CMB.2.raw
  modified_base (475)..(475): a, c, t, g, unknown or other
  modified_base (487)..(487): a, c, t, g, unknown or other
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtggggggtccctgacgactctcctgtgcacgcctcgtgggttccaccgtcagtcacacctacatgagcgtcgggtcccgaccacggcctaccggaggggaacggggcgtaggacgtggctacttctttactttttatttataggtagtggtacgtacatactcgacagactccggtggacgggggcctacgttccacgtactcctaccgagaacaactaacttaccgaaagtacacgtcttacgtttacctanaaatacgaaacngtacccgtagacgacggacacgtgaaccgtcggacgttagtactagtggtacgacggagacgtacggcggggaccctaacggtaacgttacgaacggtacctaggtcggtacgtcggtacggggaccgaaaccgggg

SEQ ID NO: 382595 - DNA, 724 bp, Homo sapiens
  misc_feature: GZ8MTXP02FG038.13.76.G10.1.454.CMB.2.raw
  modified_base (283)..(283): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctggagactctcctgtgcagcctcgtgggttcaccgtcagcacacctanatgacgcgtcgggtcccgccgaggcctaccggaggggaacggggcgtgggacgtcggtcgttctttactttttaagttagttaggttaggttacggttacgttaaccgtaacttaccgtccgacgaacggtaccgtccgggtacgggtacgggggtacccgtaactttaccgaaacctaccttaccgtaccgaacggaaacgaaactaaacgttaacccgaaaagaaacccccccccgtaagtaccgtttacgtttacttaaactaaaacgtaacgaaacgtacggaccgtaggaacggacgaccgtaagtacggaaccgtaccggtccgtaagttacgttacgtaggtcggtacggaagacggacggtaccggggaacccgaacggtaaaccgtaacgtacgtacgtacggtacggtacggtcggtacggggaaacccgg

SEQ ID NO: 382596 - DNA, 619 bp, Homo sapiens
  misc_feature: GZ8MTXP02H59BD.13.76.G10.1.454.CMB.2.raw
  modified_base (256)..(256): a, c, t, g, unknown or other
  modified_base (522)..(522): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctaattttaaaaggtgcccagtgtgaggtgcagctggtggagtcgtgggaggaggcttgatccagccgtgggggtccctgagactctctgtgcagcctntcggttcaccgtcagtcacacctacatgagcgtcgggtccgccgaggcctccggaaggggaaggggcgtgggagtgtcgttcttctttttattatagtagtaggttagtaccatacctccgcagacgtcgtggacggggcctacgttccacctatccacctagagactaacttaccaaagaaccacgtcttacgtttctaactaagtacgtaaacacgtccgtagacgtacgccgaatcgaccgacggtccgtagttactacgtgngtacgaggtagcggtacgggggaccctacggtaaaccgttacgacgtaacgtacggtcgggaacggttcggacggggaccgtaaacggggtaccccg

SEQ ID NO: 382597 - DNA, 784 bp, Homo sapiens
  misc_feature: GZ8MTXP02IY54Y.13.76.G10.1.454.CMB.2.raw
  modified_base (272)..(272): a, c, t, g, unknown or other
  modified_base (298)..(298): a, c, t, g, unknown or other
  modified_base (389)..(389): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgacggactctcctgtcgcagcctcgtgggttcaccgtnacgtcacacctacatgagcgtggccnccgaggctccggagggaggggctggagtcgcgttcttcttttaattacgtagtagtaggtacactactacgtccgagacgtaccgttcggngggtaaccggggtccctaaacgttccaacctaacttcccgtacccgaaagggtaaccgaaacctaaaaccttacccgaaaacgaaacccggtacgtctttacggtttaaccttacggaaaacttacggaaaacttccgaaccgttgggaaaacgtacccggtcccggtaaaaagtcccgtaaaacccggggcccccggtacggttaagttaccgttttaaacgggtcgggtaaccgggtaacggtaagggaaacggtaccggggttaccccggggtaaacccgtaaaccggttaaaccggtttaacccggtaaccggtaacgttaaccggggtacccggggtacccggttaaccgggggtacccgggggtaacccggtaaaacccggggtccccg

SEQ ID NO: 382598 - DNA, 698 bp, Homo sapiens
  misc_feature: GZ8MTXP02GHKCT.13.76.G10.1.454.CMB.2.raw
  modified_base (230)..(230): a, c, t, g, unknown or other
  modified_base (474)..(474): a, c, t, g, unknown or other
  modified_base (487)..(487): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccagcatcacctgctctagaaataagtganagataatactacttcagtactcagacagaacgtcacggcctacgtccccgtgtacgtcgtggtacctagtatatacaaagtactcgaaccgacggccgcctacggaagggcccctccgtagacgcgtacttcgtcgtcgaccctacgaaaccgttcgacgggtaactcgacgaccctacgtcctacgaacccagtcccggaaccggacccgggaacccgtaggtacccgtagtaggttaaccgngggtaactcggtnttaaaaccgttgttaaaccgtcggtaagcggggtaacggtacgggaacacgtacgaaccgcgtacccggtaccgtaccccgttattaaccggttcggtttaaccccggtaacggggtaaacccggttaaccgggggtaaaacccccgttaaacgggtaacccccggttaaacctttaacccggttaaacggtaccccgaaaacccccgggg

SEQ ID NO: 382599 - DNA, 686 bp, Homo sapiens
  misc_feature: GZ8MTXP02I881H.13.76.G10.1.454.CMB.2.raw
  modified_base (300)..(300): a, c, t, g, unknown or other
  modified_base (600)..(600): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtcggttcaccgtcagtcacacctacatgagccgtcggggtcccnccgaggccgtaccggaagggggaacggggccgtaggggtaggtcggtccggtttccttttacgtttttaagtttaagtagttagggttaggttaacgtacctacttaccgtccgacgtaacgtacccggttccggtggggacggggtccggtacttacccgaaccgtactccgtacccgaagaacgaactaaacttacccaaagtaaccacgtcctttagtttactaacctaaaagtcgaaaccacgtccgtaggaacgtacggcccgtaagtccgacgaccggtcgtagttacttacgngtagacggagacggacggtaccgggacccacgtaaacgttcgaacgtgtacgtcgggacgttcgacggggtaccaacgggtacccg

SEQ ID NO: 382600 - DNA, 708 bp, Homo sapiens
  misc_feature: GZ8MTXP02GKEDL.13.76.G10.1.454.CMB.2.raw
  modified_base (505)..(505): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtggtggagtcgtggaggaggcttgatccgagccggtcgggggtcctggagactctccgtgtgcacgtcctcgtcgggtcaccgtcacgtcaccactacagtgagcgtcgggtccgccgacggcgtaccggaggggaacggggcgtggagtgtccgtttctttctttttagtttagtagtaggtggttacgtactactacctcgacacgtaccgttcggtgggacgggaccgtacgttaccaccctatccgtaccaagtaacgaaaccttaattacccgaaaagaaccctacggtctttcgtttaccctaaanaaacttgtaaacacgtaccgtagaccgacggacccgataccggaacgtaccgggtcgttaaggttaactttaccggaggttaccggagggtaacggtacgggtaaccggggtacccgggggaaccctaaaccgggttaaccgtttacgaaccgggtaattacgggcggttaccggtcggtacggggaccgttaaaccggcccg

SEQ ID NO: 382601 - DNA, 620 bp, Homo sapiens
  misc_feature: GZ8MTXP02JKZ9I.13.76.G10.1.454.CMB.2.raw
  modified_base (253)..(253): a, c, t, g, unknown or other
  modified_base (295)..(295): a, c, t, g, unknown or other
  modified_base (324)..(324): a, c, t, g, unknown or other
  modified_base (405)..(405): a, c, t, g, unknown or other
  modified_base (409)..(409): a, c, t, g, unknown or other
  modified_base (429)..(429): a, c, t, g, unknown or other
  modified_base (457)..(457): a, c, t, g, unknown or other
  modified_base (502)..(502): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctgggaggaggtcttggccagacgtcgggggtccgtgacgactctcctgtgcngctcgtggttcgcgtcagtcacactacatgagctcgggtccnccgagcgtccgaggggaagggcgtggagnggtcgtccttactttttattattagtacgtagtagtacactcgtccgacacgtctcgtagggcggggtaccgactacaccntacnccagacgaactactacgaanacacgtcttgtcttaacaaatcgtaacncgcaggacgcgcgagtacaccggtacgttcgttaattacttacgnggtcgacgaaacggtacgggagggtaccccgggtaaaccctaccgttaaacgttaaccgccgtagtaacgggtcggggttacccggtcgggaccgggaacccgtaacgggaccccgac

SEQ ID NO: 382602 - DNA, 646 bp, Homo sapiens
  misc_feature: GZ8MTXP02FOQSX.13.76.G10.1.454.CMB.2.raw
  modified_base (170)..(170): a, c, t, g, unknown or other
  modified_base (239)..(239): a, c, t, g, unknown or other
  modified_base (317)..(317): a, c, t, g, unknown or other
  modified_base (387)..(387): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtcccgtgtccccaggacagacagccagcatcacctgctctaggaaataaatggacagaataaatntacttcctggtatcagcagaagtcaggccagtcccctgtgctggcatctatcaagatgacccaaaggtcccggtcccncgacgggtctcccccgtagacgcgtacttccgtcgtcgtcctacccgtaactcggtacggtaactcgacncctacctcctacgaacccgtacgtccggaccgggacccggtacccgaaggtaccgtagtacgggtagtacgggacggtacgtacgtaacgttaacgttaacgtacgtaccgtacggtacgggtacgggacgaacgacgacgaccgtaccgtaccgtacccgtaccgtacgttacgttaccgttaccggtaaccggtaacgggtaaccggtaaaccggtaacccgtacccgtacccgtaaccgtaaccgaccgaaccccg

SEQ ID NO: 382603 - DNA, 657 bp, Homo sapiens
  misc_feature: GZ8MTXP02H9H6B.13.76.G10.1.454.CMB.2.raw
  modified_base (253)..(253): a, c, t, g, unknown or other
  modified_base (255)..(255): a, c, t, g, unknown or other
  modified_base (267)..(267): a, c, t, g, unknown or other
  modified_base (300)..(300): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgactccgaggccggtgggggtccctgagactctctgtncngctcgtggttcnccgtcagtcacacctacatgacgcgtcggtccnccgaggccgtccggaggggacgggcgtggagtcgtcgttctttactttttattagtaaggttagtaggttacgtaccactaccgtccgacgtacgtaccgttccggtggggacgggggtcctacgttccacctctcctacccaagacactaaacttacccgaaagaaaccctacgttctttcgtttaacctaacgaaagttacgaaacgacgtaccgtaggacgacggaccgtaagtacgaaccgccggtcggttattaccgtagtcgtcggacgaggagtacggtccgggaaccgtaacgtaacgtttacgacgtaacgtagtcggtacgtcgggaccgggtacgaacggtacccg

SEQ ID NO: 382604 - DNA, 747 bp, Homo sapiens
  misc_feature: GZ8MTXP02JR9NK.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtcgtgggaggaggcgttgactccagccgtgggggtccctgagactctcctgtgcagcctcgtgggtcaccgtcagcacacctacagtgacgcgtcgggtccgccgaggcctaccggaggggaggggctagggaggtcggtcgttctttacgtttttaattagtaggttaggtggttaagtaaccttacacttcccggactaacggtccgttaccggtggggacgggggtcctaacttccgaacctacgttcctacccgaagaacgtaaaccctaacgttaacccgaaaacgtaaaccgtaaccgttcgtttaccggtttttacctttaaaccgaaaattaacgggtaaaccaacggtcccgttaaggaaggtacccgtaccggagtacggtacccggaacccgggttcgttacgtttaaacgttccgttacggcgaccggtagggaacgtaaccgggtcgggggaacccctaaacgggttaacgtttaaccgacgtcgtaacggtcggtaccgggttacgccgggggtaaccggaacggtaacccccgg

SEQ ID NO: 382605 - DNA, 800 bp, Homo sapiens
  misc_feature: GZ8MTXP02F1DC7.13.76.G10.1.454.CMB.2.raw
  modified_base (443)..(443): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggtagttttggctgagtcttgggttttccttgttgtcttaattttaaaaggtgcccagtgtgaggtgcagcgtggtggagtcgtggaggaggtcttgactccgacggtccggtcgggggtccctggacgaccttcctccgtgtcgcacgtccttcgttcgggttccaccgtcacgtcaccacctacatggacgtcgtcgggtcccgcgacggcctccggaaggggacggggcgtggacgtcggtcgttctttacttttagtttagtacggttagtaggtacgtacctactaccgtccgacgtacgtaccgttccgggnggggtaccgggtccgtaacttacccacctactcctaccgaagaacgtaaaccctaattaaacccgaaaagaaccctacggttcttttaccgtttactaaaccgtaaaagtccgaaacgtccgttaccgtagggaaacgaccggtacccggagtacccggaaccggtaccgggtacgtttaggttaacttacgggtttggaacggtacggaaacggtacgggtaaccggggtaccggggtaaaccccctaaaggggttaaaccccggtttacgtaaaccgttcggtaaacgggttaccggggtacccgggtttccggggtaaccgggggtaacccccgggaaaacgggttacccccgg

SEQ ID NO: 382606 - DNA, 571 bp, Homo sapiens
  misc_feature: GZ8MTXP02FEKJE.13.76.G10.1.454.CMB.2.raw
  modified_base (364)..(364): a, c, t, g, unknown or other
  modified_base (373)..(373): a, c, t, g, unknown or other
  modified_base (437)..(437): a, c, t, g, unknown or other
tcagtcacgtactacacgaccggtgctcgatttagtcactcatacaggggctgggagaggagcccagcactgggattccgaggtgtttccattaggtgatcagcactgaacacagagacgggtcaccatggagttttggctgagctgggttttccttgttgctattttaaaaggtgcccagtgtgaggtgcagctggtggagtctggaggaggcttgatccagcctgggggtccctgagactctcctgtgcagcctcgtgggttcaccgtcagtcacaccctacatgagctgggtccgcaggctccgaggggaggggctgggagtgcgtcttctttttatatagtagtggtatacatactccgnagctccggngacggggccattcacatctccagagacaattccaaagaacagctgtttactacaaatcgaaacngacctgagacgcccgagtcgacacgcccgtagtacttaactggtgtagaacgaggtaacgtcgggggaccccaacggtaaaccgttaacgaaccgtactacgtacggtaccggtacggtacgggggaaccccgg

SEQ ID NO: 382607 - DNA, 688 bp, Homo sapiens
  misc_feature: GZ8MTXP02F8CZ8.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtgggaggaggcttgatccaggccgtcgggggtccctgagactctcctgtgcagcctcgtggtcaccgtcagtcacacctacatgacgtcgtcgggtccgccgacggccgtaccggaaggggaacggggcgtgggagtcggtacgttctttacgtttttaatttagtagtaggtggtactaccatacctcgacagtaccgtcggtgggacgggcctagttaccacctatcctaccgaaagacgaaacctaaacttaacccgaaagaaaccctcgtacctttagttttaacctaacaaaaagttcgaaaacgtaccggtacctgggaaagaccggaacccgtagaaccggaacccgacgggtccgttaaggtttactacgttggggacacgggaaagtaggaccgggtaccggggaccctaaaacggtaaccgtcgaaccgtgttaacggcgggttaacgcggtaacggggacctaaacgggggaccccg

SEQ ID NO: 382608 - DNA, 662 bp, Homo sapiens
  misc_feature: GZ8MTXP02JCZNS.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggtcaccgtcagtcacacctacatgagcgtcgggtccgccgaggcctaccggaggggaagggcgtggaggtgcgttctttactttatttagtagttgtaggtagtaccataccgtccgacacgtaccgtccggtgggacgggccgtattcccgaaccatcctaccgaagacgtaaacctattacccgaaaagtacccacgttctttagtttactacaaaagttcgaaactcgaccgtagaggacgtccgaagtaccgacgaccgggtccgttaagtacgttacgtaggaccgacggtaaggacggtacgggtaccggggtaacccctaaaaccggttaacgttaacctaacggccgttaaggtcggaacccggtcggtaaccgggggacaaacccggggtaccccg

SEQ ID NO: 382609 - DNA, 792 bp, Homo sapiens
  misc_feature: GZ8MTXP02GYGTL.13.76.G10.1.454.CMB.2.raw
  modified_base (566)..(566): a, c, t, g, unknown or other
  modified_base (723)..(723): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgttgggttttccttgttgcttaattttaaaaggtgcccagtgtgaggtgcagcgtggtggagtcgtgggagggaggtcttgacgtccgacggtcccgggttcggggggttcccctggacgtaccttccttccgttggtcgccacggtcccttcggttcgggttccacccgtcagtccaaccacctacatgacgcgtcgggtccgccgaggcctaccgggaggggacgggccgtagggagtcggccttctttactttttaatttataaggttacggtggtaacgtaccactaccgccgacacggtccgttcgggtggggaccggggtcctacttcccaaccgtattcccacgtaagaactaaaccgtaattaccgaaaacgtaactacggtcctttacgtttaccttaacggaaaatcgtaaaacncggaccgtaggaagtacccggacgtacgtacggaacccgtaccggggttacgttacgttaacttaaccggtgggtacgaaacggtaacgggaaggtaccggggttaacccggggaaaccccctaaaccggggttaaaaccgttaccgtaacccgggngtttaacgggaccgggggtaaccggttcccggtacgggggaaacccccgggtaacgggtaaacccccgg

SEQ ID NO: 382610 - DNA, 615 bp, Homo sapiens
  misc_feature: GZ8MTXP02IQTRB.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctcgggtccgccaggctccgaggggaaggggcgtggagtgcgtcttctttattatagtagtggtagtcatactccgcagctccgtggacggggccgacttacaccatcctccagaagaacctaacttaccgaaagaaccacgtcttagtttcctactaaaatacggaaactagcctaggaggtacgcccgagtacgaccgaacgggcccgttgtaacttaacgtcgtgccggaagggtaacgacggttcgggggaacccccacgggtaaaccgtttaaccgtaaacggcccgttaaaggtcgggtaaccggtcgtaccgggggaacccg

SEQ ID NO: 382611 - DNA, 714 bp, Homo sapiens
  misc_feature: GZ8MTXP02J2TKS.13.76.G10.1.454.CMB.2.raw
  modified_base (257)..(257): a, c, t, g, unknown or other
  modified_base (260)..(260): a, c, t, g, unknown or other
  modified_base (567)..(567): a, c, t, g, unknown or other
  modified_base (613)..(613): a, c, t, g, unknown or other
  modified_base (620)..(620): a, c, t, g, unknown or other
  modified_base (627)..(627): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtgggaggaggtcttgatccgaggccggtggggggtccctgagactctcctgngcngtcctcgtcggtcaccgtcacgtcaccactacatgacgtccgtcgggtcccgccgacggccgtaccgggaggggaacggggtcgtaggggacgttcggtaccgtttcctttacgttttttaacgttaagttaggtttaaggttagggtaactaccgtactaccgtcccgacgtacgtaccgttcgggtaggggacggggaccgtacttccgaccacgttaccaccgagtaaacgtaacctaacgttaaccgaaaacggacctacgtacctttaggtttactaaccgaattacgaaactcggtaccgngaacgccgacggaactcgaaccgttccggcgttagttacgttacgnggtacgngaacggnggaacggtccggaaacctacggtaaacgtttccacggtcgtaagtacggggacccttacggggacggaacccggtaacggtaccccg

SEQ ID NO: 382612 - DNA, 710 bp, Homo sapiens
  misc_feature: GZ8MTXP02GQ20U.13.76.G10.1.454.CMB.2.raw
  modified_base (598)..(598): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccaggccgtcgggggtccctgagactctctgtcgcacgtcctcgtggttcaccgtcacgtcacacctacatgagcgtcgggtcccgcgacggccgtacggaagggggaacgggtcgtagggtacggtcggtaccgtttctttacgtttttaagttaagttaaggttaggttggtaaccgtactacgttaccgtccgacgtaccggtaccgtccggggtaggggacgggggtcctacttcccgaactactccgtaaccaggtaaacactaaacgttacccgaaaagtaaactcgtctttacgtttactaaacgaaatacgaacacggtacctaggaacgtaccgacgtagcgaaaccgcgggttacttagttaacttcggnggtacgacggaaggaccggtcggtacccggggacccaaacggttaaccggtttacaaccggttacgtacgggtacggtaccggtacgggtaccggggaacccgaaaccgggg

SEQ ID NO: 382613 - DNA, 557 bp, Homo sapiens
  misc_feature: GZ8MTXP02FGDP3.13.76.G10.1.454.CMB.2.raw
  modified_base (269)..(269): a, c, t, g, unknown or other
  modified_base (279)..(279): a, c, t, g, unknown or other
  modified_base (283)..(283): a, c, t, g, unknown or other
  modified_base (293)..(293): a, c, t, g, unknown or other
  modified_base (313)..(313): a, c, t, g, unknown or other
  modified_base (318)..(318): a, c, t, g, unknown or other
  modified_base (327)..(327): a, c, t, g, unknown or other
  modified_base (359)..(359): a, c, t, g, unknown or other
  modified_base (390)..(390): a, c, t, g, unknown or other
  modified_base (400)..(400): a, c, t, g, unknown or other
  modified_base (442)..(442): a, c, t, g, unknown or other
  modified_base (448)..(448): a, c, t, g, unknown or other
  modified_base (454)..(454): a, c, t, g, unknown or other
  modified_base (484)..(484): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggttttccttgtgctatttaaaaggtgccagtgtgaggtgcagctggtggagtcgtggagagcttgatccagccggtcgggggtcctgacgacctctcctgtcgcagtcctcgtgggtccaccgtnatcacactantgancgtcgggccncgaggccacgagggacgggntaggngtggtcctnttactttagtttatgtagtggtatccataccncgcagcctcgggtgacgggtccattcacctntccacaaganacctaataaccgaagaacctcgacttctttaactacgtaaancgaacncgacgngacgcgactagcgacgcggtcgtagtatgngacggagaggacggacgaccggaacctacgtaacgtcacgtcgacgtcggacggtcgacgggacgaccggccg

SEQ ID NO: 382614 - DNA, 635 bp, Homo sapiens
  misc_feature: GZ8MTXP02J34WN.13.76.G10.1.454.CMB.2.raw
  modified_base (252)..(252): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgcccaccctcagtgtccgtgtcccaggacagacagccagcatcacctgctctaggagagtaaagttggggataaatatgcttgctggtanacgagacgagaacgccgacggccctacgtccccgtgtcgcgtggtcatctaatacgaagactaaccgaacgccgacccgtacgacggtactcccccgtagacgtcgtatttcctacgtcgtcctacctaaacctcggacgggaacaccgtacgacccaactccgtacacccgttacgaccggacggccccgggaacccagggtcgttacgggagggagtcggaacgggtctacggtaacttacgttaacggtggtaccacggggtacgcgggaacgagactaacggcttacgccggtacctaccgggttacgaaccgtcggaacccgtaaccggtccgaacccgtacgtacgaccgaccgaccccgaaaccgcccaaaccccg

SEQ ID NO: 382615 - DNA, 692 bp, Homo sapiens
  misc_feature: GZ8MTXP02I0E2T.13.76.G10.1.454.CMB.2.raw
  modified_base (536)..(536): a, c, t, g, unknown or other
  modified_base (653)..(653): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgtctattttaaaaggtgcccagtgtgaggtgcagcgtggtggagtcgtggaggaggcttgatccgaggccgtcggggggtccctggagactctcctgtgcagcctcgtggtccaccgtcagtcacacctacatgagcgtcgggtcccgccgaggcctaccggaaggggaacggggcgtgggagtcggtcgtttctttcgtttttaagtttataggttaggtggtaatacctaacgtacctccgacacgtaccgtcggtggggacggggtccgtaacttaccgacctactccgtaccgaaggaacgtaaacctaaacctacccgaaaagtaacccgtaacgttctttacgttttaccttaacgaaaacttcgaaaaaccgngtacccgtaaggagaccgacgagtaccgacgaccggtcgttagttaccgttagtggaggaacgtaggaaccgtagggtacccggggaccctaaacgtaacgttacctacgcgtaacncggggtaccgtcggacgggggtaacccgaacgggacccg

SEQ ID NO: 382616 - DNA, 543 bp, Homo sapiens
  misc_feature: GZ8MTXP02H80PK.13.76.G10.1.454.CMB.2.raw
  modified_base (365)..(365): a, c, t, g, unknown or other
  modified_base (393)..(393): a, c, t, g, unknown or other
tcagtcacgtactacacgaccggtgctcgatttagtcactcatacagggctgggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccagcatcacctgctctaggaaataatgacagataaatattactcaggtatcagcagatcaggccacgtccctgtgctggtcatctatcaagactgaccaagccgaccctgacggtctcccccgagacgtcgattcgcgtcggcctacgaacgtcgtacggaactcgaccnccactcacgacacgacgacgaccgacgngtacgtagtgagtggagtactagtactagtacgacgacggacggcggtacggacgacgacgacgacgtacgtcgccgtacgtacgtacgtacgtacgtacgtacggtaaccgtaccgtaccgtaccgtaccgtaccgtaccgaccgaccg

SEQ ID NO: 382617 - DNA, 696 bp, Homo sapiens
  misc_feature: GZ8MTXP02JCX2S.13.76.G10.1.454.CMB.2.raw
  modified_base (280)..(280): a, c, t, g, unknown or other
  modified_base (519)..(519): a, c, t, g, unknown or other
  modified_base (535)..(535): a, c, t, g, unknown or other
  modified_base (546)..(546): a, c, t, g, unknown or other
  modified_base (622)..(622): a, c, t, g, unknown or other
  modified_base (628)..(628): a, c, t, g, unknown or other
tcagtcacgtactacacgaccggtgctcgatttagtcactcatacaggggggattccgaggtgtttccattcggtgatcagcactgaacacagaggactcaccatggagttttggctgagcttgggttttccttgttgctattttaaaaggtgcccagtgtgaggtgcagctggtggagtcgtggaggaggcttgatccagccgtgggggtccctgagactctcctgtgcagcctcgtgggttcaccgtcagtcaccactacagtgacgcgtcgggtccnccgaggccgtaccgaggggaaggggcctggagtggcgttctttactttttagtttaagtaaggttagttggttaaacgttaacctagttaacctccccggagaacgtaaccgttccggtaggggaccgggggtaccccgtaatttacccaacccttatccctaccgaagaacgaaacctaaaccttacccgaaaagaaaccaaccgtctttactttacctaaacaaaagtcggaaaacncgaccgtagggaaacncgacccgtaanacgtaaacccgaggggtcccttaaggttaatttccgaggtgacgagtaagcgtcggggaacccaacgtaacgtacnccgtanacggtggtaacctcggacgggaccgaacggaaccgacggttcccaccgttctacctacgcctaccccg

SEQ ID NO: 382618 - DNA, 742 bp, Homo sapiens
  misc_feature: GZ8MTXP02GU1TD.13.76.G10.1.454.CMB.2.raw
tcagtcacgtactacacgaccggtgctcgatttagtcactcatacagggggtctgggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccgaggccgtgggggtccctgacgactctcctgtcgcacgcctcgtggttcaccgtcagtcacacctacatcgagcgtcgggtccgcgaggctaccgaggggaaggggctgggagtggtcgttcttacttttatttagtagtagtcggtagtacactacctcgacaagtccgtccggtaggacgggggtaccgtacgtactaaccgaacttccctacaacggaagtaactaaacgttacccgaaagaaacctaccggtactttaggtttacctaccgtaaaaagtacggaaaccttacgggaccccgttaggtaaccgggaacggtaaccccggtaaagttacgggaaacccggtaacccgggggttacccggttaggtttaaacgtttaaccggtgggttaccggaagggtaccggaaagggtcggtaacccgggggaacccctaaaggggtaaccgttaaccgtaacggtcgtttaacggacgggtaccgtaccgggggttaggggaaaacccccgggg

SEQ ID NO: 382619 - DNA, 662 bp, Homo sapiens
  misc_feature: GZ8MTXP02FJLTP.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtcccgtgtccccaggacagacagccagcatccacctgctctaggaaataatggacagaataaatatacttcctggtatcagcagagtcaggccacgtcccctgtgctggtctatctatacgaagtagtacgaccgaacggcccggacccgtacggaacgggtacctcccccggtagacgtcttacgttccgtcggttcgtccctacccaacgttacggtaaccgggtaaccttaaccgaaaccctaccgttacccgtacgtaaccctacgtaccgaccggggaaccccgggtacccgacgggtacttagggtacggtagtacggacggtactaacgttaacgttaacgttacggttacggtacggacggggttacggacgggtacgacggacgacgaccgtacgtccggtaccctgttacgtcgttaccgtaccggtaacggaccggtaacgaaccggtacaccgtactacgacaccgacccgaaccg

SEQ ID NO: 382620 - DNA, 647 bp, Homo sapiens
  misc_feature: GZ8MTXP02HZCOC.13.76.G10.1.454.CMB.2.raw
  modified_base (534)..(534): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagcttgggttttccttgttgctattttaaaaggtgcccagtgtgaggtgcagctggtggagtctggaggaggcttgatccagccgtgggggtccctgagactctcctgtgcagcctgtggttcaccgtcagtcacacctacatgagcgtcgggtcccgccgaggcctacccggaaggggaaggggcgtgggagtcggtacgttctttctttttaatttataggttaggtggtagtacacttactccccgcacgtacctccggtggacggggcctacttccaacctattcctaccgagacgaactaaacttaccaaagaccacggtctttcgttttacttacaaaagtcgaaacacgcctagaggacgaccgtagtcgaaccgtacggcccgttagtactttacgngtgacgtaggacggtagtccggggaccctaacggtaaccgttacgacgtactagtcgggtaaccggttcggtacggggaccgaaacgggtaccccgtagggtacccctacccg

SEQ ID NO: 382621 - DNA, 643 bp, Homo sapiens
  misc_feature: GZ8MTXP02IQ61U.13.76.G10.1.454.CMB.2.raw
  modified_base (334)..(334): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtccgccaggcctccggaggggagggcgtggagtgcgtcttntttattatagtgtgtagtacatactcgcagacgtcgtgggacgggcctacttccgacctactcctccgaagacgaacctaacttaccgaaaagaacctacgtctttacgtttacctaacaaaagttcgaaaacctacggtaccctagggaagaccggaccgtaaagtcggaacccgacggggtccttaggttaacttacgtgcgacggaggacggacgtacccggggaaccctaaacggtaaaccgtttacacgtaacgtacggtacggtaccggtaccggacggggaacccgaaacggggtaaccccg

SEQ ID NO: 382622 - DNA, 731 bp, Homo sapiens
  misc_feature: GZ8MTXP02FKAL9.13.76.G10.1.454.CMB.2.raw
  modified_base (287)..(287): a, c, t, g, unknown or other
  modified_base (297)..(297): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctgggaggaggcttgatccagccgtcggggggtccctgagactctcctgtgcagcctcgtggtcaccgtcagtcacacctacatgancgtgggtccnccgaggctcgaggggaggctggagtgcgtcttctttatttagtagtagtaggtagtacctagtacctccgacacgaccgtccggtgggaacgggggtcctagttacccaaccatccctaccgaaggaaacgaacctaaacgttacccaaaacggtaaaccgtacgggtcccttttagttttaaccccgttaaaacgtaaaacgttacggaaaacccgtaccggtacccgtaagggaaccggtaccggaacccggtaagtaacccggaaccgggtacccgggttaccggttaagttaacgttacggtaggaacgggtaccggaaggtacggtaccggggtacccggggaacccctaaaccgggttaaccgttaaccgacgtaacgtaacggtcgggtaccggtccgggtaccggggaacccgaacgggtaacccg

SEQ ID NO: 382623 - DNA, 655 bp, Homo sapiens
  misc_feature: GZ8MTXP02F4PNC.13.76.G10.1.454.CMB.2.raw
  modified_base (252)..(252): a, c, t, g, unknown or other
  modified_base (283)..(283): a, c, t, g, unknown or other
  modified_base (297)..(297): a, c, t, g, unknown or other
  modified_base (371)..(371): a, c, t, g, unknown or other
  modified_base (539)..(539): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctggagactctcctgtgcncgcctcgtggtcaccgtcagtcacactacangacgcgtgggtccnccgaggcctccggagggggagggtctgggagtggcgttcttactttttattagtaggtagtgtagtaccatccncgcagtacctccggtggacggggcattccactatcctaccagacgtacaagttacccaaagtaccacgtctttcgtttacctacgaaaattcggaaaacctcggtaccctagggagaccgtaccgtagacccgaaccgtccggggtaccttagttaccgtttaacggnggtacggacggtaacgggtacgtcggggtaccggaaccctaacggttaaaccgttccgaaacgtcgtaacggtcgggtaccggtacgggaccgggggaacccgtaacggggtaccc

SEQ ID NO: 382624 - DNA, 623 bp, Homo sapiens
  misc_feature: GZ8MTXP02IENMO.13.76.G10.1.454.CMB.2.raw
  modified_base (388)..(388): a, c, t, g, unknown or other
  modified_base (502)..(502): a, c, t, g, unknown or other
  modified_base (554)..(554): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctaattttaaaaggtgcccagtgtgaggtgcagcgtggtggagtcgtgggaggaggcttgactccagccgtggggggtccctgagtactctcctgtgcagcctcgtggttccacgtcagtcacacctacatgagcgtcgggtccgccgaggccgtaccggaggggaaggggccgtaggagtcggtcgttctttctttttaagttagtagtagtgggttataccgtataccncgcacgtaccgtcggtgggacgggacgtacttaccgacctactctacccaggtaacaactaaacttacccaaagtaaccctaggttccttgttttacctacgaaaatgaaaccncgccgtagagacgccgatcgaacgacgtcgttggtaattcgtgagtacgagngacgtcggggacccaacgtacgttacacggctaacgtcggtccgtaggtcgggaccgaacgggtacccg

SEQ ID NO: 382625 - DNA, 633 bp, Homo sapiens
  misc_feature: GZ8MTXP02F26TE.13.76.G10.1.454.CMB.2.raw
  modified_base (413)..(413): a, c, t, g, unknown or other
  modified_base (450)..(450): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccaggctccgaggggaaggggctgggagtgcgtctcttttagtttatagtagtggtagtacctatactcgacagtactccgtggacggggcccgtattccaccgtatcctcaagganaccaaattccaaagaacacgcttgtttacccttaaanaaactacgaaacgtacgcgtaggagacgacgagtccgaccgtacggtcgttagttacgttacgtgtcgacggaaggacggtacggtacccggggaaccctaacggttaaccgttaccgtaccggtaaccgttaagggtccgggtaccggttaccgggacggggtaacccggaacggtacccgg

SEQ ID NO: 382626 - DNA, 822 bp, Homo sapiens
  misc_feature: GZ8MTXP02JH9CO.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgacttccgaggccggtcggggggtccctggacgtacctcctcctggtcgcacgtcccgtcgttcgggttccacccggtcacgtccacctacctacagtgacgcgtcgggtccgccgacggcgtaccggaaggggacggggcaggtagtggtccgttctttacgtttttatttacgtagttaggtggtaacgtacctactaccgtccgacgtagtaccgttccgggtgggacggggtcccgtaacttacccaccgtactccgaccgaggtaaccgaaacttaaacccgttaaccgaaaacggtaaacccgtacgtttacccgtttacgtttttaacccgttaaaactaaaagttcccgaaaaccgtaacggtccccgttaagggaaccgggtacgacccggaagttaccggaaccggtaccgggttacccggttagtttaacgtttaacggtgtcggaacgggtacggaaggtaccggggtaccggggaacccccgttaacgggtaaaacccgtttaccgaacggttaacccggtaggttaaacccgggggtaccggtttacggggtaccccgggggtaaaccggaaacccgggttaaacccccggggg

SEQ ID NO: 382627 - DNA, 701 bp, Homo sapiens
  misc_feature: GZ8MTXP02H293Z.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctctgggttcaccgtcagtcacacctacatgagcgtcgggtcccgccgaggcctaccggaggggaacggggtcgtgggaggtcggccgtttcttctttttaattatagtagtggttaagtaccatacctccgcacgacgttccgtggacggggacctacttccgaacctatcctacccgaagtacgaacctaaattacccgaaagaaccaacgtcttacgtttacctaacaaactagaaacctcggtacctaggaacgacgacccgaagtcgaaaccgaccgggtaccgtgttaacgttacgtgtacggcggaaaggaagggtacggttacccgggggaaccccctaaaacgggttaaacccggtttaacccgtaaccgggtaacgttaacggtacggggtacccggttacggggtaccgggggaacccgtaaaaacgggggtcccccg

SEQ ID NO: 382628 - DNA, 678 bp, Homo sapiens
  misc_feature: GZ8MTXP02HVNAH.13.76.G10.1.454.CMB.2.raw
  modified_base (387)..(387): a, c, t, g, unknown or other
  modified_base (417)..(417): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggctgatccagccgtggggggtccctgagactctcctgtgcagcctcgtgggttcaccgtcagtcaacacctacatgagcgtcgggtccgcgaggcctccgaggggagggctggagtggcgttcttcttttatttagtagttagtaggtataccatacctccgacgagtaccgttccggngggacgggggtaccgtacttccgaaccctnttacctacccgaagacaaacgtaattcccaaaagaacctacgctttgtttactacaaaagtacgaaaccgtgtacccgttaggaacgacggtacccggtagtacggacctacgggggttaccgtgttaacgtttaacgtggttacggtggaaaggtaggtaaaccggtcgggggaaccccctacgggtaaaccgttaccgtaacgtaaccgttaggtcggtaacggtccggtacgggggaccgtaaaacggggtaccccgg

SEQ ID NO: 382629 - DNA, 769 bp, Homo sapiens
  misc_feature: GZ8MTXP02HV8QM.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctcgtggttcacgtcacgtcacacctacatgagcgtcgggtccgccaggcctaccggaggggaacggggctggggagtcggccgtttactttctttttaatttaagtaggttaaaggttgggttaacgttaacctaacgttaaccgtcccgacgtacgtaacccgttccggtggggaacgggggtccctagtttacccaaccctacgtaccttacccgaaggtaaacgaaacctaaacttacccgaaaacgtaaaccgtaaccggttccctttaaggtttttacctaaccttaaaaagtacggaaaacctaccggtacctttacgggaagtaacgggtacccgtaaagtcggaaccccgtacgggtaccccggttaggtttaacttaaccgtggttacggtacggaaacggttaggaacgttccgggggaaacccctacggttaaaacccgttcgtaacgtaacgttacgtacgggtacccgttgggtacccggggacgaaaccgggggtaaccccg

SEQ ID NO: 382630 - DNA, 820 bp, Homo sapiens
  misc_feature: GZ8MTXP02IJEIA.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccgagccgtgggggtccctgagactctctgtgcagcctcgtggttcaccgtcagtcacacctacatgagtcgtcggtcctccgaggcctccggaaggggaacggggtcgtagggaggtcgtcgtttctttacgttttttaagttttaagttaaggttaggttagggttaacgttaaccctaacgttaacccgtccgtacgtaacgtacccgttccgggtacggggacggggtacccgtaactttacccgacccgtactaccttacccgaaaagtaccgaaaccttaaacgttaccccgaaaagaaacccgtaccggtaccttttacggtttttaacccttaacgaaaaacgttacgggaaaacctaaccggttacccgttaaggaaaccggaccgggtaccccgtaaagtacggaaaccggtaccgggttacccggtttaaggtttaactttaccggtaggttcggaacggaacgggtaacggtaccggtaccgggggaaacccccttaaacgggtaaaaccgtttacccgaacgttaacggtaacggtacggggaacccggtttacggacgggggtaacccctaaaacgggggtaaccccgg

SEQ ID NO: 382631 - DNA, 652 bp, Homo sapiens
  misc_feature: GZ8MTXP02G8DH2.13.76.G10.1.454.CMB.2.raw
  modified_base (472)..(472): a, c, t, g, unknown or other
  modified_base (484)..(484): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccaggccgtcgggggtccctgagactctcctgtgcacgtcctcgtcgggttcaccgtcacgtcacacctacagtgagtccgtcgggtccgaccgacggcctccgggaaggggacggggcgtggagtgtcgttctttattttattagtagttagtggttagtactatacctcgcagtctcgtgggacgggtcgtacttccaccatccacgaagactacctaaacttaccaaagaacccacgtcttcgtttacctaaanaaactcgaaacncgtcctaaggacgacgacggataccggaaaccgccgggtacgttacgttaattaccgtgtacgacggtaagacggtacgggtaacccgggacccctaacggtaaaaccgttaccgtacggaacgttacgcgggtacgtcgggtaccggggaacgaacgggtaaccccg

SEQ ID NO: 382632 - DNA, 684 bp, Homo sapiens
  misc_feature: GZ8MTXP02F6SPO.13.76.G10.1.454.CMB.2.raw
  modified_base (251)..(251): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgagccgtgggggtccctgagactctcctgtgcngcctcgtggtccaccgtcacgtcaccacctacatagagcgtcgggtcccgccgacggcctccggaggggacgggcgtggagtcgtcgtctttacttttagtttagtagtaggtaggttagtacctacgtaccgtccgactacgaccgttcgggtagggcggggtaccgtacttaccgacctactcctaccaagacgaacctaaatacccgaaagaacccgtacgtctttacgtttaccttaacaaacgtcgaaactcgtaccgtaggacggacgacccgtagtaccggaaccgtaccggggtaccgtttaggttacttacggtggtacggacggtaaggacggtacggtaccgggggaccctaaccggtaaccgttacctacgtcgttacggtcgggtaccgtcgggtacgggacccggaacgggtaccccgg

SEQ ID NO: 382633 - DNA, 737 bp, Homo sapiens
  misc_feature: GZ8MTXP02GEBXM.13.76.G10.1.454.CMB.2.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctcgtgggttcaccgtcacgtcacacctacatgagcgtcgggtcccgccgacggcctaccggaggggaacggggcgtaggggacggtcggtccggttcctttacgttttttagtttaagttaggttaggttagggtaacgtaactacgttacgtccgacgacggtaccgtccgggtagggacgggggtccgtacttccgaccatcctacgaagtaacgaactaaacttaccaaaacgaaccacgttctttagtttacctaacaaagttacgaaaccgtacgcccgtaggacgaacggtaccgtaagtcggaaccgtaccggtaccggttagttaacctttagtcggtaggtacggtaaacggacggtacgggtaccgggggtacccccgtaaaacgggtaacccgtttttaacgaacccggttacgttaaggtccgggggtaaccgtttccggggtaaccgggggaccccggaaaacccggggg

SEQ ID NO: 382634 - DNA, 647 bp, Homo sapiens
  misc_feature: GZ8MTXP02F287D.13.76.G10.1.454.CMB.2.raw
  modified_base (405)..(405): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcacacctacatgagcgtcgggtcccgccacgggcctcccggaaggggaacggggcgtagggagtcggccgttctttacctttttatttagtaggttaggtggtagtacgataccgtccgacacgaccgtccgnggacgggggtcctagttccacctactctcccgaagacgaactaagttacccaaagaaccaacgtcttcgtttactaacaaatcgaaacaacggtccctagacgacgacccgatacgacgtacgggccgttagttacgttactggtacggacgaggtaacggacggtccggggaaccccaacggttaaaccgtaacgtaccgtacttacggtcggtaaccgtccgggtacggggaaaccccgg

SEQ ID NO: 382635 - DNA, 662 bp, Homo sapiens
  misc_feature: GZ8MTXP02H3T6V.13.76.G10.1.454.CMB.2.raw
  modified_base (334)..(334): a, c, t, g, unknown or other
  modified_base (399)..(399): a, c, t, g, unknown or other
  modified_base (471)..(471): a, c, t, g, unknown or other
  modified_base (525)..(525): a, c, t, g, unknown or other
  modified_base (534)..(534): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttcctgtgctatttaaagtgccagtgtgaggtgcagctggtggagtctgggaggaggcttgatccagccgtggggggtccctgagtacctctccgtgtgcacgtcctgtcgggttccaccgtcacgtccacctacctactagcgagcgtcgggaccgccgaggcctacgggaggggaaggcgtaggngtcgcgttctttattttatagtagttagtcggtatacctattacgccgagacgtacgttcccggngggacggggtcctattaccgacctagttccacgaaggtaacgaaacctaaattacccccgaaaaggaacccncggttacctttaggttttaccaaaccgtaattacggaaactacgcgtaggaaancggacgtancggaacgcggtaccgtgttaacgttaccgcggagacggaggtcggaccggtaccgggacctaaacgtaccgtacgacgtaacgtacggtacgggtaccggtacggacccgggaacgaacccggacccg

SEQ ID NO: 382636 - DNA, 658 bp, Homo sapiens
  misc_feature: GZ8MTXP02G0DQL.13.76.G10.1.454.CMB.2.raw
  modified_base (274)..(274): a, c, t, g, unknown or other
  modified_base (481)..(481): a, c, t, g, unknown or other
  modified_base (501)..(501): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttcctgttgctatttaaaaggtgccagtgtgaggtgcagctggtggagtctgggaggaggcttgatccgagccgtgggggtccctggacgactcgtcctgtcgcacgtcctctgggtccaccggtnagtcaaccactacatcgagcgtgggtcccgccgaggccgtaccgaggggtaaggggctagggacgttcggcttcgttactttttaactttagtaggttagttggtacgtacacttacacgtacgacgtaaccgtcggtacggacggggtccctaagttcccactacttaccgccgaagtacgaaccaaacttcgaaaacgtactacncgtttagtttaccagttaanacggaaactgaccttagaagtacggacgacgttaggaacgtccgggtcaacgtttagttccgtagccggaagcggtaagccgacggggacccaaaacggttcccgttaaaagcccgtgacggttagggacccgtggccggggaacccgtaaaccggg

SEQ ID NO: 382637 - DNA, 680 bp, Homo sapiens
  misc_feature: GZ8MTXP02FGNAX.13.76.G10.1.454.CMB.2.raw
  modified_base (270)..(270): a, c, t, g, unknown or other
  modified_base (363)..(363): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggtcttgatccaggccgtggggggtccctgagactctccgtgtgcagcctctgggtcaccgtnagtcacacctacatgagctcggggtccgccgagggcctccgaggggaacggggtctgggagtgcgtcttactttatttactagtagtgggtanacctactactcgctacgacctccggtgacgggggtccattaccactagtcctaccgaaagaacgtaacctaaacttaccccgaaaaggaaaccctaccgtactttcgttttaacctacaaaaaacgttcggaaaaccagtcccgtaggaacgacgacccgtatccggaaaccgtaccgggtcgttacgtaactttaaccgtggagtaaccggagacggtaccgtccgggggaaaccccccaaggttaaaaccgtccgttaacccgggaacgtacggtacgggacccgtcggaccggggacccgaaccggggtaaccc

SEQ ID NO: 382638 - DNA, 578 bp, Homo sapiens
  misc_feature: GZ8MTXP02H0ZH1.13.76.G10.1.454.CMB.2.raw
  modified_base (395)..(395): a, c, t, g, unknown or other
  modified_base (439)..(439): a, c, t, g, unknown or other
  modified_base (487)..(487): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtcctgagactctctgtgcagcctctggttcaccgtcagtcacacctacatgagcgtgggtcccgcaggcctccggaggggaaggggctaggagtgcgtcttcttttattatagtagtggtagtacatacctcgcagctcgtggagggctatccacactctccaganactattaccaaagaaccacgtcttgtttactaacaatcgaaacncgaccgtagacgacgcgatacggaccacgggtccgtgttaacttacgnggtacgacggagtaggtacggtaccgggaccctaacggtaacgtacgacgaacgtacggtacggacggtcggacgggaccgaacgggtccg

SEQ ID NO: 382639 - DNA, 645 bp, Homo sapiens
  misc_feature: GZ8MTXP02HZHFJ.13.76.G10.1.454.CMB.2.raw
  modified_base (422)..(422): a, c, t, g, unknown or other
  modified_base (439)..(439): a, c, t, g, unknown or other
  modified_base (451)..(451): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcacacctacatgagcgtcgggtccgccgaggccgtccgaggggaacggggcgtggagtggtcgtcttcttttatttatagtagtggtagtacatactcgcagactcgtgagggcgattccaccatctccagacgactaatacccaaagaacncgccttgtttcctaaanaaatacgaaacngacctagacgacgaccgagtacgaaccgtacggtccgttagttaacttacgtggtacggacggtagggaacggtaacgggtacccgggggaaacccccgttaaacggtaaaaccgtttaaccgtaaccgtaaccgttaaggtaccgggtacgggttaccgggaccgggggtaaacccgaaacgggggtaacccg

SEQ ID NO: 382640 - DNA, 687 bp, Homo sapiens
  misc_feature: GZ8MTXP02GXED3.13.76.G10.1.454.CMB.2.raw
  modified_base (475)..(475): a, c, t, g, unknown or other
  modified_base (490)..(490): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagcgtggtggagtcgtggaggaggcttgactccagccggtggggggtccctgacgactctcctgtcgcacgtccccgtgggttccaccgtcacgtccaccacctacatgagcgtcgggccgccgaggctaccggaggggagggctgggagtgtcgttctttctttttattataggttagtggtacgtacactacctcgcacgtaccgtccggaggcgggggcctatccgacctactcctacgagacgaactaaacttaccgaaacgaccacgtcttagtttactaanaaagtacgaacgacnccgtaggacgacgacccgatacggaaccgtaccggtaccgttagttaacttacgtgtacgggacgaaggtaggtacgggtcccggggtaaacccgtaaacggttaaccgttaacctaccggtaacgttaacggtacggggttaaccggttacgggtaccgggggaaccggaaaccggggtaaccccggttacccggg

SEQ ID NO: 382641 - DNA, 777 bp, Homo sapiens
  misc_feature: GZ8MTXP02GU7AV.13.76.G10.1.454.CMB.2.raw
  modified_base (247)..(247): a, c, t, g, unknown or other
  modified_base (716)..(716): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagctctcctgtgcngcctctgggttcaccgtcacgtcacacctacactgagcgtcgggtcccgccgaggcctaccgggaaggggaacggggtccgtggacggttggtccgttcgttttacttttttaagtttaagttaaggttaggttaggttaacgtaacccgtaagttaccctacccggactaacggtaccgttacccgggtcggggaacgggggtcccgtacgttaccaacccgtacttcccgtacccgaaacggtacaacccgtaaacttacccgaaacgtaaaccctacgggttcctttaaggttttaccctaaaccgtaaaagttaaccgaaaccgaacggtcccgttaggaagggacgtacccgtaagaccggtacggaccggtccggttaagttacgttacgtcggtagggaccgaagggtacgtaacgggtaccggggaacccctaaacgggtaacccgttaacgtaacccggntttaacgggaccggggtaccgttacgggtacccggggaccggtaaaccggggtaaccccgg

SEQ ID NO: 382642 - DNA, 571 bp, Homo sapiens
  misc_feature: GZ8MTXP02HCY7Q.13.76.G10.1.454.CMB.2.raw
  modified_base (306)..(306): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtcgtggaggaggcttgatccagccgtgggggtcctgagactctcctgtgcacgcctctgggttcaccgtcagtccacacctacatgagcgtcgggtccgccgaggccnccggaggggaaggggctggagtggtcgtctttcttttattatagtgtggtacgtactatactcgcagactcgtggagggctattccacatctcagagaacaatccaaagaacctcgaccttgtttacactaaagtacaaaccgagtccgtagagacgaccgatcgaacgaccggcgttgtacttacgtgagcgacgagacgtacggggacccaacgtaaccgtaacacgaagtacgcggtaacctcgacgggaccgaaacggccg

SEQ ID NO: 382643 - DNA, 718 bp, Homo sapiens
  misc_feature: GZ8MTXP02G08Q6.13.76.G10.1.454.CMB.2.raw
  modified_base (332)..(332): a, c, t, g, unknown or other
  modified_base (496)..(496): a, c, t, g, unknown or other
  modified_base (534)..(534): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtggtggagtcgtgggaggaggtcttgactccgaggtccggtcgggggtccctgacgtacttcctccgtgtcgcacgtcccgttcggttcgggttccacccgtcacgtaccacctacctacagtgacgtcgtcgggtccnccgaggcctaccgggaggggacgggcgtggagtgtccgtttcttactttttattagtagttaggtaggtacgtacctactaccgtccgcacggtccgtcggtggggaccggggtctacgttaccaccgtactcctacgaaacgactaaacctacctaacgaaanaaccgtcgtcttagtttaccaaagaaatcggaaaaccncggtacaggagaccgacgtagaccggacgttccggtagttagttacgttcgaggtacggaacgtacggtacggaccggggtacccggaaacctaaaccggttaaaccgttaccgtacggtaacgttcgggtaaccgggttaccggtacgggggtaacccggggaaccggtaaaccgggtccccg

SEQ ID NO: 382644 - DNA, 832 bp, Homo sapiens
  misc_feature: GZ8MTXP02I4Y3J.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtgggaggaggtcttgactccgacggtccggtcggggggtccctgacgtacgtcctccgtgtcgcacgtccttcgtcgggttccaccgtcacgtaccacctacctacagtgacggtccgtcgggtcccgccgtacggccgtaccgggaaggggacggggcgtaggagtcggtcgtttctttagtttttaattagtaaggttacggttagggtaattaacctacgttaccgtacccgtacgtacgtaccgttccgggtagggggaccggggtacctaacgttacccgacctaacgttaccctaccgaaagtacgtaaacctaaacgttacccgaaaacgtaacgtaccgttctttacgtttactaaacaaacgttacgaaaacctggtacctaaggaacggacgtaaccgtagtaacccggaccggacggttacccgttaggttaaactttccggtaggaccggtaacggaagggtaccggttaaacgggggtaccccggggaaaaccccgtaaaccgggttaaaacccgtttaccggtaaccgttaaaaccggtcggttaaccgggggtaaaccccgtccggggttaacccgggggaaaccccggaaaaccggggtttaaacccccgg

SEQ ID NO: 382645 - DNA, 681 bp, Homo sapiens
  misc_feature: GZ8MTXP02HZNFC.13.76.G10.1.454.CMB.2.raw
  modified_base (378)..(378): a, c, t, g, unknown or other
  modified_base (398)..(398): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtcgggggtccctgagactctcctgtgcagcctcgtgggttcaccgtcagtcacacctacatgagcgtcggtccgccgaggctccggaggggaggggcgtggagtggtctcttctttttatttagtagttagtgtagtacatacctcgacagcttcgngggacgggctactcgacctntcctaccgagagaacctaaattaccaaagaaccctacgtaccgttttagtttaccttaacgtaaaacgtagaaaccgacgtacccggttagaacgtaaccggtcgaacgtacgaccgaaccgggttaccgtggtttaactaccgtggtaaccggacggaaaggaggtacggtaccccgggggtaacctaaaccccggttaaacggtttaacctaccgtaaccggttagtaaccggggtccgttacgggggtacccggggtaacgaaacccggggaacccccgg

SEQ ID NO: 382646 - DNA, 715 bp, Homo sapiens
  misc_feature: GZ8MTXP02F029D.13.76.G10.1.454.CMB.2.raw
  modified_base (303)..(303): a, c, t, g, unknown or other
  modified_base (687)..(687): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttatttaaaaggtgcccagtgtgaggtgcagctggtggagtcgtgggaggaggcttgatccagccgtggggggtccctggacgactctcctgtgcagcctcgtgggtccaccgtcagtcacactacagtgacgcgtcgggtcccnccgagggcctaccgggaggggaacggggtcgtgggagtcggtccgtttactttacgtttttaagtttaagtaaggttaggtacggggttaacgttaacccgtaaccgtttacccgtacccggacctaacggtacccgttagggtccggggttaacgggaccggggggtaccccttacgttaccctaacccgtacgttaccctacccgaaggtaaacggtaacctaaacgttacccgaaaacgtaaacccgacgttacgtttcgttttactaaccaaagttacgaaaccgaacgtccgtaggacgaacggccgtaagcggaaacgtccggtaccgtgttattacgtcgtgacgaggagacggtacggaccacgtactagtaacgntacgcggacgtcggtacggacgtaacgg

SEQ ID NO: 382647 - DNA, 572 bp, Homo sapiens
  misc_feature: GZ8MTXP02FW591.13.76.G10.1.454.CMB.2.raw
  modified_base (258)..(258): a, c, t, g, unknown or other
  modified_base (377)..(377): a, c, t, g, unknown or other
  modified_base (394)..(394): a, c, t, g, unknown or other
  modified_base (411)..(411): a, c, t, g, unknown or other
  modified_base (416)..(416): a, c, t, g, unknown or other
  modified_base (418)..(418): a, c, t, g, unknown or other
  modified_base (425)..(425): a, c, t, g, unknown or other
  modified_base (431)..(431): a, c, t, g, unknown or other
  modified_base (466)..(466): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggtgcccaatgtgaggtgcagctggtggagtctggaggaggcttgatccagccgtgggggtccctgagactctcctgtgcagcctctgggttcaccgtnagtcacacctacatgagcgtggtcccgccaggcctccgaggggaaggggctggagtgcgtcttcttttaattatagtagtggtagtacatactccccgcagactccgtggacggggccnttccacatcctccaganacaatccaaagacacgntatancngacagangaaacngccgtagggacgccggaaggaccacggtcgtttancgactggagtacgaaaagattagttagtaatagtacgtaggtacgctacggaaccttaacgttaaccttacgttttacgaacgttaccggtacgggggaaccccgg

SEQ ID NO: 382648 - DNA, 627 bp, Homo sapiens
  misc_feature: GZ8MTXP02HAV8P.13.76.G10.1.454.CMB.2.raw
  modified_base (392)..(392): a, c, t, g, unknown or other
  modified_base (482)..(482): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagcgtgggtggagtcgtgggagggaggcttgatccaggccgtggggggtccctgagactctcctgtgcagcctcgtcgggttcaccgtcacgtcacacctacatgagcgtcgggtccgccgacgggcctaccggaaggggaacggggcgtgggagtcggtcgtttctttactttttattacgtagttaggtggttatacctatacnccgacagccgtcggtggacggggcctattccacctatccaccgagacaactataccaaagaccacgtctagtttctacaaatcgaaaacngtaccgtagaaggacgccgaagtcggaactccggggacttgttaactcgtaggcgacgaggagtacggtacggggacccacggttaaacgtcgacgtaaccgtagaccgggtacggttcggaccggggaccgaagggtaaccccg

SEQ ID NO: 382649 - DNA, 697 bp, Homo sapiens
  misc_feature: GZ8MTXP02IOPM8.13.76.G10.1.454.CMB.2.raw
  modified_base (250)..(250): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgtgctatttaaaaggtgccagtgtgaggtgcagctggtggagtctgggaggaggcttgatccagccgtggggggtcctgacgactctcctgtgcncgcctcgtgggttcaccgtcagtcacacctacatgagcgtcgggtcccgaccacggctaccggaaggggaacggggtctagggagtgtccggttctttacttttttaagtttaagtaaggttaggtttacgggttaacgtactaactttaaccgtcccggtacgaacgtaccggttccgggtaggggaaccggggggttccctaacgtttacccgaacctaacgttccgtacccgaaaggtaacgaaacctaattaccccgaaaagaacccgtaacgtccgttacgtttacttaccaaaattcgaaactacgtcctagaggacgccgtatacgaacggaccggtcgttagtacttagtagtcggacgacgtaagacggtaccgggggaaccctacggtaaacgtccgtaacgtccgttagacggacggttcggaacggggaacccgg

SEQ ID NO: 382650 - DNA, 609 bp, Homo sapiens
  misc_feature: GZ8MTXP02JOH3A.13.76.G10.1.454.CMB.2.raw
  modified_base (287)..(287): a, c, t, g, unknown or other
  modified_base (303)..(303): a, c, t, g, unknown or other
  modified_base (364)..(364): a, c, t, g, unknown or other
  modified_base (369)..(369): a, c, t, g, unknown or other
  modified_base (394)..(394): a, c, t, g, unknown or other
  modified_base (397)..(397): a, c, t, g, unknown or other
  modified_base (415)..(415): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaggtgcccagtgtgaggtgcagctggtggagtcgtgggaggaggcttggatccaggccgtggggggtccctggagactctcctgtgcagcctcgtgggttccaccgtcagtcacacctacntgacgctggggtcccncgacggctccggaggggaggggctgggagtgcgtctttcttttattatagtagtggtatanactcncgcagactcgtgcggggcatccacntcncagcataactccaagacncgtcttgttactacaaatgaactagcctagacggacgccgagtacgacgtacggccgtattaacgttacctgggtacacggaacggtagtacgggtacccgggggacccaaacggttaaccgttaccgtcggtaccttaaggcgggtaaccggttcggaccgggggacccaaacgggggacccgttaacccggg

SEQ ID NO: 382651 - DNA, 536 bp, Homo sapiens
  misc_feature: GZ8MTXP02FI2E3.13.76.G10.1.454.CMB.2.raw
  modified_base (254)..(254): a, c, t, g, unknown or other
  modified_base (357)..(357): a, c, t, g, unknown or other
  modified_base (365)..(365): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggagggtccctgagactctcctgtgcagcctntggttcacgtcagtcacacctacatgagctgggtccgccaggctccgagggaaggggctggagtgcgtctctttttaagttatagtagtgtagtacatactcnagactcgngagggggccattcacatctacagagacaattccaaagacacgactgtttctacaaatgaaacagacctgagaagccgaatgacacggcgtagtattacgtggcgcgagacgacgtacgggacccaacgtaactacaacgcgtagtacggacgtcggtacgggacgaaacgg

SEQ ID NO: 382652 - DNA, 686 bp, Homo sapiens
  misc_feature: GZ8MTXP02JCF9J.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagcgtcgggtccgcccgaggcctccgaaggggaacgggggctagggagtcgcgttcttctttttaatttatagttagtaggtagttaccgactacctccgcgagtacctccggtggacggggcctacttccgacctatcctccgaagacgtaaactaaacttaccgaaaacgaaccaccgtcttcgtttacttacaaaatgaaacctaggccctaggagtaacgcccgtagtaccggaacgtaccggggtacccgtttataaccgtttacgcgttacgggacggttaaacggagggtaacggttccgggggaaacccccgtaacggttaaaaaccggttccgtaaccgaacgttaggttacgggacgggttacgccggggggtaacccaaggggtaacccccgg

SEQ ID NO: 382653 - DNA, 636 bp, Homo sapiens
  misc_feature: GZ8MTXP02GCAZN.13.76.G10.1.454.CMB.2.raw
  modified_base (549)..(549): a, c, t, g, unknown or other
  modified_base (574)..(574): a, c, t, g, unknown or other
  modified_base (607)..(607): a, c, t, g, unknown or other
  modified_base (614)..(614): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtcgtgggaggaggtcttgatccgaggtccgtggggggtccctggacgactctcctgtgcacgtcctcgtcggttcaccgtcagtcacacctacatggagcgtcgggtcccgccgagggtccgtaccggaagggggtaacggggcgtaggggacggttcgtccggtttctttttactttttaaagtttagttaaggtttaggttaggttacgtaactacttaccgtccgacacgtaccgtccggagggacggggtcctacttaccacctatcccacaaggactaactaactacccgaaaagccctagtctttgttaccaataaatgaaactcgcgtagaggtacaccgntacgacgtcggcttagtatcgtggngacgaagacgtcggacgggacctaaggtaactnaacggtntacggcgacggtcggacggacg

SEQ ID NO: 382654 - DNA, 745 bp, Homo sapiens
  misc_feature: GZ8MTXP02G702L.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgacgactctcctgtgcagcctcgtcgggttcaccgtcagtcacacctacatgagcgtcgggtccgccaggcctccggaggggaggggcgtaggagtgcgttctttcttttatttatagtagtagtagtacctagtacctccgcacgtaccgtccgtgggacggggcctacgttccaaccgtactcctacccgagacgaacctaaagttacccaaagaacctccgtaccgttcgttttacctaacgaaaattcggaaaacgtcgtacctagggacggaaccgtaccggtaagtaccggaacccggaccggggttacccggttaaggtttaactttacggtttcggtacgggaaccggaagggggttaacgaaccgggggtttacccgggggaaccccgtaaaacccggggttaaaaccgtttacttaacccgggggtaaccttagggttacccggggtaccggtttaccggggaccggggggtaaaccccgaaacgggggtaaaccccccgg

SEQ ID NO: 382655 - DNA, 833 bp, Homo sapiens
  misc_feature: GZ8MTXP02GHI17.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtggaggaggcttgatccgaggccgtcgggggtccctgagacctcgtcctgtgcagcctcgtcgggttcaccgtcacgtcaccacctacatgacgtcgtcgggtcccgccgagggccgtaccggaaggggaaggggtcgtgggtacggtcggtccgttctttactttttaagtttagtaaggttaggtacggtaagtactactaccgtccgaccgacgtccgtccggtacgggacggggtaccgtagttaccgacctactacccgtaccgaaggaacgtaacctaaacgttacccgaaaacgtaacccgtaacggttccttttaagttttaccctaaacgtaaaacgttacggaaaacccgacggtaccccgttaagggaacggaacccggtaccccgtaaggtaacccggtaacccgggttaacccggggtacccgtttaacggtttaaaatttcccgggttacggggtaaccgggacggtaaaggggaaacgggttaccgggttaacccggggggaaaccccccctaaaggggtttaaaaacccggtttaaccggttacccggaaccggtttaagggttacccggggtaaccggtaccgggggttaacccgggggtaaaaccccggg

SEQ ID NO: 382656 - DNA, 672 bp, Homo sapiens
  misc_feature: GZ8MTXP02FR17F.13.76.G10.1.454.CMB.2.raw
  modified_base (428)..(428): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgaggccgtcggggggtccctgacgtacctctcctgtgcagtcctcgtgggttccaccggtcacgtcaccacctacatcgagcgtcgggtcccgccgtaggcctacccggaaggggaacggggtcgtggggagtcggccgttctttacgtttttaattagtaggttagtacggtacgtactatacctccgacgacgtaccgttccgggnggacgggggtccctacttaccgaacctacgtaccctaccaaaggtaacgtaaaccctaaaggttacccaaaagtaaaccccgtacggttacctttacgtttactaaaccgtaaagttaacggaacacgtccttaacggaggaacggtccagtaccgacgaaccggtcgtattacgtaacgttgacgagagaggtcgacgggaccccaagtaccgtgaactctacgcgtacgcgtacgggaaccg

SEQ ID NO: 382657 - DNA, 793 bp, Homo sapiens
  misc_feature: GZ8MTXP02GDJTJ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtcgtggaggaggcttgatccgagccgtgggggtccctgacgactctcctgtgcacgcctcgtggtcaccgtcagtcacacctacatcgagcgtcgggtcccaccgaggcctaccgggaggggacggggcgtgggaggtcggtcgtttctttacgtttttaagtttagttaggttagtaggttaactaccgtacttaccgtccgacgtacggtacccgttcgggtcggggaccgggggtacccttacttacccgaccctaacttccgtaacccgaaggtaaacgtaaaccctaaaacgttacccgaaaacggtaacccttaccggttccgttttaagtttttaccctaaaacaaaacgttacggaaaccgtaccggtacccgttagggaacgaaccggtacccggtaataccgggaacccgttacgggtaccgtttaaggttaaccctttagggtccggtaaggaccgggaagtacggggaaccgttaccgggggaaccccctaaaggggttaaacccgtaccggtaacgtaaccgttaacgggtaccgggtaccgggtccgggtaaccggggaacccggaaccgggttaccccgg

SEQ ID NO: 382658 - DNA, 636 bp, Homo sapiens
  misc_feature: GZ8MTXP02I6KKT.13.76.G10.1.454.CMB.2.raw
  modified_base (265)..(265): a, c, t, g, unknown or other
  modified_base (377)..(377): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaggtgcccagtgtgaggtgcagctggtggagtctggaggaggcttgatccagccgtgggggtccctgagactctcctgtgcagcctgtgggttcacgtnagtcacacctcatgagctcgggtccgccaggcctccgaggggaagggctggagtgtcgtcttacgtttattagtagtagtgtaagtacatacctcgacagtccgttaccggnggtacgggggtccagttaccaccctatcctaccagaacgactaacgttacaaacgaactacgtcttcgtttacttaacgaaattacgaaacaagcccgttaagaggtacgacccgaagtacggaaccgacgggtaccgtaggttacttaccgtggtacgcgtaaaggcgtacggtaccggggacccctaaacgggtaaccttacgaccggtactaagtacggtaccgttgaccgggggtaccaacgggtccgtaaccgg

SEQ ID NO: 382659 - DNA, 805 bp, Homo sapiens
  misc_feature: GZ8MTXP02I2AH7.13.76.G10.1.454.CMB.2.raw
  modified_base (303)..(303): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtctgggaggaggcttgatccagccgtgggggtccctgagactctcctgtgcagcctcgtgggttccaccgtcagtcacacctacagtgacgtcgtcggggtcccnccgaggcctccgggaaggggtaaggggctagggaggtcggtccgttacttttacgtttttaatttagtaaaggttacggttagggttaagtaacccctaagttacccgttcccggacgtaacgtacccgttcccgggtggggaccgggggcccgtaaactttcccgaaccctagttaccctacccgaaggagtaaaccctaaacttacccgaaaagtaaacccgtaaaccggttcctttacggtttttaacccctttaaaacgtaaaacgttaacggtaaaacccgtaacggtaccccgtaagggaaaccggtaacccggaccgggttaaacgtacccggaaccggtaccgggtaccgttaaggttacttacggtgtacggacgggtaaaggtcgggtacgggtaccggggaaccctaaccgggtaaaaccgtttacgtaccgtaacgttacgtacggggtacccggtacggtaccgggggaacccggtaacggggacccgg

SEQ ID NO: 382660 - DNA, 630 bp, Homo sapiens
  misc_feature: GZ8MTXP02FXPEH.13.76.G10.1.454.CMB.2.raw
  modified_base (456)..(456): a, c, t, g, unknown or other
  modified_base (475)..(475): a, c, t, g, unknown or other
tcagtcacgtactacacgaccggtgctcgatttagtcactcatacagggggagcctgggcctcaggaagcagcatcggaggtgcctcagccatggcatggatccctctcttcctcggcgtccttgcttactgcacaggatccgtggcctcctatgagctgactcacgcccaccctcagtcgtcccgtcgtccccaggacagacacgcagcactccacctgactacgtaaggtaaataagtcgacaataataaataacttacttcgtagtactacgacgacgtaagaacgtcgaccgccgtaccgtcccgtgtacgtctgtactatctatacaagtatcgaccacggtccgaccgtacggacgtaccctccgtaggactacgtattccgtacggtccgtccaacctagtaccgtacggaactcaccgtcactcacgacctagccgacggccgaaccngttacagtgaagtgacgtntagtacttatacgtcggtagcggggtcgaacggcgtaagcgaccacgtccgtaccggcccgttagtacgttccggttacgaccgggtaaaaccgtggggtaaaaccctacgggtacccaaacccgggttacttaacggaccccgaaaaccccggg

SEQ ID NO: 382661 - DNA, 662 bp, Homo sapiens
  misc_feature: GZ8MTXP02HWPUU.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacactacatgagcgtggtccgccgaggcctccggaggggacggggcgtggagtgtcgtctttctttttattatagttaggtggtagtaccatacctcgctacgtcgtccgtgggacggggccgtacttccacgtactcctaccagtacgaaactacgttaccaaacgaacacgtcttacgtttctactaaacttgaaacacgtcctaggtacgagacccgtatagaccgtaccggccgttgttaacgtttacgtcggttggacggaggtaacgggacgttacggggggaccccctaaacgggttaacccgtttacccgtaacggaaccgttacggtacggtacccgggttccggtaccgggggaacccgtaaaccgggggtaaccccgg

SEQ ID NO: 382662 - DNA, 663 bp, Homo sapiens
  misc_feature: GZ8MTXP02FE0JF.13.76.G10.1.454.CMB.2.raw
  modified_base (254)..(254): a, c, t, g, unknown or other
  modified_base (289)..(289): a, c, t, g, unknown or other
  modified_base (427)..(427): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggtagttttggctgagcgttgggttttccttgttgtcttaattttaaaaggtcgccagtgtgaggtgcagctggtggagtcgtggaggagtctgatccgagccgtcgggggtcctgagactctcctgtncagtcctcgtgggtccaccgtcacgtcacacctanatagacgtcgtcgggtccgacgacggcctaccgggaaggggaacggggtcgtggaggtcgtccgtttcgttacttttagtttaagtaggtaggttaggtaagtaccctacgttaccgccgacaggtacccgttcgggngggaacggggcctattcccactatcacgaagacaactaactacgaaaacgtacgtacgtctttacgttactaacaaaattcggaaaccagacgagacgtaccgacgtaagaccgtacggtacgttagttacttagacgtcgacgacggaggacgtaccgggaccggaaaccctaacggttacctaacacgtaacgtacggtacggtaccgtgggtacgggaaccgaacggtacccg

SEQ ID NO: 382663 - DNA, 648 bp, Homo sapiens
  misc_feature: GZ8MTXP02FWLJ9.13.76.G10.1.454.CMB.2.raw
  modified_base (281)..(281): a, c, t, g, unknown or other
  modified_base (296)..(296): a, c, t, g, unknown or other
  modified_base (339)..(339): a, c, t, g, unknown or other
tcagtcacgtactacacgaccggtgctcgatttagtcactcatacaggggtctggggagaggagcccagcactgggattccgaggtgtttccattcggtgatcagcactgaacacagaggactcaccatggagttttggctgagctgggttttccttgttgctattttaaaaggtgccagtgtgaggtgcagctgggtggagtcgtgggaggaggcttgatccgaggccgtcggggggtcctggagactctcctgtagcagtcctcgtgggttcaccggtncgtcaacaccctaanagtgcgtcgtcggccgcgacgcgtacggaggggacggcgtggngtcgtcgttctttatttagttagttagtaggtacggtagtactacgtaccgtcgacgtacgtcggtcggtacgggacgggtacctacgtaccactactaccgtacgaagacgtaaactaaactaaccgaaagtaaccgtacgttcgtttacttactaacgtaaagtacaaacgtacgtcgaagacggacgtaccgaagtccgaacggcgtacgttagtacgtacgtgtcggagacggacggtacggaccggaacctaacggttaacgtaacgacgtacggtagtacggtaccggtcggaacgggaccgg

SEQ ID NO: 382664 - DNA, 604 bp, Homo sapiens
  misc_feature: GZ8MTXP02GB0X7.13.76.G10.1.454.CMB.2.raw
  modified_base (304)..(304): a, c, t, g, unknown or other
  modified_base (402)..(402): a, c, t, g, unknown or other
  modified_base (427)..(427): a, c, t, g, unknown or other
  modified_base (515)..(515): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgtctattttaaaaggtgcccagtgtgaggtgcagcgtggtggagtcgtggaggaggcttgatccagcccgtggggggtccctggagactctcctgtgcagcctcgtgggttccaccgtcagtcacacctacatgagcgtgggtccccncgacggctcgaggggaagggctggagtgcgtcttcttttattatagtagtaggtagtaccatactcgctagactcgtgggcgggcctattccgacctntcctccaagacgactaataccaaanaaccacgtcttagttacttacaaagttcaaactcgtacctagagacgacccggtaatccggaccgacggtcccgttagtacttaccgngtacgacggagtagacgtccggggacctaacggtaacttacgtacgaaccgtagtcggacgtcggtacggggacccgaacggtaacccg

SEQ ID NO: 382665 - DNA, 791 bp, Homo sapiens
  misc_feature: GZ8MTXP02GBKON.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggtagttttggctgagcttgggttttccttgttgtcttaattttaaaggtgccagtgtgaggtgcagcgtggtggagtcgtggaggaggcttgactccgaggtccggtcggggggtccctggacgtacctctcctgtcgcacgtccttcgttcgggttccaccgtcacgtccaccacctacagtgacgtcgtcgggtcccgccgacggccgtaccgggaaggggaacggggtcgtggtacgtcggtcgtttactttacttttaagtttagttagtaggttaggttactaacctaacttaccgtaccgacgtacggtacccgttccgggtgggggtaccgggaccgtaacgttacccaaccgtacttacccgaccaaagtaaaccgtaaacccttaaaacggttaacccaaaaggttaaacccgtacgttccgtttaacgtttaaccctaaacgtaaaagtccgtaaacgtacgaccgtaagacgtacgtaaccgataccgacgtacggtaccgttattacgtacggtggacggtaacggacggtaaacgggttccggaaccgggggtaaaccccttaaaacggttaaccgtttacccgaacgtcgttaacgggtacgggttacccgggtacgggaaccgggggaacccgtaaaccggggtaccccgg

SEQ ID NO: 382666 - DNA, 797 bp, Homo sapiens
  misc_feature: GZ8MTXP02JDQ59.13.76.G10.1.454.CMB.2.raw
  modified_base (290)..(290): a, c, t, g, unknown or other
  modified_base (451)..(451): a, c, t, g, unknown or other
  modified_base (642)..(642): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgccagtgtgaggtgcagcgtggtggagtcgtgggaggaggtcttgatccgagccggtgggggtccctgacgactctccgtgtgcacgtcctcgtcggtcaccgtcagtcacacctanagtgacgcgtcggtccgccgtacggccgtaccgggaaggggaaggggccgtagggtaggtcgtcggtttaccttttacttttttaagtttaaggttaggttaggttagggttaactaaccctacgttacccgtaccgtacgtaacggtaccgttaccgggnggggtaccgggggcctacgttacccaccgtactcctaccgaaagaacaaccttaaagtcccaaaaggacctaacgttccttacgtttttaacaaacgaaaatcgtaaaacgtccgtaccgtaagggtaaccgacggtacccgaacgtcggtaaaacccggtccggggttccttaaagttagtttaccgggngggtaacgaccgggtaagggtaaccgggtaccgggtaaccccggggtaaacccgttaaaacgttaaaaccggttctaaacggttaacggtaacggggttccgggtaaccgggtacggggttaacccggggaaaccccggtaaaccggggtcccgg

SEQ ID NO: 382667 - DNA, 620 bp, Homo sapiens
  misc_feature: GZ8MTXP02IC0HG.13.76.G10.1.454.CMB.2.raw
  modified_base (170)..(170): a, c, t, g, unknown or other
  modified_base (237)..(237): a, c, t, g, unknown or other
tcagtcacgtactacacgaccggtgctcgatttagtcactcatacaggggcctggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctggaaataattggactagataaatntactcctggtatcagcagaagtcacgccagtcccctagtgctggtcatactatcaaagtctagccaaaggccggtacccctcgacgggactcccccctgacgcgagtttctacgtcggtctccccgtaaactccgttagggaacctcgagcccaccttcagaccatacacgaccgggacccaggacctagtggatacgagtccgtaggtacttacgttactagtaccgaagggtccggttaggacgagaccgacgaccgaccgttcgcccccggtttacttacggttaccggtttaccgttaccgggtaacggtaccgggtaaacccgtaaccggtaccgtaaccccggttaccgttaaaccgtaccgtaacccggtaacccg

SEQ ID NO: 382668 - DNA, 583 bp, Homo sapiens
  misc_feature: GZ8MTXP02F5OZ6.13.76.G10.1.454.CMB.2.raw
  modified_base (393)..(393): a, c, t, g, unknown or other
  modified_base (444)..(444): a, c, t, g, unknown or other
  modified_base (459)..(459): a, c, t, g, unknown or other
  modified_base (512)..(512): a, c, t, g, unknown or other
  modified_base (514)..(514): a, c, t, g, unknown or other
tcagtcacgtactacacgaccggtgctcgatttagtcactcatacaggggggggaggaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtggggggtccctgagactctcctgtgcagcctcgttgggttcaccgtcagtcacacctacatgagcgtcgggtcccgccaaggcctccgaaggggaacggggctggagtgcgttcttctttttatttataggtgtaggtagtaccctatacctcgacagaccttcgnggaacggggcctatacccacatcaccaagaacacaaactacaaagaacacnccttagtttcctaanaaatacgaaacacgacgtagagacgacgtatacgacgacgtccgtagtactangngacgagaagcgcggaccaacgtaactaccgtacaacgtagcggtactcggacgggaaccgaacggaccg

SEQ ID NO: 382669 - DNA, 653 bp, Homo sapiens
  misc_feature: GZ8MTXP02IT9VG.13.76.G10.1.454.CMB.2.raw
  modified_base (244)..(244): a, c, t, g, unknown or other
  modified_base (246)..(246): a, c, t, g, unknown or other
  modified_base (258)..(258): a, c, t, g, unknown or other
  modified_base (262)..(262): a, c, t, g, unknown or other
  modified_base (271)..(271): a, c, t, g, unknown or other
  modified_base (316)..(316): a, c, t, g, unknown or other
  modified_base (542)..(542): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagtttggctgagctgggttttccttgttgctatttaaaggtgccagtgtgaggtgcagcgtggtggagtcgtggaggaggcttgatccagccgtgggggtccctgagactctctgtncngcctgtcggtcncgcngtcacacanatgacgcgtcggtccgacgaggcctacggaggggacggcgtaggngtcgtcgttctttactttattagtagtggtgtactactatccgtcgacagccgtcgtgggcgggctacgtaccaccgtactccaccgaagaccaacttaacgtacccaaagaacccgtcgtcctttgtttacccaaagaaacgtcgaaaacgccgttaacgtacgggaacggacgacccgttagtaccggaacccggtcggggtacctttagggttaacttacggngggacgaacggaggtacggtaccggggacccggtaaacctaacggttaacctacgacgtcgtaacgggtaccggtaccggtcgggacccgggaaccggtaaccggggtacc

SEQ ID NO: 382670 - DNA, 610 bp, Homo sapiens
  misc_feature: GZ8MTXP02I5EFR.13.76.G10.1.454.CMB.2.raw
  modified_base (442)..(442): a, c, t, g, unknown or other
  modified_base (495)..(495): a, c, t, g, unknown or other
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcacgtcacacctacatgagcgtgggtccgccaggctccgagggaggggcgtaggagtgcgtctcttttattatagtgtggtagtaccatactcgcagactcgtggagggccgattcacatctccagagacaattccaagaaaccacgcttagtttcttacaaaattcgaaaacncgacgtagacgacgaccgaagtacgaaccgtaccggtcgttagttacttacgngtacggacggtagacggtacgggtaccggggaaacccctaaacggtaaaccgttaccgaacgtaacgtaacggtacggtacgtcgggtaccgggggtacccgaaacgggtacccg

SEQ ID NO: 382671 - DNA, 778 bp, Homo sapiens
  misc_feature: GZ8MTXP02FRGFK.13.76.G10.1.454.CMB.2.raw
  modified_base (281)..(281): a, c, t, g, unknown or other
  modified_base (575)..(575): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagtttggctgagctgggtttccttgtgctatttaaaaggtgccagtgtgaggtgcagctggtggagtcgtgggaggaggcttgatccgagccgtggggggtccctgagactctccgtgtgcagtcctcgtgggttcaccgtcagtcacacctanatgacgcgtcgggtcccgccgacggcctaccggaaggggaacggggtctaggggtagtggccgtttccgtttactttttaagtttaagtaggttaggttaggttaacggtaccctaacgttaccgtaccgacgtaacggaacccgttcccgggtaggggtaccgggggaccccgtaactttaccccaacccgtattcctaccccgtaaaggaactaaacccgtaaacttaacccgaaaacggtaaaccctacggtcccttttagtttacctaactaaaaacttcgggaaaaccncgttcctagggaaaccgagggtacccaagtaccgaacgtaacccggtccgtttaggtacctttaaccggtgtcggaaacccggtaggtaacggaacgggtcccgggggaaccccaaacggttaaaacccgttcctaaacgggcttaaacgggtacgggaccccggttaggaccgggggtaaccggaaaacccggggtccccgg

SEQ ID NO: 382672 - DNA, 674 bp, Homo sapiens
  misc_feature: GZ8MTXP02HKW83.13.76.G10.1.454.CMB.2.raw
  modified_base (282)..(282): a, c, t, g, unknown or other
  modified_base (637)..(637): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagcttgggttttccttgttgcttaattttaaaaggtcgccagtgtgaggtgcagctggtggagtcgtgggaggaggtcttgactccaggccggtcgggggtccctgacgtctctccgtgtgcacgcctcgtcggtccaccgtnacgtcacactacagtgagccgtcggtcccgcgacggcgtaccggaaggggacgggcgtggtacggtgtcgtttcttttctttttaaattaagttaggttaggttaggtaacgtaacgtactaccgtcgactacggtccgtcgggtcgggacggggtcctattaccactactcctaaccgaggtaacaactaaacgtacccgaaaagtaacctaccgtcgtttacgtttactaaactaaacgtacggaaacctacgtccgtaggacgtaaccggcgtaagttaccggacgtacggttccggtaattacgttagcggtagacgtaggacgtacgggtcgaccgtacgtaacggtacncgtacgtacggcggtacgtcggacgggaaccgaacgg

SEQ ID NO: 382673 - DNA, 821 bp, Homo sapiens
  misc_feature: GZ8MTXP02I0B9L.13.76.G10.1.454.CMB.2.raw
  modified_base (305)..(305): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggtagttttggctgagcttgggttttccttgttgctaattttaaaaggtgccagtgtgaggtgcagcgtggtggagtcgtgggaggaggtcttgatccgaggccgtggggggtccctgagacctctccgtgtgcacgccttcgtggttccaccgtcagtcacactcatgagctgggtccncaggtccaccggaggggaacggggctgggagtcggcgtttcgttactttttaattagtagttaggtggttaacgtaccctaataccgtcccgtacgacgtaccgttaccgcgggggtacgggggtccgtaacgtttcccgaaccctacgttccctaaaccgtaacggggaaacgtaaaacctaaaacccgttacccccggaaaaaaggaaaaccctaccgggttcccgttttaatttttttaccccggaaacttaaaaaagtccggttaaaaacccaccggttacccccgttaagaaaccggggaactaccccgggaagttaacccggaaccgacccgggggtacggtttacctaaaggtttaccgtggttaacggggaccgtaaaaggggtagggtaaaccggggttccggggaaaacccggttaaaccgttaaaacggtttaacccgtaacgtaacggtacgggtacgggttacccggtcggggaaccgggggaacccggtaaccggggtaccg

SEQ ID NO: 382674 - DNA, 715 bp, Homo sapiens
  misc_feature: GZ8MTXP02JG72L.13.76.G10.1.454.CMB.2.raw
  modified_base (249)..(249): a, c, t, g, unknown or other
  modified_base (375)..(375): a, c, t, g, unknown or other
  modified_base (499)..(499): a, c, t, g, unknown or other
  modified_base (515)..(515): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcngcctcgtggtcaccgtcagtcacacctacatgagcgtgggtcccgccgaggcctccggaaggggaggggctggaggtcgtcgtctttcgtttttatttagtagtaggtaggttataccgattaccnccgtactacgaccgttcgtggggacggggccgtagttacccaccgtactaccctcgaaagtagaaaccctaaagtttacccgaaaagtaacccgtacctcgttttaacgtttaccccttaaaanaaacgtacgaaacccncggtaccgagggaacgtaccgaccggtagtaccggaccggtaccggttacgttagttaacgttcgcggtacgggacggaggtaacgggtaccgggtacccgggaaacccttaaacgggttaacccttaacgtaccggtaacgttacgggtaccgggtacccggtccgggaaacgggggaaccccgtaacgggtaaccccg

SEQ ID NO: 382675 - DNA, 672 bp, Homo sapiens
  misc_feature: GZ8MTXP02FTM0G.13.76.G10.1.454.CMB.2.raw
  modified_base (469)..(469): a, c, t, g, unknown or other
  modified_base (511)..(511): a, c, t, g, unknown or other
  modified_base (532)..(532): a, c, t, g, unknown or other
  modified_base (578)..(578): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgcttattttaaaaggtgcccagtgtgaggtgcagctgggtggagtcgtgggaggaggtcttgactccgaggtccggttcggggggtcccctggacgtaccttcctcccgttgtcgcgacgtccctcgttcggggttccacccggttcacggtccaaccacccttaacagttggacgtccgtcggggtccccgccgacgggtcctacccggagggggaaggggtcgtgggagtgcgttctttcgtttttattagtaggtagtgtagtacatcctcgcagccgtccggtggacggggcctattccgaactntcctcgaagagaactaaacttcccaaagacctacgtccgttntttactacaaaatcgaaaccngcctaggacgtaacgcccgaatcgaaccgcggtaccgtgtacttcnggtcgaggacgtagacggtcgggggaacccctaacgtaaacgttaaccgtacggacttaacggtcggtacggttccggtacgggggaaacccgg

SEQ ID NO: 382676 - DNA, 745 bp, Homo sapiens
  misc_feature: GZ8MTXP02FYIR3.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtggaggtgcagcgtggtggagtcgtggaggaggctgatccagccgtgggggtccctgagactctcctgtgcacgcctcgtggtcaccgtcagtcacacctacatgacgtcgtcgggtcccgcgacggcctaccgggaggggaacggggcgtaggagtcggtcgttctttacgttttatttagtaagtaggtaggttaacgtaacctacgtacctccgactacgtaccgtccggtcggggacggggaccgtacgttacccacctactccaccgtaagacgtaaactaaacttaaccgaaaacgtaacctaccgtctttagtttaccttaactaaaaagtcgaaaaccgtacgaccgtaaggacgtacggaccgtaagaccggaacgtaccgggtccgttaagtaacgttcgtacggtaggacggtaaagggtaacggtaccggggttaccggggaaaccccgtaaaacggtttaaacccgttaaccggttaaccgtaacgttaacggtacgggggtaccggttacccggggtacggggaaaccccggtaaacggggtaaacccccgg

SEQ ID NO: 382677 - DNA, 665 bp, Homo sapiens
  misc_feature: GZ8MTXP02IUEEO.13.76.G10.1.454.CMB.2.raw
  modified_base (270)..(270): a, c, t, g, unknown or other
  modified_base (307)..(307): a, c, t, g, unknown or other
  modified_base (336)..(336): a, c, t, g, unknown or other
  modified_base (369)..(369): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggagggaggcttgatccagccgtggggggtccctgagactctcctgtgcagcctctgggttcaccgtnagtcacacctacatgagccgtgggtcccgccaggccncgaggggacggggcgtggagtgcgtcttnttttattagtagtgtggtactacatacctccgntacgacctccggtgggacgggccgattacccacctatcctacccaaggaagacctaaacgttacccaaaggtaaacccacgtacctttggtttacttaacaaaagttgaaaaccgagtcccttaaggacgacggacgaacgtcggaaccgacgggtcccgttaaggttaacttacgtcggtagaccggaggacggtacgtaccgggggtacccaaaccggtaaaccggttacgtaaccgggcttaggtacggggaaccggttcgggtacgggggtacccaaaacgggggtcccccg

SEQ ID NO: 382678 - DNA, 593 bp, Homo sapiens
  misc_feature: GZ8MTXP02GQF8W.13.76.G10.1.454.CMB.2.raw
  modified_base (453)..(453): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccagcatcacctgctactaggaaaataattggacaagtaataaatactacttcctggtatcagcaagaagtcaggcccacgtcccctgtcgctggtcatctatacgaagctcgaccgaaggcccggaccctgaacgggtactcccccgaggacgcgtactttcgtcgtacggtcctaccaaacgttcgtacgggaacctcgacgccctaactcgacgaccacgtacgacggcccggtaccccgaggtaccgttagnggaagttcggacggtactaggtacttacgttacgtcggtacggaggtcgggtaggacaggcagtacacgtcgccgtactagtcgtcgtaccggacgtacggaacgtaacggctaccggtactacgtaccgacgaaccccg

SEQ ID NO: 382679 - DNA, 712 bp, Homo sapiens
  misc_feature: GZ8MTXP02HKBJ7.13.76.G10.1.454.CMB.2.raw
  modified_base (272)..(272): a, c, t, g, unknown or other
  modified_base (292)..(292): a, c, t, g, unknown or other
  modified_base (309)..(309): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctgggaggaggcttgactccagccgtggggggtccctgacgactcgtcctgtcgcacgtcctcgtcggttcnccgtcagtccacacctaacntgcgtcgtcgggtcccnccgaggcctcggaaggggacgggccggagtcgcgttcttctttttaagtagtacgtagtaggtagtacactaccgtcgactagtaccgtccggtagggacggggtcctagttccacctaactcgacagaacgtacctaaacttacccgaaagaaacctcggtctttacgtttacctaagaaatacgaaactccgactacggaacgtacgaccgggaaatccggaaccggtacgggtaccctaagggtttacctaacgttggggtacgaccggtaaaggaacggtccgggttaccgggggaaccccttaaaacggttaaaccgtccggttaccgaccgttaaggttcgggggaacctttcccgggggaacggggaccccgaaacgggggttaacccccgccggg

SEQ ID NO: 382680 - DNA, 757 bp, Homo sapiens
  misc_feature: GZ8MTXP02IV4NB.13.76.G10.1.454.CMB.2.raw
  modified_base (247)..(247): a, c, t, g, unknown or other
  modified_base (279)..(279): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtgggaggaggcctgatccgagccgtgggggtccctgagctctctgtncacgctcgtggtcaccgtcagtcacacctacntgagcgtcgacgtccgaccgacggccgtaccggaaggggaacggggctaggggacggtcggtccggtttctttacgtttttaatttaagttaaggtaaggttaggtaaaccgttaactaaccttaaccgtcccgacgtaccggtacccgttcccggggttaaggggaaaccgggggttccccgtaaacgtttaccccgaaccctaaagttccccgaacccgaaggtaaacccgaaacctaaacgtttaacccgaaaacggaaaaccttccgtaccgtttacgtttttaccttaaccgaaaagttacgaaacctacggacccgttagaaccgtacggacccgtagtaccggacggaaaccgttcggttacgtagtttacgtggttagcggtaaagggcgtaacggtaccgggacccgtaacgtaaccggttactaacgtcgtaccggtggtaaccggtcggccggggaacgtaaccggg

SEQ ID NO: 382681 - DNA, 594 bp, Homo sapiens
  misc_feature: GZ8MTXP02HYAA3.13.76.G10.1.454.CMB.2.raw
  modified_base (380)..(380): a, c, t, g, unknown or other
  modified_base (426)..(426): a, c, t, g, unknown or other
  modified_base (466)..(466): a, c, t, g, unknown or other
tcagtcacgtactacacgaccggtgctcgatttagtcactcatacagggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccagcatcactgctctaggaaataatggacagtaataaatatacttcctaggtatcagcagaagtcaggccacgtcccctgtcgcgtaggtcaatcgtatccaagactcgaccaacggccgcccctacgacgggtactacccccgtgacgcgacttctcgtcgctccaactacgtgggaacncacgcccactctacgaccatcgacggaccgggaccccagggtccgngggttaggagtaggtaggcgtcgtaaattacgtttaccgngtcgtacgggcgggtgggaacgagccgagccacgtcgtaccgttccgtcggaaacgttcggggaacctaacgggcctaacccggttacgtaacgggccaaccggaccccgaacggaacccccaacccg

SEQ ID NO: 382682 - DNA, 659 bp, Homo sapiens
  misc_feature: GZ8MTXP02GDJWK.13.76.G10.1.454.CMB.2.raw
  modified_base (294)..(294): a, c, t, g, unknown or other
  modified_base (297)..(297): a, c, t, g, unknown or other
  modified_base (301)..(301): a, c, t, g, unknown or other
  modified_base (375)..(375): a, c, t, g, unknown or other
  modified_base (477)..(477): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtgggggtccctgagactctcctgtgcagcctcgtggttcaccgtcagtcacacctacatgagcgtggccncgnggcnccgagggagggctggagtgtcgtcttacttttatttagtagtagtggtagtaccatactcgacacgtcctcggnggacgggcctacttccgacctatcctccgaaagacgacctaaaacttccgaaaagtaacctaaccggtctttacgttttaacctacaaaagtcgtaaaaccncgtaccgttagaacggtaccggaccgtaactacggaacccgtaccggggtcttaacggttactttaaccgtgggtacggacgagggtaacggtacggttcccgggggaaccctaacggtaaccgttaccgtacggtaacgtacgtcggtaaccggtcgtacgggggaaccacgggtacccgg

SEQ ID NO: 382683 - DNA, 796 bp, Homo sapiens
  misc_feature: GZ8MTXP02HYJC5.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatatacttcctaggtatcagacagaagtcaggccagtcccctgtgctggtcattctaatcaaagactcgaccaaggccggaccccttcgaacggggtacctccccccgtggaagtccgtaactttccgtacgtcgggtcccttaccctaaacgttccgtaccgggggtaaacctcccgtacggtaccccctaccgttacctaccggaaaccctacgtaacccgggaaacggggaccccggggaacccccggttaaagggacccgttagttaccggggaacgttagggaaccggttacgttacggttaacctttaacgttttaccggttccggttacggaccgggggttaggggttacggggaacgtaaccgggaccgtaacgggtacccaaccgggtttcccgaaccccccgggttactaacggttttcccggttaccggttttacccgggggaaaacccggttaccgggggtaaacccgtaaaaccgggggttacccccgtaaaaccccgggtttaaccgtaaaacccgggttacccgtaacccgggaaaaaccccccccggg

SEQ ID NO: 382684 - DNA, 639 bp, Homo sapiens
  misc_feature: GZ8MTXP02H3SS1.13.76.G10.1.454.CMB.2.raw
  modified_base (540)..(540): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctctgtgcagcctcgtcggttcaccgtcagtcacacctacatgagcgtgggtcccgccgacggcctccgaggggaggggcgtggagtgtcgttcttctttttattatagtagtggtatacctataccgtccgactacgacgttccggtgggacggggtacctacgttccaacctactacctacccgaagacgaactaacgttaaccaaagaaccacgttcttgtttacctaacaagtacgaaactcgtacccgtagaacgtacgacggtaatacggaccgacgggtccgtagtactttcgngtacggacgaggtagacggtccggggaacccctaacggtaaccgttacaacggtcttacggtacggaccgtggtaccgggggaacgtaacgggaccccg

SEQ ID NO: 382685 - DNA, 586 bp, Homo sapiens
  misc_feature: GZ8MTXP02GVH0K.13.76.G10.1.454.CMB.2.raw
  modified_base (212)..(212): a, c, t, g, unknown or other
  modified_base (236)..(236): a, c, t, g, unknown or other
  modified_base (250)..(250): a, c, t, g, unknown or other
  modified_base (469)..(469): a, c, t, g, unknown or other
tcagtcacgtactacacgaccggtgctcgatttagtcactcatacagggggctgggcctcaggaagcagcatcggaggtgcctcagccatggcatggatccctctcttcctcggcgtccttgcttactgcacaggatccgtggcctctatgagctgactcagcccacctcaggtgtccgtgtccccaggacagacagccagcatcactgctnagaaataagtgacagtaataaatntactcctgtatcanacagaagtcaggccacgtccctgtgctgcatctatacaagactgaccaagccgacctgaggactccccgtagacgctacttcgtacgtcggtcctaccgaaacgttcgaacgggtaacctcgaaccgcccaacctcgtacgacccaagtcgaacgggaccggaaccccgaagggcctaggtaggtagtaggacgtagtacgtaacgttatttaaccggngtacggaggcggtacggacagacgacgaccgtacgtccgtaccgtactacgttcgtaccgtaccggtacggtaccggaacgtacgtaccgaccgtacgaaccgtacgaccggaaccg

SEQ ID NO: 382686 - DNA, 588 bp, Homo sapiens
  misc_feature: GZ8MTXP02HWCWM.13.76.G10.1.454.CMB.2.raw
  modified_base (223)..(223): a, c, t, g, unknown or other
  modified_base (285)..(285): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcactgctctgaaataatggnagataaatatacttctggtatcagcagagtcagccagtccctgtgctggtcatctatcaagntgccgaaggtcgccctacgaggggtactcccccgtagaacgcgtaacttcgtacgtggcctaccgaaacttcgtacggggaaactccgagtcccacgtctacgacccacgtaccgacgtacccgggaaccccgtagggtaccctagtacggaagttcgggaacggtcctaggtaactttaacgttacgtcgtacgacgggtaccggtagggacaggcgtacgcaccgtcgccctcgttagtcgttacgttacggtaaccgtgggaaccgacggtaccgaccgtactacgaccgtacgaacccg

SEQ ID NO: 382687 - DNA, 671 bp, Homo sapiens
  misc_feature: GZ8MTXP02J1EJM.13.76.G10.1.454.CMB.2.raw
  modified_base (301)..(301): a, c, t, g, unknown or other
  modified_base (338)..(338): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccaggccgtgggggtccctgacgactctccgtgtgcagccttgtcggttcaccgtcagtcacacctacatgacgcgtcgggtcccnccgaggcctaccggaggggagggcgtggagtgccgtnttacttttatatagtagtggtacgactatccgccgacagtaccgcgtggacgggacgtattccgacacgtcctacaacgactaaactaacttacccgaaagtaacccgtacggtctttacggtttaccttaacctaaaattacgaaaccacggtacccgtaggacgagaccgtagtacgaacccgtcgggtacccgttagtacgtttaaccgtggtaccgtagaacggtacggacggttacccggggacccctaaacggtaaacccgttaccgtacgaacgttaacggtcggtacggttaccgggacggggaacccgaacggggtaaccccgg

SEQ ID NO: 382688 - DNA, 621 bp, Homo sapiens
  misc_feature: GZ8MTXP02JKXJK.13.76.G10.1.454.CMB.2.raw
  modified_base (278)..(278): a, c, t, g, unknown or other
  modified_base (430)..(430): a, c, t, g, unknown or other
  modified_base (460)..(460): a, c, t, g, unknown or other
  modified_base (463)..(463): a, c, t, g, unknown or other
  modified_base (469)..(469): a, c, t, g, unknown or other
  modified_base (483)..(483): a, c, t, g, unknown or other
  modified_base (515)..(515): a, c, t, g, unknown or other
  modified_base (544)..(544): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtgggaggaggcttgatccgagtccgtgggggtccctgacgtacctctcctgtgcagcctcgtcggtcaccgtnacgtcacacctacatagagcgtcggtccgacgacggcgtccggaggggaggggcgtagggagtcggtcgttctttactttttagttacgtaggttagttacggtacgtatacttaccgccgacagtccgtcgtggacgggtcctagtcaccnttccacaaggactactaacttaccgaaaanacnccgttntttacgttactaanaaagtcgaaactacgtccgaggagacgccganccgacgtcggacttagtacttcgacggtnacggaaagtcgtacggaccggaccctaaagtacggtaactacgtacgtcggacggtacgtccgggaggaaacccggg

SEQ ID NO: 382689 - DNA, 712 bp, Homo sapiens
  misc_feature: GZ8MTXP02F7RZ5.13.76.G10.1.454.CMB.2.raw
  modified_base (190)..(190): a, c, t, g, unknown or other
  modified_base (244)..(244): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacgagggtcctcgggcccagtctgtactgacgcacgcccgcctnagtgtcgtcggggccccagggcaggacggtcaccagtctctgctacgtgggacncacgtcctacaacgtggtacggactatattagagtatacgtaactacgtacgtaccacgtacgtacggttacgaggtacgccgtacgtaccctacgtacctacctactaacgtaactaaaacgtaaacccgtaaaccaaaccgtaccggtacccggacccggtaccgggttacccgggtcccgtaccggtaccgttacgttccgtcgtacggtaccgtacccggtacgttcccgtaccggtaccctacccgtaccgtacccgtaccccgttccgtacgtacctacgtacccgtacgtaccggtacccgtaccggtacggtacgtacggaggtacgtacggtacgtacgttacgttactttcgttacgtacgtaccttacgtacgtagtacgaccgtcgtaccgtacgtcgtaggtaacggttcgtaccggttacgggtaccgggtaccgggggacccggtacgtacgg

SEQ ID NO: 382690 - DNA, 745 bp, Homo sapiens
  misc_feature: GZ8MTXP02GVYX7.13.76.G10.1.454.CMB.2.raw
  modified_base (642)..(642): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaggtgcccagtgtgaggtgcagcgtgggtggagtcgtgggagggaggcttgactccgaggtcccggttggggggtcccctggacgtaccttcctccgtgtcgcacgtcccttcggttcggggttcccacccgtcgacgtccaacctacctacagtggacgtcggtcgggtcccgaccgacgggtacctccggggaaaggggtacggggtcgtagggtaggttcggtcgtttccgtttttactttttaagtttagtagttaaggttggttaacgtaacctacgttaccgtccgacgaacgtcccgttcggtgggggaccgggtaccgtacttaccaccgtattcccacgaagtactaaaccttaacgtaccaaaagtacccgtactcgtttactttaacgtacaaaagtcgaaaacgcgtccgtaagacgacgtaccgaagtacccgacgtaccgggtcttataccgtttgggngtacggacgtaggacggtccgggtaaccggaaccctaacgggttacctacgacggtaagttcggtaccgggcggtccgggaaccgggaaccggacggtacccg

SEQ ID NO: 382691 - DNA, 660 bp, Homo sapiens
  misc_feature: GZ8MTXP02FN77I.13.76.G10.1.454.CMB.2.raw
  modified_base (379)..(379): a, c, t, g, unknown or other
  modified_base (383)..(383): a, c, t, g, unknown or other
  modified_base (387)..(387): a, c, t, g, unknown or other
  modified_base (551)..(551): a, c, t, g, unknown or other
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggagggaggctgatccagccgtggggggtcctgagactctcctgtgcagcctcgtgggttcaccgtcagtcacacctacatgagccgtcgggtcccgccgaggcctaccggaaggggaggggcgtgggagtcggcgttctttactttttacgtttataggtagtaggtataaccntacnccgnacgtaccgtcgtggggcggggaccgtattaccaccgatcctaccaaggacaactaaactaccgaaagaaccctacgtccgtttacgtttactaacaaaagtcgaaaactcgaccgtaggaacgacgacccgtaatgaacccgaaccggtcgttagttactacgnggtcgacggaggagtcgggtacccggggaccctaaacgggttacgtacgtacccgtgttaacgtcggaaacccggttggacgggggtaacccgaaggggttaaccccgg

SEQ ID NO: 382692 - DNA, 709 bp, Homo sapiens
  misc_feature: GZ8MTXP02JUNEK.13.76.G10.1.454.CMB.2.raw
  modified_base (291)..(291): a, c, t, g, unknown or other
  modified_base (359)..(359): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaggtgcccagtgtgaggtgcagctggtggagtctggaggagcttgatccagccgtgggggtccctgagactctcctgtgcagcctcgtgggtccacgtcagtcacactacatgagctagggtccncaggctccgaaggggtaacggggctagggatggcttctttctttttaagttatagtagttggtactanacgtactcgcaagtccgtccggtggacgggggcccattcccgaacatctacccgaagacgtaactaaacttcaaaacgaacacgtacgttctttactaactaaagtacgaactacgggtacctgaacggagtacccgtagtaccggaacccgtaccgggtaccggtttagttaaacgttccggttacgtagacccggaaaacggttagaccgggttacgggggaccccccttaaaggggtaaaaccgtttaacccggtaacgtacccgttaaagggtcgggtaaccccggggttacggttacggggggtaacccccgaaaacgggggtacccccgttaaacccccggggg

SEQ ID NO: 382693 - DNA, 672 bp, Homo sapiens
  misc_feature: GZ8MTXP02JBO9U.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtgggggtccctgagctctctgtgcagcctcgtggtcaccgtcagtcacacctacagtgacgcgtcgggtcccgccgaggcctaccggaggggaggggcgtggagtcgtcgttctttactttttagtttagtagttacgtaggtacgttacctacgtaccgtccgtacgacgtacccgttcggtcggggacggggtcccgtactaccaaccttactacctaccgaaaggaactaaacccttaaaacgttaccccgaaaagtaacccgtacgtaccttttcgttttaacttaacaaaagtcgaaactcgtccgtaggaacgacggaccgtatccggaacgtcccgggtagttacgtattcggtagtcgagacggagtcggtacggaccctaacgtaaaccgttctaccgaagttcggaggtaccgtcgtacgggaccgtaaggtaccccg

SEQ ID NO: 382694 - DNA, 959 bp, Homo sapiens
  misc_feature: GZ8MTXP02HC716.13.76.G10.1.454.CMB.2.raw
  modified_base (292)..(292): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccgaggtccggtcgggggtccctgacgactctcctgtgcacgtcctcgtggttcaccgtcagtccacacctaacngtcgacggccgtacgggtcccgccgacggtccgtaccgggaagggggaaggggtccgtggggtacggtcggtccgtttaccgttttactttttaagtttaagttaaggtttaggtacggggtttaagttaaccccgtaacgttaccgtacccgacgtaacggtaccggttaccggggtccgggggaaccgggggtaccccgttaacgttaacccccgtaacccgtaacgtttaccctaccccgggtaaagaaaccggtaaacccctttaaaaagttaccccggaaaaaacgggaaaacccttaaccgggtttcccctttaagggttttttaaacccccttaaacgtaaaaaacgttacccggggaaaaacctaccggggttacccgttaagggaaacccgggttacccgggttaaacccgggaaccgttaacgggaaaccccggttaccgggggttaccctttaaacgggttaatttaaacccgtggggtggttaaaaccggggaaaagggtaccggacggggttaaccccgggggtaaccccgttaaaaccggttaaaaccccggtttaacggtaacccgttaacccggttaggttaacccgggggtaaacggttcccggggaaaccgggggtaacccggaaaaccgggggtttaaaccccccggg

SEQ ID NO: 382695 - DNA, 690 bp, Homo sapiens
  misc_feature: GZ8MTXP02JVLE0.13.76.G10.1.454.CMB.2.raw
  modified_base (359)..(359): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaggtgcccagtgtgaggtgcagctggtggagtcgtggaggaggcttgatccagccgtgggggtccctgagctctcctgtgcagcctcgtggtccacgtcagtcacactacatgagctcgggtcccgcgaggcctccgaggggaacgggctgggagtgcgtcttcttttattatagtagtggtagtacactacnccgcagctccggtggcggggtccagttccacccagttcccaccgaagacgaactaaacgttacccgaaaacgaacctaacggtctttacgtttaccttaaaccgtaaaagttcggaaaaccgtacgcccgttaaagggaacggtacggtacccgtatacgggaacccgacgggtcccggttagttaccttaggttcgtacggaacggaggaacggtagggtaccggggaaccccctaacgggtaaaccgtttaccgtacggtacttaacggggtacggtaaccggttcgggggacccgggggaccgtaaaccgggggacccttacccgggg

SEQ ID NO: 382696 - DNA, 713 bp, Homo sapiens
  misc_feature: GZ8MTXP02JV8T9.13.76.G10.1.454.CMB.2.raw
  modified_base (281)..(281): a, c, t, g, unknown or other
  modified_base (374)..(374): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagctctctgtgcagcctcgtggttccaccgtcagtcacaccctaanagtgacgcgtcggcccgcgacggccgtacggaggggacggcgtggagtcgtcgttctttactttattagtagtagtagtagtacctacgtacnccgacgacgtaccgtcggtcgggacgggtacctactccactactccgtacgaagaacaaacctaaacgtaaccgaaacgtaacccgtacgttactttacgtttaacctaacgtaaactacgaaacgccgtacgtaggtacgacgaccgtaagtaccgaccggtaccgggtacgttaagttaccgttacggtgggtaaccgggacggtaaacggtaccgggtaacggggtacccggggtaaaccccgtaaacggttaacccgttaacctaaccggtaacgttacggtaccggggtaccggttaccggggacccggggaaacccggtaaccgggtaacccg

SEQ ID NO: 382697 - DNA, 785 bp, Homo sapiens
  misc_feature: GZ8MTXP02HIKP3.13.76.G10.1.454.CMB.2.raw
  modified_base (254)..(254): a, c, t, g, unknown or other
  modified_base (286)..(286): a, c, t, g, unknown or other
  modified_base (610)..(610): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgcttaattttaaaaggtgcccagtgtgaggtgcagcgtggtggagtcgtggaggaggcttgatccagccgtgggggtccctgagtactctcctgtncagcctcgtggtcaccgtcagtcaccacctanagtgacgtcgtcggtccgccgaggcctaccggaggggaacggggcgtaggggaggtcgtccgttactttctttttaaagttacgtaggttagtacggttaagtactacttacctacgaccgacgtaccgtccgggtaggacggggcctaactccaaccgtctacctaccgagtaacgaaaccttaacgttaacccaaagtaacccgtacgtaccttttacggtttaaccgtaacctaaaaagtaccggtaaactaccggggtacctaggggtacgggaacctaaccccggagtacccggaacccgtaaccggggtaccggtttnttaaaacggttcccggtttgtacccggggtaggaaaacccgggtagggaacccggggtttacccggggaacccccgttaaaaccggttaacccgggtttaaccgtaaacccggtacggtttaaacggcccggggtacccggtttacgggggaacccgggggttaaaccccggggg

SEQ ID NO: 382698 - DNA, 707 bp, Homo sapiens
  misc_feature: GZ8MTXP02JCOQK.13.76.G10.1.454.CMB.2.raw
  modified_base (426)..(426): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaggtgccagtgtgaggtgcagctggtggagtcgtggaggaggcttgatccagccgtgggggtccctgagactctcctgtgcagcctcgtgggtccacgtcagtcacacctacatcgagtcgtcgggtccgccgacggcctaccggaagggggaacggggtcgtggggacggtcggtccgttactttacgttttttaagtttagttaaggttagttacggtaacgtactaccgttacctcccgacgtacgaccgttccggnggaccgggggcctacgttccaccgacttacccgacgaacggaactaacttaaacgttacccgaaaacggactaccggttactttacgtttaccttaaacaaagttacgaaacgttagcccgtagacggacgacgtagtacgaaccggacggttccggtatttaaagtcggtgtacggacgtaggacgtacggtacgggggaccccctaaaggtaaacgttacgtacggacttaaggtcggtaaccggtccggtagggacccccgaaggtacccgtacccgg

SEQ ID NO: 382699 - DNA, 720 bp, Homo sapiens
  misc_feature: GZ8MTXP02GVNSR.13.76.G10.1.454.CMB.2.raw
  modified_base (256)..(256): a, c, t, g, unknown or other
  modified_base (273)..(273): a, c, t, g, unknown or other
  modified_base (285)..(285): a, c, t, g, unknown or other
  modified_base (299)..(299): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggtagttttggctgagcttgggttttccttgttgcttaattttaaaaggtgcccagtgtgaggtgcagctgggtggagtcgtggaggaggcttgatccagccgtgggggtccctgacgactctcctgtgcngcctcgtggtcaccgtnagtcacactacntgagcgtcgggccncgaggcctaccggaggggagggcgtggagtgcgttctttactttttatttagtagttaggtaggtagtacctactacgtccgacgagtaccgtcggtggggacggggtccaacttccaacctagttccgtacccaaaggacgtaaacctaaacgttacccgaaaacgaacccgtacgttaccgtttacgtttttaccgtaactaaaacgttacgaaaaccgtacggtacccttagggaaggtaccggacccggtaaagtacggaaacccggtacgggtacccgttaagttactttaccgtggtacgaacgaggtaaggtacggtcgggggaaccctaaacgggtaaaccgttaaccgtacgtaaccgttaaggtacggtaaccgggtcggtaccgggggaaccggaaacggggtaaccccg

SEQ ID NO: 382700 - DNA, 680 bp, Homo sapiens
  misc_feature: GZ8MTXP02JBKDI.13.76.G10.1.454.CMB.2.raw
  modified_base (578)..(578): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgactccgaggccggtcgggggtccctgacgtactcctccgtgtgcagccgtcgtggttccaccgtcacgtcaccacctacatgacgcgtcgggtccgccgaggccgtccggaggggacggggcgtaggagtgtcgttctttcttttagtttagttagttagtaggttaactacctacgttaccgtccgacgacgtaccgttcgggtggggacggggccgttactaccgacctactcctacgaagacgtaacctaaacgttaacccgaaagtaacccgtacgtcctttagtttacctaaacgaaattcgaaaccgacgcctagaacgacgacccgattacggaccgtacgtcgtatacttcgtgngacgagcggacggtccgggaaaccctaacggtaaccgttacgacggtcgttaacgggacggtacccggtcgggtaacccggggaaccgtaaccgggaccccg

SEQ ID NO: 382701 - DNA, 650 bp, Homo sapiens
  misc_feature: GZ8MTXP02F3KSK.13.76.G10.1.454.CMB.2.raw
  modified_base (292)..(292): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccnccgaggctccgaggggaaggggctggagtgcgtcttctttattatagtgtggtagtaccatactcacagactccgtggacggggcattccacctatcctccagacgaacctaattaccaaagaaccacgtcttacgtttacctacaaaatcgaaaccaggtaccctaggagtacgcccgaagttaccggaaccgtaccggggtacccgttgtaacgtttaaccgtaggttacggacggtaaacggaggaacggttccgggggaccccctaaaacgggtaaaacccgtttacgttaaccggaacgttacgtacggggtaaccgttcggtacgggggaacccgaacggggtaaaccccgg

SEQ ID NO: 382702 - DNA, 605 bp, Homo sapiens
  misc_feature: GZ8MTXP02G98RB.13.76.G10.1.454.CMB.2.raw
  modified_base (172)..(172): a, c, t, g, unknown or other
  modified_base (198)..(198): a, c, t, g, unknown or other
  modified_base (264)..(264): a, c, t, g, unknown or other
  modified_base (266)..(266): a, c, t, g, unknown or other
  modified_base (302)..(302): a, c, t, g, unknown or other
  modified_base (342)..(342): a, c, t, g, unknown or other
  modified_base (346)..(346): a, c, t, g, unknown or other
  modified_base (486)..(486): a, c, t, g, unknown or other
  modified_base (507)..(507): a, c, t, g, unknown or other
  modified_base (512)..(512): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctnagtgtcccgtgtccccaggacagacngccagcactccacctgctacgtaggaaaattaagtggacaagtaataaatctactctagtatcgananagagtcagccacgtcctgtgccgtgtcatactatanagatcgaccgaggtcccgacctacgagggtacctccccgngacncttacgttctcgtcggtcctaccgtaacgtccgtaccgggtaactccgaacgtacctacgtcgtacgacctagtaccgacgggtaccgacccgaggtccgttaagcgaagttggacggtacttggtaacctagttaccgngtacggaggtcggacggaacngacgngtaaccgccgtcggacccttagtcgttacgttacggtaccggacgtaccgggaacctacggtacccacggttaccaggtcccaaacgaccccg

SEQ ID NO: 382703 - DNA, 747 bp, Homo sapiens
  misc_feature: GZ8MTXP02JU6A9.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtggaggaggcttgatccagccgtgggggtcctgagctctcctgtgcagtcctcgtggttcaccggtcagtccactacctacatgagcgtcgggtcccgacgcggctccggaggggtacggggcgtgggaggtgtcgttctttacttttatttagagttagtggttatactactacgtccgacagtaccgtcggtggggacggtaccgtattccacccgttacttacccgcccgaaaggtaacgtaaacccgtaaatttacccgaaaaaccgtaccgaccgttacccgttttaacggtttttaccttaacccgaaaaaggtccgtaaacgaacggccccgttaagggacggacggaccccgtagtaccggaaaccgtcccggggttaccgtttagtaacgtttaccgtagggtacggaaccgggtaggtacggtaacggggtcccggggtaaacccccgtaaggttaaaacccggtttaaccgtacccggtaaggtttaaacggacggggttccggttaaccgggcgggggtaaaacccccgg

SEQ ID NO: 382704 - DNA, 642 bp, Homo sapiens
  misc_feature: GZ8MTXP02F1TFJ.13.76.G10.1.454.CMB.2.raw
  modified_base (198)..(198): a, c, t, g, unknown or other
  modified_base (252)..(252): a, c, t, g, unknown or other
  modified_base (281)..(281): a, c, t, g, unknown or other
  modified_base (330)..(330): a, c, t, g, unknown or other
  modified_base (380)..(380): a, c, t, g, unknown or other
  modified_base (393)..(393): a, c, t, g, unknown or other
  modified_base (420)..(420): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttccttgttgctatttaaaaggtgcccagtgtgaggtgcagctggtggagtntggaggaggcttgatccagcctggggggtccctgagactctcctgtgcagcctntggggttcaccgtcagtccacaccctaanagtgacgtcgtcgggcccgccgacggtccgtaccggaaggggaacgggngtagggtgtcgtcttctttcttttaattagtagtagtgtactacataccncacagacttcggnggacgggctataccacatctaccaganaacaactaacaaagaacgactctttacgttactaacaaagtacgaaactagtaccagaacgacgacggataccgaccggacggtacgttaagttaacgttacgtggtacggacgaaggaaggtaacggtaccgggggtaacccgtaaacggttaaaccgttacgtaccggtaacgtaggtacggggtaccgtcggtaccgggggaaccgaacggggaacccg

SEQ ID NO: 382705 - DNA, 584 bp, Homo sapiens
  misc_feature: GZ8MTXP02HYE4G.13.76.G10.1.454.CMB.2.raw
  modified_base (331)..(331): a, c, t, g, unknown or other
  modified_base (364)..(364): a, c, t, g, unknown or other
  modified_base (374)..(374): a, c, t, g, unknown or other
  modified_base (402)..(402): a, c, t, g, unknown or other
  modified_base (418)..(418): a, c, t, g, unknown or other
  modified_base (425)..(425): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtcgtgggaggaggcttgatccagccgtgggggtccctgagactctcctgtgcagcctcgtcggtcaccgtcagtcacacctacatgagcgtggtccgccaggcgtccgagggaagggctggagtcgcgtnttcttttattagtagtagtgtagtacatactcnacgctccggnggacgggccgtattcaccatcctcaganacaactacaaagaacnctagttnttcttacaaaattgaactagaccttagacgacgtccgagtcgaacgacggtccgttagttactagtgtcggacgtaggacgtacggtccggggacctaacggtaaccgttacgaacgtcgttaacgtcgggacttcggacggggtacccgaaaccgggg

SEQ ID NO: 382706 - DNA, 728 bp, Homo sapiens
  misc_feature: GZ8MTXP02HXRQW.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtcctgagactctcctgtgcagcctcgtggtcaccgtcagtcacactacatgagcgtcgggtcccgccgacgggcctacccggaggggtaacggggccgtagggtaggtcggtcggttactttcgtttttaatttagtaggtttaaggtggttaagtacccaatacctccgacagtaccgttccggtgggacggggtccgtacttaccgaaccctacttcctacccgaaggtaaccaactaaacttacccgaaaacggtaaccctaaacggttcctttaacggtttttacccttaaaccgttaaaagtacggtaaaacctacgggtacccgttaagggaaacggtacggaccccggtagtacggaaacccgtacggggtaccgtagtaacttacgtaggtcggacgtaggaggtacgtaccgggggaccctaacggaaaccgtttaccgaacgtcgtagtacgggtacgtccgggtacggggaccctaaaacggggacccg

SEQ ID NO: 382707 - DNA, 599 bp, Homo sapiens
  misc_feature: GZ8MTXP02GYD7D.13.76.G10.1.454.CMB.2.raw
  modified_base (378)..(378): a, c, t, g, unknown or other
  modified_base (450)..(450): a, c, t, g, unknown or other
  modified_base (545)..(545): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggtcttgatccagccgtggggggtccctgagacctctctgtgcagcctcgtggtcacgtcagtcacactacatgagcgtaggtccgcaggcctcgagggagggctggagtcgcttcgtactttattagtagtagtgtagtacactctcgcacgaccgtcggtggacggctntacactactacacaagagaacctactacgaaagtacgctagttacctttacaaacaagtacgaaactcacgngacgcgggtaaccagtaccgacgaccgggttattacgttaaactgtggccgaaggagtacggtacggcccgggtaaactaaccggttaaacgttnaaaccgtggtagtaaccgggcgttagggaccgggaaccgtaacggtaacccggg

SEQ ID NO: 382708 - DNA, 690 bp, Homo sapiens
  misc_feature: GZ8MTXP02GQ07Y.13.76.G10.1.454.CMB.2.raw
  modified_base (620)..(620): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtgggaggaggtcttgactccgaggccgtcgggggtccctggagtactctcctgtcgcacgtccgtcgtcggttcaccgtcagtccactacctacatcgacgtcgtcgggtccgaccgaggcctaccgggaaggggaacggggtccgtagggacggtcggtccggtttacttttacgtttttaatttagttaaggtttaggttaggttaacgtaaccctacttaccgtccgacgtacggtaccgtccggtggggaccgggggcctacgttaccacctactcctaccaagtaaccgtacctaaacttaccgaaacgaccgtacgtctttacgttttaccaaacgtaaaatcgaaaaccgacgtacctaaggacgacgtaccgagtaaccgaccgtaacggtcgtagttactacgtgngacgagagacgtcggaaccacgtaaacgtcgacgtcgtagtcggtacggtcgcgggaccgtacggacccg

SEQ ID NO: 382709 - DNA, 873 bp, Homo sapiens
  misc_feature: GZ8MTXP02GZEGL.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaggtgcccagtgtgaggtgcagcgtggtgggagtcgtgggagggaggtcttgattccgaggccggtcggggggtccctggacgactctcctgtgcagtcctcgtcggtcaccgtcagtcaccacctacatgagcgtcgggtccgaccgtagggcccgtaccgggaagggggaacggggtcgtacggggacggtcggtccggtttcttttacgtttttaagttttaggttaagttaggttagggttaacgttacccgtaacgttaccgtacccggtacgtaccggtaacccggttccggggtcgggggtaccgggggtacccgtaacggtttacccaacccgtaacgttcccgttacccgaaaggaaccggtaaaacctaaacgtttaaccccaaaagggtaaaccccgtcgtttaccgtttacggtttttaacccttaaacgaaaaacgtttccgaaaaaccggtccgttaacccggtagggtaaaccccgaacgggtacccgtaacggttaaccccggaaccggtacccccgggggtttattaacggggtttaaacctttaccgggggcggtaacggtaacggaacgggtacgggtacggggtacccgggtaaacccgtaacggttaaccgttacggtaacgtaaccggttaggtaccgggtacggtaccggggtaaccggggaaccccggtaacgggtaccccg

SEQ ID NO: 382710 - DNA, 718 bp, Homo sapiens
  misc_feature: GZ8MTXP02JMTVR.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctctgtgcagcctcgtgggtcaccgtcacgtcacacctacatgagcgtcgggtccgaccgaggccgtaccggaaggggaacggggtcgtacgggaggtcggtccgtttcgtttactttttagtttagtaggttaggtaggttagtaacctacttacctccgacgagtaccgttcggtgggacgggggtcctacgttaccgacctacgtcctcgaagacgaaccctaacttaacccgaagtaaacccgacgttccttacggttttacctaaactaaaagttaccgtaaaccgaccgtaccgtaggaacggacgtaccggaagtacggaaccgaccggggtccgttagttacgtttacgtaggtcgacggaggtacgggacggtccgggggaacctaaaccggtaaccggtttacgtaaccggtcgtacggtacggggtacccgtacggggtacggggtacccggaacgggtaaccccgg

SEQ ID NO: 382711 - DNA, 662 bp, Homo sapiens
  misc_feature: GZ8MTXP02JAOTH.13.76.G10.1.454.CMB.2.raw
  modified_base (573)..(573): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtgggggtcctgagactctcctgtgcagcctgtgggttcaccgtcagtcacacctacatgacgcgtcgggtcccgccgaggcctccggaaggggaacggggcgtaggagtcggtcgtttactttacgtttttaatttagtaggttaggttaggttacgtacctacgtacctcccgactacgtaccgttccgggtgggacggggtaccgtacttaccaccgtatccctaccgaagacaacctaaacttacccgaaagtaaacccgtacgtcttacgttttacctaaacaaagtacgaacgtacgacgtagacgacgaccgagtacggacgtacggtacgttatacgttacgngtacgacgagacggtacggtaccggaccgtaacgtaacgttacgtacgaacgtacggtacggtacgtcgggaccggaccgtaacggccg

SEQ ID NO: 382712 - DNA, 831 bp, Homo sapiens
  misc_feature: GZ8MTXP02G1686.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagtttggctgagcttgggttttccttgttgcttaattttaaaaggtgcccagtgtgaggtgcagcgtggtggagtcgtggagggaggcttgactccgagccggtcgggggtcctgagactctccgtgtcgcagtccttcgtcgggttcaccgtcacgtaccaccacctacagtgacgccgtcgggtcccgaccgacggcctaccgggaagggggacggggccgtagggacggtcggtccgtttactttacttttttaagtttaacgttaaggttacggttagggttacgtaaccctaccgttaccgtcccgtaccgtacggtaccgttaccgggtcgggggaccggggtaccggttaccttaccgtaaccctaccttacctaacccgtaaagtaacgtaaaccctaaaccgttaacccaaaaggtaaaccctacgttccgttaacttttaccttaaaccgaaaagttacgaaaaccgtccgaaaccgttcgggaaacggaccggtaccccgtaagtacccggaccgtacccggggttaccgtttaggttaacgtttaccgttggaaaccggttggaaacggtacgggaaccgggttccgggaaacccccgttaaccggtaaaccgttaacccgtacggtaaccgttaaggaccgggttaaccgggcggttaacccgggggaaaccgtaacggggtaacccccgg

SEQ ID NO: 382713 - DNA, 666 bp, Homo sapiens
  misc_feature: GZ8MTXP02IDNNM.13.76.G10.1.454.CMB.2.raw
  modified_base (451)..(451): a, c, t, g, unknown or other
  modified_base (483)..(483): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgacgactctcctgtgcagcctcgtgggtcaccgtcagtcacacctacatgagcgtcgggtcccgccgaggcctccggaaggggaaggggcgtaggaggtcgtcggttctttactttttagttagtaggtagttggtacgtacctacgtactccgacagtaccgtccgtggggacggggtccgacttccacctatcctaccagagactaacttcaaanacacgtcttgtttacctaacaaagtcgaaacncgtacctggaacgcgacgtagacgaacgtaccggggtccttagttacttacgtcgttcggacggtaaagggacgacggggttaccgggggaccccttaaacgggtaaaccgttttccgaacggtcttaacgggtcggggtaaccggttcggaaccgggggaaccgaaacgggggttacccccg

SEQ ID NO: 382714 - DNA, 798 bp, Homo sapiens
  misc_feature: GZ8MTXP02I6JKJ.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtggaggaggcttgatccgacggccgtcggggggtccctgacgtactctccgtgtgcacgtccgtcgtcggtccaccgtcagtccaccacctacatcgacgtcgtcgggtccgccgacggccgtacggagggaggggcgtggagtcgtcggtttctttactttttaagttacgtaggttagtcggttaagtaccctaacgtaccgtccgactacggtaccgtcgggtacggggacgggggtaccctacgttaccaacccgtactaccgtaccgaaacgtaacgtaaacctaaaccttccgaaaacgtaacccgtacgtcccgttttaaacggttttaacctaaacgaaaacgttaacgtaaaacccgtcggacccggttacgggaagacccggacccgtaaggcccggtaacggtaccgggttacgttacgttaaccgtttaggtccggtgggtaaaccggaggttacgggaaccggtacccgggggtaaaccccgtaaccggttaaaccgttaaccgtacggtaacccggttaaaaggttccgggtaaaccgggttcgggcccgggggtaaaccgaaaacccgggggttaccccgg

SEQ ID NO: 382715 - DNA, 596 bp, Homo sapiens
  misc_feature: GZ8MTXP02F9ZCQ.13.76.G10.1.454.CMB.2.raw
  modified_base (253)..(253): a, c, t, g, unknown or other
  modified_base (270)..(270): a, c, t, g, unknown or other
  modified_base (328)..(328): a, c, t, g, unknown or other
  modified_base (426)..(426): a, c, t, g, unknown or other
  modified_base (477)..(477): a, c, t, g, unknown or other
  modified_base (588)..(588): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgccctcagtcgtcgtggggccccagggcaggacggtcaccatctcctgcacgtgggactcagcctaccaanagttgggcacagtttanggatgtacacgtgtaccatctagttccaggacgcacggtaccccagtaacctccctanactacaataacctaacaacgtacgtccgccgacggacgggtccagaccgtcttcgtcgtcgcctacgtcgtctcgcctaccgtccgacccgtccccgngtactacgtacgtacgtcggtactaccgaggtcgaggtagagtcggacgtnttacgttactttacgtcgacgtcgttacgtacgtcgacgtacgacgtacgaccgtacgtaggttacgtccggttacggttacgggtacgggtaccgggggaccgggtaccncggtaccg

SEQ ID NO: 382716 - DNA, 735 bp, Homo sapiens
  misc_feature: GZ8MTXP02G06XJ.13.76.G10.1.454.CMB.2.raw
  modified_base (289)..(289): a, c, t, g, unknown or other
  modified_base (296)..(296): a, c, t, g, unknown or other
  modified_base (398)..(398): a, c, t, g, unknown or other
  modified_base (434)..(434): a, c, t, g, unknown or other
  modified_base (440)..(440): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggtagttttggctgagcttgggttttccttgttgcttattttaaaaggtgcccagtgtgaggtgcagcgtggtggagtcgtggaggaggtcttgatccgaggtccggtgggggtccctggagactctcctgtgcacgcctcgtggttccacgtcagtcacnccgtacntacgacgtcgtcgggtccgcgacggtccgccggaaggggtacggggcgtggtagtcgtcgtttcttctttattagtagttagtaggtactatactacctcgnacgtccgtcggtaggacggggtcctagttccacctnttaccncaaacggtactaaactacgttaaccaaacggtacctacgttcgtttactttacccgttaaacaaacgtacgaaacgtacggtaccgtaggaacggtaccgtaaccgtaacgtaccggtaaccggtccgggttaccgtttaacggttaaccgtttacggtcgggacggtaacgggaacgggtaacggtaaccggggtacccgggtaaacccgttaaacggttaaacccgttaacggtaaccggttacggttacgggtaccgggtaaccggttccgggtaaaccgggggtaacccgg

SEQ ID NO: 382717 - DNA, 730 bp, Homo sapiens
  misc_feature: GZ8MTXP02FFZ01.13.76.G10.1.454.CMB.2.raw
tcagtcacgtactacacgaccggtgctcgatttagtcactcatacagggggctgggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagtccgtgggggtccctgagactctctgtgcagcctcgtggttcaccgtcacgtcacacctacatgacgtcgtcgggtcccgcgaggcctccggaggggacggggcgtgggagtcgtcgtctttactttttatagtaggttaggtaggttagtaccagttaccgtcccgagacgtccgtccgggtcggaaacgggggtccctattaccaacctagttccctaccgaaggtaacgtaaacctaacgttaaaccccgaaaggaaaccctaaccggttccgtttacggttttacctttaaccgaaaaaggttcaaaaccgttacgtacccgtgaacgggacgacccgttaagcccggtaacggaccggtacccgttagttaacgttaacgttccggaggaccggtaggaacggttacgggacccggggaaccccgtaacgttaaaaccgtttaaccgacgttaccgtaaggtacgggtaacccggtcgggtaccgggggtaaaacccccggg

SEQ ID NO: 382718 - DNA, 704 bp, Homo sapiens
  misc_feature: GZ8MTXP02FN31E.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctgggtggagtcgtgggaggaggcttgactccgaggccggtcggggggtccctgacgactctcctgtgcagcctcgtggtcaccgtcagcacacctacatgacgcgtcgggtccgccgacggcctcggaaggggaacggggcgtgggagtcggtcgtttctttactttttaagtttacgttaaggtaggttaggttaacgtaccctacgttaccgtccgtacgacgtaccgttcgggtggggaccgggggtccgtacttccaccgtactccgtaccgaaagacgaaacctaacgtaacccgaaacgaacctaccgtctttacgtttacctaaaccgaaaagtacgaaaacctacgcgttaacgggacgaccgggtaccgaagtaccggaccgtaaccgggtccgttaagtattaccgtgtacggaacgaggtaacggcggtacccggggaacctaaccggttaacgttctaacgcgtaaggtccgtccggtcggtacgggaccgaacggtacccg

SEQ ID NO: 382719 - DNA, 578 bp, Homo sapiens
  misc_feature: GZ8MTXP02FLBL9.13.76.G10.1.454.CMB.2.raw
  modified_base (386)..(386): a, c, t, g, unknown or other
  modified_base (390)..(390): a, c, t, g, unknown or other
tcagtcacgtactacacgaccggtgctcgatttagtcactcatacagggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccaggccgtgggggtccctgagactctcctgtgcagcctcgtcgggttccaccgtcagtcacacctacatgacgcgtgggtcccgccgaggcctccggaaggggaacggggcgtgggagtgcgtctttctttttattagtagttagtggtatacatactcgcagtcnccgnggaggggccattcaccatctccagacacaattccaagaacacgtctgtttaccttacgtaaaatcgaaacacgcctagagacgaccgatcgaacgacggccgtagtatacgtgtagcgagaggtacgcggggacccaacgtaacgtaacgtaacgtctacggtggtaacgtcggtcggggaaacccgg

SEQ ID NO: 382720 - DNA, 586 bp, Homo sapiens
  misc_feature: GZ8MTXP02F3V13.13.76.G10.1.454.CMB.2.raw
  modified_base (431)..(431): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtccgccaggctccgagggaggggctggagtgcgtcttcttttatttatagtagtggtagtaccatactccgcagacctccgtggacggggccattccaccatctccagagacaatccaaagaacacgcttgttacctaanaaatacgaacacgacgtaggagacgaccgagtacgaccgacggtcgttagtagttacgtgtcgacggtaggacgtacggtaccgggaccctaacggtaaccgttacgtacgtaacgtacggtacggaccggtcggacggggaccgaacgggcccg

SEQ ID NO: 382721 - DNA, 851 bp, Homo sapiens
  misc_feature: GZ8MTXP02JVUEI.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtgggaggaggtcttgatccagccggtgggggtcctgagactctcctgtgcacgcctcgttcggtcacccgtcacgtcacacctacatgacgcgtcgggtccgccgaggcctcggaaggggaggggcgtggaggtggtccgttctttactttttagtttagtaggttacggttggtaacgttaccctactaccgtccgacacggtaccgttccggtggggacgggggccgtaacttcccgaaccctactacctacccgaaggaaacctaactaaacgttaacccgaaaacgtaaaccgtaccgttcccgttttaacgttttacttaaaccaaaagttacgaaaacccgacggttacccgtaggaacgggaacccgtacccggggaaatcccgggaaacccggttaccgggggtacccgttttaaggttaaccgtttaccgtaggggtcggtaaaccggggtaaaagggaccgggggttaaaccggggttacccggggggaaaccccccgtaaaaaccgggtttaaaacccggggttttaaaccgacccggggttaaaccgtttacggggtaaccggggggtaaccccggtttaccggggggaacccggggggtaaaccccgggaaaaaccgggggttaaccccccgg

SEQ ID NO: 382722 - DNA, 781 bp, Homo sapiens
  misc_feature: GZ8MTXP02IT038.13.76.G10.1.454.CMB.2.raw
  modified_base (283)..(283): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtgggtggagtcgtgggaggaggtcttgatccgaggtccggtggggggtcctgagtacctctcctgtcgcagtcctcgtcgggttccaccgtnacgtcactactacatggacgcggtacgggtccgccgaggccgtccggaaggggacgggcgtagggagtacggcgtttcttttactttttaagtttacgttaaggttacggttaggggtaactaccctaacgtacccgtacccgcgtaacgtacccgttaccggtgggggaccggggtacccgtatttaacccccgaccgtacttacccttaacccgagtaaaccgtaaaaccctaaacgggttaaacccaaaacggtaaacccgacgggtttactttaaccggtttttacgtaaaacctaaaacgttacgaaaacccgttacgtacccgttaagggaaacgggaacggacccggtaaaacgtacgggacccgtaacccggggtccgtaagtttaacgttctacgggtagaccggtagacggttacggtaacgggggacccctaaggtaccgttaacgactcgttacgaggtacctccggacggacgtaacgggacccg

SEQ ID NO: 382723 - DNA, 682 bp, Homo sapiens
  misc_feature: GZ8MTXP02H5QD8.13.76.G10.1.454.CMB.2.raw
  modified_base (602)..(602): a, c, t, g, unknown or other
  modified_base (608)..(608): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggtttttccttgttgcttaattttaaaaggtgcccagtgtgaggtgcagcgtggtggagtcgtgggaggaggtcttgactccgagtccggtcggggtcctgacgtctcctctgtcgcacgtcctcgtcggtccaccggtcagtcacactacagtgacgcgtcggtccgccgaggtccgaccgggaaggggacgggtcgtaggggtcgtacggttccgtttacttttacgtttttaatttagttaaggttacggttaggttaacgtaccgtacgttacccgtccggaacgtaccggtaaccgttccgggtgggggaccggggtacctacgttaccaccgtactacctaccgaagaactaccgtaactaaccgaaacgacgtacgttcttacgtttacaaacagtacgaacgtagtccgtaggacgacgcgtagacgacgtacggtcgtaagttcttagngcgagngggagacgggccggaaccttaacgaacctttcgacgtcgagtaccggcgtacgggccggaaacgaccggtcccg

SEQ ID NO: 382724 - DNA, 816 bp, Homo sapiens
  misc_feature: GZ8MTXP02GLXKJ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggtagttttggctgagcgttgggttttccttgttgtcttaatttaaaaggtcgccagtgtgaggtgcagcgtggtggagtgtggaggaggtcttgactccgaggtccggttcggggggtccctggagtacgtctccgtgtcgcacgtcccgttcgtcgggttacccaccggtcacgtaccaccaaccctacagtcggacgtcggtcgggccccgacgacggtacctccgggaaggggaacggggtcgtgggagttcgtcgtttactttacgtttttaagttttaagtagttaggttaggtaacgtacctacgttaccgtcgactacggtaccgtccgggtacggggacgggggtaccctaacttacccgaacctactacctacgaaaacgaactaaaccctaaacgttaacccgaaaaagttaacccgtaaccgtcttttaaccgtttttaaccaataaaaacgtcggttaaaaacccgtccgtaacggtaaggtaacggaaccggtaaccgaaccgtaaacgacccgggtaccggttaccggttaacttaacgttacggtcggtaagaacggtaaagggaccggtaacggggtaccccggggtaaacccgtaaacggttaaaccgttaaccgtacgtaacgtacggtaccggtaccggtacgggaaccggggaaccggaaccggtacccg

SEQ ID NO: 382725 - DNA, 724 bp, Homo sapiens
  misc_feature: GZ8MTXP02FLZTD.13.76.G10.1.454.CMB.2.raw
  modified_base (249)..(249): a, c, t, g, unknown or other
  modified_base (296)..(296): a, c, t, g, unknown or other
  modified_base (524)..(524): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttaattttaaaaggtgcccagtgtgaggtgcagctggtggagtcgtggaggagcttgatccagccgtggggtccctgagactctctgtgcngcctcgtggtcacgtcagtcacacctacatgagcgtcggtccgacgnggccgtaccggaggggaacggggcgtggagtcgtacgttcgtttacttttagtttagttaagtaggtaggtacgtaccgtactacccgtcgacgtacgacccgttaccggtggggacggggtaccctacgttacccaaccgtactaccgtacccgaaggtaaaccaaccgttaaaacgttaaccccgaaaagtaacccctacggtcctttacgtttttaaccctaaanaaaagttaccgaaaacctacgtcccgttaggaacgaaccggacccgtaagaccgaaaccgtcggtccgttaagttaccgttagtcggagtacggacgaggtaccggtaacccgggtaccccaaaaggtttacccgtaaacgtcggtaaccgtaggtaccggacggttacgggacgggggaaccccgaaaaggtcccccgg

SEQ ID NO: 382726 - DNA, 725 bp, Homo sapiens
  misc_feature: GZ8MTXP02FZCDJ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagcgtggtggagtcgtgggaggaggtcttgacttccgacggtcccggttcggggggtcccttggacgtaccttccttcccgtggtcgcacgtcccgttcgttggggtcacccgtcacgtccacacctacatgacgtcgtcgggtccccgaccgacggcccgtaccggaggggaacggggtcctggggacggtcgtccgtttctttactttttagttttagtaaggttagttaggtagtaccactaccgtccgacacgaccgttccggtggacggggtccgtacttaccgacctactacctacccaaagtaccaaactaaacttaaccgaaagtaaccgacgtctttacgtttacttaacgaaaactcggaaactacggtccgtaggtacgaccgacgtagtaccgacgtaccggtccgttaagttattaccgtaggcgacggtagtacggacgggttacccggggaccctaaacggtaacgttacgaccgtaagttacggcgggtaacgcgggtacgggtaaccgaacggggaaccc

SEQ ID NO: 382727 - DNA, 768 bp, Homo sapiens
  misc_feature: GZ8MTXP02GBIUM.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgtcttaattttaaaaggtgcccagtgtgaggtgcagcgtggtggagtcgtggaggaggcttgactccagccggtcgggggtccctgacgtacctcctccgtgtcgcacgtccttcgtggttccaccgtcacgtccacacctacatgacgcgtcggtcccgccgacggcctccggaaggggaggcgtaggagtcgtcgttctttacttttatttaagtagttaggtaggttaagtaccctacgttaccgaccgacagtacccgttcgggtcgggacggggacctacgttacccaaccctagtacctaccgaagtaacgaaaccctaaacgttaccaaaagtaacccgtaaccgttacctttacgtttttaacctaaacctaaaacgttacgaaaacctaccgtacccgtagaaacgaccgtaccgtacgtaaccggaccgtaaccgggttaccgttaacggttaactttaccggtggtacggtaacggaaggtaaacgggtaccgggttaccgggggaacccctaaaccgggttaaaaccgtaccgttaaccggtaacgttaaccgggtacggtaaccggttcgggaccgggaccggaaaacgggtaccccg

SEQ ID NO: 382728 - DNA, 561 bp, Homo sapiens
  misc_feature: GZ8MTXP02FGVQV.13.76.G10.1.454.CMB.2.raw
  modified_base (195)..(195): a, c, t, g, unknown or other
  modified_base (242)..(242): a, c, t, g, unknown or other
  modified_base (264)..(264): a, c, t, g, unknown or other
  modified_base (293)..(293): a, c, t, g, unknown or other
  modified_base (437)..(437): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttcctgtgctattttaaaaggtgcccagtgtgaggtgcagctggnggatctggaggaggcctgatccagtccgtgggggtccctgagactcncctgtgcagctctggtcacgtnagtaactccacatgacgtctcggggtccnccgaggtcgtccgaggggaggggcttggcgtgcgtctctttattatagtagtgtacgtactatactcgcacgacgtccggcggacggcgtactcacactcacagaagactaactacaacgacactcgttacttactactaatanacgacgacgtagacgacgacgacgtacgacgacgtacgtacgtacgtagtacgacgacgagacgacggaccggaccgacgtacgtacgtaacgcgtacgtacgtacgtcggacggaccgaacgg

SEQ ID NO: 382729 - DNA, 695 bp, Homo sapiens
  misc_feature: GZ8MTXP02H9FF9.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcgttgggttttccttgttgcttaattttaaaaggtgcccagtgtgaggtgcagcgtggtggagtcgtgggaggaggtcttgactccacggtccggtcgggggtccctgacgacttcctcctgtgcacgtcctcgtcgggttccaccgtcacgtcacctacctacagtgacgtcggtcgggtcccgaccgaggccctaccgggaggggacggggcgtggggagtcggtcgtttcttttactttttagttagttaggttaggtaggttacgtaacctactaaccgtccgacgtacgaccgttcggtcgggacggggtccgtacttacccgactactctacccgaagaacaacttaactaaccgaaagaaacccgtcgttctttacgtttaccttaaacgaacgtacaaaccgtcgtcctagggacgtacgcgaagtccgaacgtcggtactgttattacgtggtacgacgaaaggcgtacgggtaccgggacctaacggacctttaccagtaaccgttggtacggacgttcggacgggtaaccgaaccgggtacccg

SEQ ID NO: 382730 - DNA, 882 bp, Homo sapiens
  misc_feature: GZ8MTXP02I3W3X.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgtcttaattttaaaggtgcccagtgtgaggtgcagcgtggtggagtcgtggaggaggtcttgatccaggccggtgggggtccctgagtacctctccgtgtgcgacgcctacgtcggggttccaccggtcacgtccaaccaccgtacatagacgcgtcgggtcccgacgacggtcaccgggaaggggaacggggctaggtagtcgtccgtttacctttagtttttagtttagtaggttacggtaggttaacgtacctaacgtaaccgttccgacgtaaccggtaccggttccccggttagggggaccggggttaccccggtaaagtttccccgaaccttaacgtacccccttaacccgaaaaggacgtaaaacccttaaaacggttacccaaaacggtaaacccgtaacccggtttcctttaacgttttaaaccccttaaacgaaaagttacccgtaaaacgcggtttaacccctagggaaaccgtaccgggtaacccaagttacggaaaacccccggtcgggttacccgttaaggtttaaacccgtttacggtcgggagggtaaccggaaaaggggtacccgggtttacggggtaccccgggaaaaccgttaaaccccggtttaaaaaccgttaaccggtacccttaaggtaaaacgggtccgggggttaaacccggttccgggaaacccgggggttaaccgggaaaaccggtttaacccccggg

SEQ ID NO: 382731 - DNA, 776 bp, Homo sapiens
  misc_feature: GZ8MTXP02GBBG8.13.76.G10.1.454.CMB.2.raw
  modified_base (252)..(252): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtggaggaggcttgatccagccgtgggggtccctgagactctcctgtgcngctcgtggtcacgtcagtcacacctacatgagtcgtcgggtcccgcgacggccgtaccggaaggggaacggggtcgtagggtacggttcggtccggtttccttttctttttaaagttttaaagttagtttaaggttaggttaacgttaaccctaacttacccgttcccgaccgtaacggtacccgttacccgggttggggaaccgggggtaccccgtaacgtttaccccaaccctaacttccctacccgaaagtaacgaaaccttaaacttaccccgaaaagtaaccctacggtactttacgtttacttaaacgaaaattacgaaaccgacgtcctaaggacgacggaccgtagtaccgaaccgtaccgggtccgtttagttaacttacgtggtcggacggtaagggaggtaacccgggtacgggggaaaccccctaaaacggtaaccgggtttaaccacggtaacccgtaagggtccggtacggttccgggtacgggggacccgttaaaacggggacccccgg

SEQ ID NO: 382732 - DNA, 757 bp, Homo sapiens
  misc_feature: GZ8MTXP02IRE6H.13.76.G10.1.454.CMB.2.raw
  modified_base (261)..(261): a, c, t, g, unknown or other
  modified_base (316)..(316): a, c, t, g, unknown or other
  modified_base (347)..(347): a, c, t, g, unknown or other
  modified_base (620)..(620): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccctagtgtgaggtgcagctggtggagtcgtgggagggaggcttgactccacgccgtcggggggtccctgacgactcctccgtgtcgcncgcctcgtcggttccaccgtcacgtcacacctacagtcgagtccgtcgggtcccnccgacggtcgaccggaggggacgggcgtggngtgtaccgttctttacttttattagtagttaggtaggttagtacctactaccgtccgctacgtaccgtcggtggggacggggtccgtacttacccgaccctacgtaccgtcccgaaagtagtaaaccctaacttaaacccgaaacgtaacctaacggttccttttacgttttcttaaacaaaagtcgtaaaccaggtaccctaagggacggaaccgaccgggtaaaattccgggaaccgtacggggtccgttaaagtttaactttaacggggnggtaacgaacgggtaacgggtaaccggtacggggtacccgggaaacccgttaaaccgggttaacgtaccgttaacggaacgttaacggtaccgggttaccggtccggaccgggggtaaaccgaacccggggtacccg

SEQ ID NO: 382733 - DNA, 705 bp, Homo sapiens
  misc_feature: GZ8MTXP02IR96L.13.76.G10.1.454.CMB.2.raw
  modified_base (318)..(318): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtggtggagtcgtggaggaggcttgatccaggccggtgggggtccctgacgacttcctcctgtcgccagtccttcgtcgggttccaccgtcgacgtcaccacctacagtgacgtcgtcgggtcccnccgacggccgtaccggaaggggacgggcgtaggagtcggccgtttctttactttttagtttagttaggttagtaggttacgtaccgtactaccgtccgacgtacgtacccgttcgggtggggacggggtacctaacgttccgaacctacgtacctaccgaaggacaaactaacttaaccgaaacgtaacctacgttctttagtttaacctaacgaaacgtacgaaacaccgactaggagtaccgacgacgtacgaccgtacggtctagttacgtacgtgtacgacgacgtacggacggtaccggggaaccctaacggtaaccgttacgtacgtaacgtacggtacggttaccggtacggtaccggggacccgtaaacggggtacccg

SEQ ID NO: 382734 - DNA, 727 bp, Homo sapiens
  misc_feature: GZ8MTXP02FSTQM.13.76.G10.1.454.CMB.2.raw
  modified_base (174)..(174): a, c, t, g, unknown or other
  modified_base (287)..(287): a, c, t, g, unknown or other
  modified_base (293)..(293): a, c, t, g, unknown or other
  modified_base (430)..(430): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgcttatttaaaggtncccagtgtgaggtgcagcgtgggtggagtcgtgggaggaggtcttgatcccgaggccgttcggggggtccctgacgacctctcctgtgcagcctgtggtccacgtcagtcacnccctanatggacgtcgtcgggtcccgaccacggccgtcccggaggggtaaggggcgtcgggaggtcgtccggtttctttacgtttttaatttagtaaggttagtcggttaagtacctattaccgtccgacagtcccgtccggnggacggggccctattaccgacctactcctacgaagcgaaactaacttacccaaaaggaccaccggttctttacgtttactaacaaaacggttgaacctacgggtcctaaggacggtacggaccctaagcggtaaccgacccgggtgttagtttaaacgttccgtaggtcggaaagaacggtgggttaacgggcccgggggtaaacccctacggttaaaacccggtttaaccaacgggttaccttaggggtaccccggggtacggtttacccggggtacgggggtaaaaacccccggg

SEQ ID NO: 382735 - DNA, 637 bp, Homo sapiens
  misc_feature: GZ8MTXP02FG8EJ.13.76.G10.1.454.CMB.2.raw
  modified_base (283)..(283): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggttcaccgtcagtcacacctanatgacgctgggtccgccaggctccgaggggagggctggagtgcgtcttcttttatatagtagtcgtagtacatactccgcagacctcgtggacgggggccattcaccatcctccaagacgacaattacccaaagaaccacgacttgtttacctacaaaatcgaaacctacgcctagaacgggacgaccccggtaattaccggaaacccgtaccggggtccgttaagtttaacgttacgtagggtcgacgggaacgaagggtacgtaccggggggacccctaacggtaaaccggttaaccgtaaccggtacttaacggtcggggtaccggtaccgggtacgggggaaacccgggg

SEQ ID NO: 382736 - DNA, 793 bp, Homo sapiens
  misc_feature: GZ8MTXP02FMO5I.13.76.G10.1.454.CMB.2.raw
  modified_base (285)..(285): a, c, t, g, unknown or other
  modified_base (297)..(298): a, c, t, g, unknown or other
  modified_base (312)..(312): a, c, t, g, unknown or other
  modified_base (320)..(320): a, c, t, g, unknown or other
  modified_base (380)..(380): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaggtgcccagtgtgaggtgcagcgtggtggagtcgtgggaggaggtcgttagactccgaggccggtcggggggtccctggacgtacctctcctgtcgcacggtcctcgtgggtcaccgtnagtcacactacnngagcgtcgggtccncgacggcncgaggggacggcgtggagtgcgttcttacgtttatatagtagttaggtactactataccncgtacgacgacgtccgtggggcgggaccgtatccgaacctctccgcccgtaaagcgtaaaacctaacttaaccgaaaacgaaccgtacgtcgtttaacgtttttaacccttaagaaaacgttacgtaaaccgaccggtaccctaaggggaccgtaaccggtccgaaaacgttcgggaaacccgtaaccggggttccggtttaaacgttacgtttaccgtttaggggaacggtaccggtaagggtaaaccggaccggggtaaaccccggggggtaaaccccttaaaccgggggtttaaaaaccctttaccgttaacccgggttaacccggtttaggggaaccgggggtttaaccccggggtccgggggttacccggggggaaaacccgttaaaacccggggggtaaccccccgg

SEQ ID NO: 382737 - DNA, 633 bp, Homo sapiens
  misc_feature: GZ8MTXP02JW9JT.13.76.G10.1.454.CMB.2.raw
  modified_base (348)..(348): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgactccaggccgtggggggtccctggagacctctcctgtgcacgcctcgtgggtcaccgtcagtccacacctacatgacgcgtcggtccgcacggctcggaggggagggcgtgggacgtcggtcgttcgttnttttaagtttagtagttaggtacggtagtactactacgtccgacgtacgtccgtaccggtaggggaccgggtccgattcccgaactactccctaccgagacgaactaattaccgaaacgaacgcgtacttgtttactaacgtaaatcgaaacagaccgtagacggacgaccgtagtacgaccgtacggtcgttagtactacgtgtacggcgaagcgtacgggtcccggaaccgaacgtaaccgttaagaccgtagtacgtacggtacgtcgggaccggaaccggg

SEQ ID NO: 382738 - DNA, 747 bp, Homo sapiens
  misc_feature: GZ8MTXP02JPIV4.13.76.G10.1.454.CMB.2.raw
  modified_base (525)..(525): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggtcttgatccgaggccggtcggggggtccctggacgaccttcctccgtggtcgcacgtcccgtcgttcgggttcccaccggtcacgtaccacctaccctacagttggacgtccggtcgggtccccgccgaacggccgtccgggaaggggaaggggcgtgggagtcggttcgttcgtttactttttagttagtagttagtaggtataccactacgtccacgacgtaccgtcggtgggaccggggtactacgtaccactactcctaccgaagaactaacctaataccaaagtaccacggttcttacgtttacanaaagtcggaaaactcgtaccgaggaacgtacggacccgtaataccggaccgtaccgggttacgttagttacgtacggtcggtaacgaccgggaaggtacggaccgggggttacccgggaacccccttaaaacgggttaaccgttaacccgtaaacggtccgttaaacgggtaccggtacgggtccggggtaaaaccggggaccgaaacccgggtaaccccgg

SEQ ID NO: 382739 - DNA, 681 bp, Homo sapiens
  misc_feature: GZ8MTXP02I7EXZ.13.76.G10.1.454.CMB.2.raw
  modified_base (561)..(561): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgacgactctcctgtgcagcctcgtgggtccaccgtcagtcacacctacatgagccgtcgggtcccgccgaggcctaccggaggggaacggggcgtggagtcgtcgttctttctttttaattagtagttaggtggttacgtacctactacctccgctagaccgttccggtgggacgggtctacgttccaacctacgttcctccgaaagcgtaacctaacttaacccgaaagtaaaccctacgtccgtttagttttaccaaagaaacttcggaaaactcgccgtaggacgaccgtacgactacggacgacggtaccggttatacgtttacgnggtacgaacggtaggaacggtaccggtacccggaaaccgtaaccgttaaaccgtcctacgtaacggttaacggtacgggtacccggtacggggtaacgggaacccggtaacggtaccccg

SEQ ID NO: 382740 - DNA, 764 bp, Homo sapiens
  misc_feature: GZ8MTXP02F937O.13.76.G10.1.454.CMB.2.raw
  modified_base (261)..(261): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttatttaaaaggtgccagtgtgaggtgcagcgtggtggagtcgtgggaggaggcttgatccgaggccggtcggggggtcctgacggtactcctccgtgtgcncgcctcgttggggtccaccgtcacgtcaccacctacgagtcgacggtcggtcgggtccccgccgtacggccgtccggaggggaagggcgtgggagtcggtcgttctttcgttttaatttagtaggttagtaggttaagtacctacgtacctcggactaacggtaccgttccgggtgggggaccggggtacccgtatttaccccaaccgtacttcccgaacgaacggaaactaaaccctaaacttaacccgaaaacggtaaaccctacgttcccgtttagtttaccttaaaacgaaaagtacggaaaacctacggccttaacggaagtaccggacgacgttaaccgaccggtaccggtccgggtttaattacgttactgggttacggaacgaagggacggtaccgggtaccggggaaccctaaaccggttaaccgttaagtaaccgtcgtaacggtacggggtacgttaccgggaacgggggacccgaacggggttaaccccgg

SEQ ID NO: 382741 - DNA, 659 bp, Homo sapiens
  misc_feature: GZ8MTXP02HN58L.13.76.G10.1.454.CMB.2.raw
  modified_base (382)..(382): a, c, t, g, unknown or other
  modified_base (486)..(486): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcacgcctcgtcgggtcaccgtcagtcacacctacatgagcgtgggtccgccgaggcctccgaggggaaggggctggagtgcgtctttcttttatttagtagtgtggtagtacactcgtccgctagaccgtcggngggacggggctattccgacctatctcccgagacgactaacttacgaacgaacacggtcttgtttctacaaagtacgaacgacgaccctaggacgacgccgtaanacgtaccgacgggtccgttagttatttaccgtgggtacggcggtaagggacgtaacgggtcccgggggaacccctaacggtaaaacccggtttacgaccggtaacgttaacgggtacggggtaccggttacccgggtacggggggtacccggtaaaccgggggtaacccccgg

SEQ ID NO: 382742 - DNA, 579 bp, Homo sapiens
  misc_feature: GZ8MTXP02G72CN.13.76.G10.1.454.CMB.2.raw
  modified_base (233)..(233): a, c, t, g, unknown or other
  modified_base (246)..(246): a, c, t, g, unknown or other
  modified_base (291)..(291): a, c, t, g, unknown or other
  modified_base (365)..(365): a, c, t, g, unknown or other
  modified_base (381)..(381): a, c, t, g, unknown or other
  modified_base (385)..(385): a, c, t, g, unknown or other
  modified_base (436)..(436): a, c, t, g, unknown or other
  modified_base (454)..(454): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtcgtggaggaggcttgatcagcgtgggggtcccngagctctcctgtncagcctcgtggttcaccgtcagtcacactacatgagcgtcggccncgaggctcgaggggaggcgtggagtgcgttcttacttttattatagtagtggtatacgatacctcacagctcgnggcgggcattccactntccncagacgaacaacgtacaaagactacgtctgtttactacaaagtacgaaacncgactaggacacgccgancgacgacggctagtacttagtggtagacgtaggacgacggtccggggaacccaacggtaacgttaacctacggaaccttaggtaccggacgttacgggaccgggtaccgaaacggggtaaccccg

SEQ ID NO: 382743 - DNA, 649 bp, Homo sapiens
  misc_feature: GZ8MTXP02HI7BN.13.76.G10.1.454.CMB.2.raw
  modified_base (246)..(246): a, c, t, g, unknown or other
  modified_base (251)..(251): a, c, t, g, unknown or other
  modified_base (290)..(290): a, c, t, g, unknown or other
  modified_base (367)..(367): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaggtgcccagtgtgaggtgcagcgtggtggagtctggaggaggcttgatccagcgtgggggtcctgagactctcctgtgcngcctntcgggttcaccgtcagtcacactacatgagctcgggccnccaggctccggagggaggggctgggagtgtcgtcttacgttttattagtagtaggtgtacgactatacctcgacganacgtccggtgacgggggcacgttccacctactcctaccaagactaacaaacttacccaaaaggaaacccaccgtacttagtttacctaactaaagacgtaaacgacgtccgaagaacgacgccgtaagacgaccggtaccggtaccgtaagttacctttacggcgttacggaacggaacggtacggacgggtacccggggaacctaaaaccgtaaccgttaaccgaacgtaacgtacggtaccggacggttacggaccggggaaacccgaaaccgggtaccg

SEQ ID NO: 382744 - DNA, 646 bp, Homo sapiens
  misc_feature: GZ8MTXP02I23CY.13.76.G10.1.454.CMB.2.raw
  modified_base (232)..(232): a, c, t, g, unknown or other
  modified_base (277)..(277): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggctgatccagccgtgggggtcccngagactcctctgtgcagcctcgtggtcaccgtcagtcacacctanatgacgtcgtacggtccgccaggcctacggaggggaggcgtggacgtgcgttcttctttattcgtagtacgtaggtacgtacactacctcgacgtacgtccgtaccggtgggacggggtccagttacccaccgtactacttcccgaaagcgtaaactaaacgttacccaaagtaaaccgtaccgttcctttagttttcctaaaccagtaacgtaaaccgacgtccgtaagagtacgcgaactccgagtacccgggtctagttattacgtgttacgacggtagtacgggtcggaaccccgaagttacccgtaacgtccgtacaacggttacggacgtacggtcggggaccgaacggttacccggacccgg

SEQ ID NO: 382745 - DNA, 616 bp, Homo sapiens
  misc_feature: GZ8MTXP02HLMH3.13.76.G10.1.454.CMB.2.raw
  modified_base (200)..(200): a, c, t, g, unknown or other
  modified_base (246)..(246): a, c, t, g, unknown or other
  modified_base (261)..(261): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagtttttggctgagcgtggtttcgtgtaggctatttaaaagtgccagtgtgagtgcagctggtggagtctggnggagtcttgatccgagccgtgggggccctagagctctcctgtcgcncgctgtgtcgactcncgcacactacagtgacgcgtcggtccgccgacgcgtacggacgggacggtcgtaggtgtgtcgttctttactttagttagtagtagtagtacgtaccgtactacgtcgtcgacgtacgtacggtcggtacggtactactacctactactctacgacgaacgtactaactaacgtaacgtaaccgtacgttacgttacgttacgttaacgtaacgtaacgacgtacgtacgtacgacgtacgacgacgtacgacgacgtacgtacgtacgtacgtgtacgtacgtagagtacggtacggtaccgtacgtacgtacgtacgtaacgtacgtacgacggtacgacggacggacgaccg

SEQ ID NO: 382746 - DNA, 739 bp, Homo sapiens
  misc_feature: GZ8MTXP02H0F5R.13.76.G10.1.454.CMB.2.raw
  modified_base (275)..(275): a, c, t, g, unknown or other
  modified_base (633)..(633): a, c, t, g, unknown or other
  modified_base (700)..(700): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggtagttttggctgagcttgggttttccttgttgtcttaattttaaaaggtgcccagtgtgaggtgcagcgtggtggagtcgtgggagggaggtcttgactccgacggccggttcgggggtccctggacgtaccttcctccgtgtcgacncgtcctcgtcggttccaccgtctacgtccacctacctacagtgacgtcgtcgggtccgccgacggccgtacgggaggggaggggcgtggagtcgtcgtttctttagtttttatttagtacggttaggtggttaacgtacctactaccgtccgactaacgtccggttacggtcggggaccggggtacctaccgttacccaaccgtactacctaccggaaataaagtaaacccctaaagttacccgaaaagtaaacccgtccttcgttttacgtttacaaaccgtaaagtacggaaaacttcggacccgtaaggtacggaaccccgtccggaaaccgtacccgtacggtacccggtttanaacgtttcgacggtgaacgtaggacgtagggtcccggtaaacgaccgtttaaacgtactaccgtagngtcggaacgtcgggtacggccggttaaacgcggtacccg

SEQ ID NO: 382747 - DNA, 758 bp, Homo sapiens
  misc_feature: GZ8MTXP02G273Z.13.76.G10.1.454.CMB.2.raw
  modified_base (243)..(243): a, c, t, g, unknown or other
  modified_base (275)..(275): a, c, t, g, unknown or other
  modified_base (316)..(316): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgccagtgtgaggtgcagcgtggtggagtcgtggaggagtcttgatccagccgtggggtcctgagactctctgngcacgcctgtggtcaccgtcagtcacaccacntgacgcgtcggtcgcaggcctccggaggggacggcgtaggngtcggtacttccgtttattttagttagttaagtaggtaggttaactaacgtacttaaccgccgacgaacggtaccgttacggtcggggaaaccgggggtccctaagtttacccgaaccctagtcccgtaaccgaaacggtacgtaaacctaaaacttaacccggaaaactaaaacccgtacgttcccggtttactttaacccggtttaaaacaaaacgttacgaaaccgtacgtaccgtaaggaacgacgaccgtaatacggaccgtaccgggttacgttagttaacgttacgtacgggtacgaacgggtaacggaacggtacccgggtaacccggggtaaaccctaaaccgggttaaaccgttaaccgtaaccggtaacgttacggaccggggtttaaccggtacggggaacccgggtaacccggaaaccgggtaccccgg

SEQ ID NO: 382748 - DNA, 682 bp, Homo sapiens
  misc_feature: GZ8MTXP02I522N.13.76.G10.1.454.CMB.2.raw
  modified_base (528)..(528): a, c, t, g, unknown or other
  modified_base (557)..(557): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggtcttgactccgaggccggtcggggggtccctagacgtactctccgtggtcgcgacgtcccgttcgttcggggttccaccgtctacgtccaccacctacagtagacgtccgtcggtcccgcatcgccgtaccggaaggggacgggcgtaggacgttcggtcgtttccttttatttttagttaagttaggttacggttaggtacgtaactacttaccgttccccgactcggtaacccgttcccgggtaggaccgggggtccctaatttcccaaccgtactccgtaaccgagtaacactaacttaccaaaggtacncgttcttatttctaacaaattcgaaaccncgcagacgacgagtacgacgaccgtcggtacgtagttatcgtggacgacgaaggtacggtaccgggacccggaacctaaacgtaaccgttacgacgtacgtaggtaccgggtcgtacggggacgg

SEQ ID NO: 382749 - DNA, 734 bp, Homo sapiens
  misc_feature: GZ8MTXP02H99GJ.13.76.G10.1.454.CMB.2.raw
  modified_base (390)..(390): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttttaaaaggtgcccagtgtgaggtgcagctgggtggagtcgtggagaggcttgatccagccgtgggggtccctgagactctcctgtcgcagtcctcgtgggttccaccgtcagtccacacctacatgacgcgtcgggtccaccgaggcctccggaggggaaggggctgggagtggtccgttctttactttttaattagtagttaggtaggtatacctattacctccgnagtacctccggtggacgggggctactttaccaacctacgtacctacccgaagtacgtaaacctaacttacccgaaaaggtaaaccctacgttaccgtttacggtttttaacccttaacaaaaacgttacggaaaaccccgttggaccccgttaggaaacggtaaccggacccgtaagtacggaaccggtaaccggggtccgttagtttaacgttacgtcggtacggccggtaaaagcggtaaacggttccggggaacccctaaaacgggtacgttttaacccgaacggttctaacggtcgggaacccggtttcgaccgggggtaacccaaacgggggtaccccc

SEQ ID NO: 382750 - DNA, 736 bp, Homo sapiens
  misc_feature: GZ8MTXP02FPN73.13.76.G10.1.454.CMB.2.raw
  modified_base (255)..(255): a, c, t, g, unknown or other
  modified_base (273)..(273): a, c, t, g, unknown or other
  modified_base (630)..(630): a, c, t, g, unknown or other
  modified_base (692)..(692): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttccnccgtcagtcacacctacntgagcgtggaccgccgaggcctccggaggggtaaggggccgtgggtagtcggtacgttaccgtttacttttttaacgtttaagttaggttaagggtttcggttaaacggtaaccgtaaacgtttacctacccccggtacaaccggttaaccggtccccggttaggggaccggggtaccggtactttccccgaaaccgttacctaccgttaccccgaaagtaccggaaacctaaacctttacccgaaaacgtaaccgtaaacccgtgttttcggttactaacgtaaataccgaaacgacgtacctaaggacgacgacccgttgaaccgaccggacgtcgttagtagttaccgttaggngacgaggacgtacggtacgggaccctaacggtaacgtttacacccggtactaggtaccgggngtcccggtacggggaccgaacgggtaccgaccggtcgtaccccg

SEQ ID NO: 382751 - DNA, 649 bp, Homo sapiens
  misc_feature: GZ8MTXP02HWWLH.13.76.G10.1.454.CMB.2.raw
  modified_base (304)..(304): a, c, t, g, unknown or other
  modified_base (510)..(510): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaggtgccagtgtgaggtgcagctggtggagtcgtggaggaggtcttgactccgaggccgtcggggggtcctgagactctcctgtgcagcctcgtcggttccaccgtcacgtcactacctacatgagcgtcgggtccncgaggcctaccggaggggaggcgtggaggtgtccgttctttctttttaatagttaaggttaggtacggtatacctagtaccctccgacacggtaccgtcggtcgggacggggacctacgttaccaccccgtatccctaccgagtaaccaactaaacttaccgaaacgtaccaacgtcttacgtttactaaacctaatacgaaaccncgacctaggacgacgtacccgagtacggaccgaccggtccgttagtacttacgtggcgacgaggtacgacggtccggggacccaaacggtaaccttacgacgtcgtaggtcggtacgtcgggacggccgaaacggaccg

SEQ ID NO: 382752 - DNA, 632 bp, Homo sapiens
  misc_feature: GZ8MTXP02G9457.13.76.G10.1.454.CMB.2.raw
  modified_base (291)..(291): a, c, t, g, unknown or other
  modified_base (397)..(397): a, c, t, g, unknown or other
  modified_base (440)..(440): a, c, t, g, unknown or other
  modified_base (458)..(458): a, c, t, g, unknown or other
  modified_base (495)..(495): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttggatccaggccgttcggggggtccctggacgacgtctcctgtcgcagcctcgtgggttcaccgtcagtcacacctanctgagcgtcggtccaccgaggcctccggaggggaacgggcgtggagtcgcgttcttcgtttttattagtagtagtggttagacctatacctcgacagctcggtggnggggcctattccacatctcccagacgacctagtaccaagaacncgtcttagtttccctaanaaactggaaacacgtcctaggagaaccgtcccggaanccggaaactccgggagttacggtattaccgtgcgaggtacgaacggtggtacccgggaccccgaacgtaaacggttacctaccggaagtaacgtcggaacggttccggtacggggacccgtaaaacgggggtccccg

SEQ ID NO: 382753 - DNA, 647 bp, Homo sapiens
  misc_feature: GZ8MTXP02F3SWN.13.76.G10.1.454.CMB.2.raw
  modified_base (603)..(603): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtcgggggtccctgacgtactctcctgtgcagcctcgtcgggttcaccgtcagtcacacctacatagagtccgtcgggtccgccgagggccctacggaaggggaacggggcgtagggaggtcggtcgttcgtttacgtttttattagttagtagttggtagtacactaccgtcgacgacgtcgtccgtaggacggggcctattccacatcctacaggacaactatacccgaaatacctagtcttctttacaacaaaagttcgaaaccacgtccgtaggaaggacgtaccgagtacggactacccgggtgttagttaaatcggtagtcgacggtaggaaacgtcgggtaccgggggacccctaaggtaccggtttaanacccgtagttaacgggcgtaccggttacggaccggggaaaccgg

SEQ ID NO: 382754 - DNA, 622 bp, Homo sapiens
  misc_feature: GZ8MTXP02GGS8I.13.76.G10.1.454.CMB.2.raw
  modified_base (276)..(276): a, c, t, g, unknown or other
  modified_base (283)..(283): a, c, t, g, unknown or other
  modified_base (287)..(287): a, c, t, g, unknown or other
  modified_base (299)..(299): a, c, t, g, unknown or other
  modified_base (369)..(369): a, c, t, g, unknown or other
  modified_base (391)..(391): a, c, t, g, unknown or other
  modified_base (408)..(408): a, c, t, g, unknown or other
  modified_base (549)..(549): a, c, t, g, unknown or other
  modified_base (595)..(595): a, c, t, g, unknown or other
tcagtcacgtactacacgaccggtgctcgatttagtcactcatacagggggtctggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtgggaggaggcttgatccagccgtggggggtccctgagactctcctgtgcacgcctgtgggttcacgtnagtcacnctantgagctggtccncgaggctccgagggagggctggagtgactcgtttatttattagtagtgtgtagtacacgtactccgacgntaccgtcgtggacggggtaccngttaccacgacttaccncgaacgacgtacaaacgttaccgaaagtaaccaacgttcccttaggtttacctaataaacgtagaaccgtaacgcgtacggaaggacgtcccggaaagtcgaccgtaacggcttagtaaccttgtgtcggaggaggtacgnggtacccgggacctacggtaaaccgtaagtaaccgtcgttaacggnggtaccttcgggggacgaaaccccggg

SEQ ID NO: 382755 - DNA, 729 bp, Homo sapiens
  misc_feature: GZ8MTXP02I4VZY.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggtagttttggctgagtcttgggttttccttgttgcttaattttaaaaggtgccagtgtgaggtgcagcgtggtggagtcgtggaggaggtcttgatccgaggtccggtcgggggtccctggacgtacctctccgtgtcgcacgtccgtcgtcggtccaccgtcacgtccacctaacctacatgacgtcgtacgggtccgccgaaggccgtacgggaggggaacgggcgtaggagtcgtcgttctttactttattagtagtaggtagtactacctataccgtcgactacgaccgtcggtgggacgggtctacgtcactactctaccgaagaccgtaaactaacgtacgaaaagaaccctacgttctttacgttttactaaacaaaagtctaaaaccggtgcccgttaaggacggaacctacgggaactaacgggaccgtaccggggttcgttaaagtttacccttacggtggacccgaagggtacgggaaggaacccggtacccgggggtaaacccctaaacggtttaaaacgttcgtaaacccggtgttacggaaccgggggttccgtacccggggacgggaaccccgtaaacggggaccccg

SEQ ID NO: 382756 - DNA, 750 bp, Homo sapiens
  misc_feature: GZ8MTXP02JH8JP.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtcctgagactctcctgtcgcagtcctgtcgggttcaccgtcagtccacacctacatgagcgtcgggtccgccaggcctccggaaggggtaggggctggagtgccgttctttcttttattagtagttagtggtaatacatacctccgactacgaccttccggtggggacggggtctaacttccaaccgttatacccttccgaaagtacgaaacctaaacgttacccgaaaacgtaaacccgaacgtcctttaacggttttcctaactaaaacgttacgaaaaccgacgtaacccgttagaaaggtaccgacccggtaaagtacggaccgtaacccgggtacgtttacgttaacgttttaccgtacgggttagtaaccggagggtaacggtaacggtacccgggggaacccctaaaaccgggttaaaccggtttaaaccgaccggttaaccgtaacggttacggggtacccggttaccggggttaccgggggtaaaccccggtaaaacgggggtaaacccccgg

SEQ ID NO: 382757 - DNA, 750 bp, Homo sapiens
  misc_feature: GZ8MTXP02IYEDE.13.76.G10.1.454.CMB.2.raw
  modified_base (238)..(238): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggactccgtgcctcctatgagctgactcacgcccacctcgagttcgtccgtcgtccccaggacagacacgccagcactccacctgctcgtaggaaaattagtcganagaataatcttactcgtagtactcgagacagaacgtcaggcctacgtccccgtgtcgtcgtacggtacagtactatacgagtatccgaccgacgcccggtcctcgggaacggtcctacccccgtgacgtcgtacttcgtaccgttcgaccttaccacgttcggtaccgactccgaccgtacctaccgttccacgacccgacgtacggacccggacccggacccggaggtaccgttagggacggaacgtacggggtaccgttacgttaaacccggtttattaaaccgtttacggtccgggtaccggttagggggccggttaacggggaacgaccgggaaccgtacggggaccctaacccggggtccggttaaacccggttacgtttaccggttccggtttaacccggggttaacggtaaccccgggttaaccggggtaaacccgtaccggtttaacccccgtaaccggtttaaccgtaaacccgtaccccggaaacccgggtaaaaccccccg

SEQ ID NO: 382758 - DNA, 727 bp, Homo sapiens
  misc_feature: GZ8MTXP02HMLYO.13.76.G10.1.454.CMB.2.raw
  modified_base (499)..(499): a, c, t, g, unknown or other
tcagtcacgtactacacgaccggtgctcgatttagtcactcatacgagggggggagaggagcccagcactgggattccgaggtatttccattcggtgatcagcactgaacacagaggactcaccatggagttttggctgagcttgggttttccttattactattttaaaaggtgtccagtgtgaggtgcagttggtggagtcgtggaggaggtcttgggtccgaggccgggggggtccctggagactctcatgtgcggcctcgtgggctcaccgtcaacaccaaactacatcgagcgtgggtcccgccaggcctccgaaggggaagacgggccgggagtgggtctacgtagtttacttagtgtacgacgggttcgacctactattcgacccgtacgagtaccgttccggtagggaccgggggtcccgtttaccacctaacgtccttaccgaagacgtaactaaacgtccgaaaagaaccgtacggtatacttccgtaanaaactacgaacgtaccgtagagtacggacggaaggaaccgtccggggtacctaccttaacttacgttaggtacgacgtaaaaggagcgacgaaggacgggaacccgggtacccccgttaaagggtcgggggtcccgttagggggttacgggttaaccgggtttcctttaacggtttacgacggttcgggtaccggttaccgggggacggtaaccggggttaacccccg

SEQ ID NO: 382759 - DNA, 705 bp, Homo sapiens
  misc_feature: GZ8MTXP02IQ5DD.13.76.G10.1.454.CMB.2.raw
tcagtcacgtactacacgaccggtgctcgatttagtcactcatacaggggggggagaggagcccagcactgggattccgaggtgtttccattcggtgatcagcactgaacacagaggactaaccatggagttttggctgagctgggttttccttgttgctattttaaaggtgcccagtgtgaggtgcagctggtggagtcgtgggaggaggcttgatccgaggccggtcgggggtccctgagacctctcctgtgcacgtcctcgtcggttccaccgtcacgtacacacctacatgacgtcgtcgggtcccgccgaggccgtccggaagggggaacgggtcgtagggagtggtcgttctttactttttagttataggtaggttggtaagtactactaccgtccgactacgtaccgttccggagggcgggggtacctacttccgacctcgtccctacgagactaactaccttaccgaaacaccgtactacgtttccgtttacctacaaaacgtcgaaaacacgtaccgtagacgtacggaccgagtaccgaccggtaccggtccggttagttaacgttcgtaggcggtacggaacggtaggtaccggggtccggggaaccctaaaccgggttaaccgttaccgtacgtacgtaacggtacgggtaccggttcgggacgggtacccggaaccgggtaccgtaccccgg

SEQ ID NO: 382760 - DNA, 722 bp, Homo sapiens
  misc_feature: GZ8MTXP02GPFHM.13.76.G10.1.454.CMB.2.raw
  modified_base (489)..(489): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtggggggtccctggagactctcctgtgcagcctcgtggtcacgtcagtcacacctacatgacgcgtcgggtcccgccgaggcctaccggaaggggacggggtcgtgggagtcggtccggttcctttactttttaagtttagtaggttaggtacggttacgtaacctaactaccgtcccgacgtacgtaccgttccggtgggacgggggtacctatttaccaccgtactcctacccgaagagtaacctaatacccgaaagtaaacncgtacttagtttacctacaaaattcggaaacacggtctaggggaactcgacccggtatacgaaccgtacggtccgttagttaaactccgtagtcggacggaggtaccggaacgggttacccgggggaacccctaaacgggtaaacccgttttacgaaccccgtaaggtttaccggtacggggtaacccggttccgggtaaccgggggaccgaaaaccgggggttaacccccgg

SEQ ID NO: 382761 - DNA, 737 bp, Homo sapiens
  misc_feature: GZ8MTXP02FZGD2.13.76.G10.1.454.CMB.2.raw
tcagtcacgtactacacgaccggtgctcgatttagtcactcatacaggggggggaggaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtggaggaggcttggatccgagtccgtggggggtccctgacgactctcctgtgcagcctcgtgggtcacgtcagtcacacctacagtgagcgtcgggtcccacgacgggcctccgggagggggaacggggtcgtaggggagtcggtccgttacttactttttagtttagtagtaggtcggttaacgtacctattaccgccgacacggtacctccgggtaggggaccgggggtaccctattacccaaccctacgttcccaccaaagggtaactaaaccaacttaaccgaaaggtaaaccctaccggtcctttagtttaacccttacaaaacgttacggaaacctccggaaccttggggaaacggtaccgacccgggttaaacgaccggaaccggtaccgggtacggtttagtacgttacggtggaacggtacggaacggtacggtacggtaccggggaaaccctaacggttaaaccgtacgtacgtaacgtacggtacgggtaccggtcgggtaaccggggaaccgtacgggacccg

SEQ ID NO: 382762 - DNA, 848 bp, Homo sapiens
  misc_feature: GZ8MTXP02FUNFL.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagcgtggtggagtcgtggaggaggtcttgatccgagccgtgggggtcctgagactctcctgtgcagcctcgtggtccaccgtcagtcaccacctacatgagtcgtacgggtccccaccgacggcctccggaaggggaacggggtcgttagggacggttcggtcggtttacctttacgttttttaagtttaacgttaacggttaagggttagggttaacgttaaccccgtaagtttaccccgtaccggacgtaacggtaaccgttccccgggtggggtaaccgggggtacccggttaacgtttacccccgaaccctaacgtttccccgtacccgaaaggtaaaccgtaaaccctaaacgtttaacccccgaaaaggtaaacccgtaacccggtaccttttacggtttttaaccccttaaacgtaaaacgttaccggaaaaacctacgggtaacccttagggaaaccgtaccggtaccccggtaagttaaccggaccggtaacccgggtaccccgtttaaggtaacctttaccgtagggtacggtaacggagggtaaacggtaccgggttacccgggggaaccctaaaccggggtaaaacctttcggtaacccgaagttacggtacggtacggtccggtacggggaccgtaaacgggacccg

SEQ ID NO: 382763 - DNA, 815 bp, Homo sapiens
  misc_feature: GZ8MTXP02GU47Q.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggcttgactccgaggcccggttcggggggtccctggacgtacctcttccgtgtcgcagtccgtcgttcgggttccacccgtcagtccacaacctacagtgacgccgtcgggtcccgccgtacgggcctaccgggaaggggaacggggtcgtaggacggtcggtccgtttcctttactttttaattttaagtaaggttacggttagggtaacttaaccctaactaccgtcccggactaggtaacccgttccgggtgggaccgggggccctaatttcccaacccgtattcccgtacccgaaaggaaaccgtaaactaaaaccgtttacccaaaaggtaaacccgtaccgttcgttttacgtttttaacgtaaccctaaaaagtccgaaaaccgtacgccccgttaagggaacgacgggtacccgaaaggttaccgtaacccggaccggggttccgtttaaagtgtttaacccggaggtaccggcggtaaaaggggacgtacggggttaaccccggggaccctaaaacgggttaaaccgttaacgttaccggaaccgtttacggacgggttacggccggtacgggggaacccgaaacgggaccccg

SEQ ID NO: 382764 - DNA, 616 bp, Homo sapiens
  misc_feature: GZ8MTXP02JVJWJ.13.76.G10.1.454.CMB.2.raw
  modified_base (369)..(369): a, c, t, g, unknown or other
  modified_base (385)..(385): a, c, t, g, unknown or other
  modified_base (441)..(441): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcgggtccgccgaggctccgagggaggggctggagtgcgtctcttttattatagtagtggtataccatactcgcagctccgngaggggcctatccacntcctcaagacgaaacacttccaaagaacacgtcttgtttctacaaagtgtaaaccngaccctgaagacgacccggtatacggaaccgacggggtccctttagtaaccgtttacgtggtacgacgggaagtaggaaacggttccgggggaccccaaacggtaacgtttaaccgacggtaaccgtaaagttcggggaaccgttcggaccgggggtaccaaacggggaccccgg

SEQ ID NO: 382765 - DNA, 616 bp, Homo sapiens
  misc_feature: GZ8MTXP02GC2NG.13.76.G10.1.454.CMB.2.raw
  modified_base (472)..(472): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccggtcagtcacaccctacatcgagcgtgggtcccgccagggcctccgaggggaaggggctgggagtgcgtcttactttttattatagttggtaggtagtacattacctccgtacagacctccggtgacgggggccctagttccacctatcctaccaggaacacaattacccaaaagaccacgtcttcgtttactactaaatgaaaccncgtcgtaggaacgacgaccgtagacgaccgacggtacgttagtaacgttcgtcggtaggacggagacggtacggtaccgggaacccgtaacgtaaaccgttaacgtacgtacgtacggtcggtacggtaccggtacggggaccg

SEQ ID NO: 382766 - DNA, 644 bp, Homo sapiens
  misc_feature: GZ8MTXP02HS9IP.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctcgtgggttcaccgtcagtcacacctacatgagcgtcgggtccgccaggctccgagggaggggctggagtgcgtcttcttttattagtagttagtggtagtaccatactccgcagtacctcgtgggacggggccattccaccgactctacccagtaacgactaacttacccgaaagaaacccacggtaccttggtttaccttacctaaaagttcgaaaaccgtagcccttagggaacgaacggaccccggtaagacggaaccgaccgggtaccgttagtaaacctttagtacgttggaacgtaggagacgttcgggggacccaacggtaacgttaacgtacgtccgttaagtcgggtacggtcggtaccggggacgtaaacgggtaacccgg

SEQ ID NO: 382767 - DNA, 814 bp, Homo sapiens
  misc_feature: GZ8MTXP02GFZWB.13.76.G10.1.454.CMB.2.raw
  modified_base (270)..(270): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgacgactctcctgtgcagcctcgtcgggtcaccgtcngtcacacctacatgacgcgtcgggtcccgccaggcctccgggaaggggaacggggcgtaggggagtcggccgttctttcgtttttaatttagtagtaggtggtagtacccatactccgacacggtacctccgggtgggacgggggcccgtacgttaccacccgtattccgtaccgaaacgtagaaaccctaagttaaccccgaaaaggaaccctaacggtccgttttacgtttaccgtttaacaaaacgttacgaaaaccgtcggtaccgtaagggaccggtaaacggtacccggtaagttaaccgggacccggtaaccggggttcccggtttaagttaaacccgttcgggttaggggtacggaccggggtaaaaggtaggggtacccgggggttaacccgggggaacccccttaaaaaccggggttaacccgtttaaccggtaaacccggtaacccgtttaaagggttaccgggggtaaccccgggtttaccggggttaccggggggaaaacccccggtaaaacgggggttaaacccccccgg

SEQ ID NO: 382768 - DNA, 657 bp, Homo sapiens
  misc_feature: GZ8MTXP02FQR30.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaatttaaaaggtgccagtgtgaggtgcagcgtggtggagtcgtggaggaggcttgatccaggccggtcgggggtccctgacgacctccgtcctgtcgcacgtcctcgtcggtccaccgtcacgtccaccgacctacatgacgtcgtcgggcccgcgacggcctaccggaagggacggcgtggtagtcgtcgttctttcttttagttagtagtagtagtagtacctactacgtccgacgtacgtaccgtcggtgggaccgggctactccgacctacgtcctacgaagactaaacctaacgttacccaaagtaacctacgtctttacgttacttaaacaaaagttcgaaaacgcgaccctagggaacgaccgaccggtagtaaccgaccgtacgggtacgttaagtcgttacgtggtacgagtaggacgtggtacccgggacctaaacggtaacctcgagtcgtaggcggtacgtcggacggaaccgacggtaacccg

SEQ ID NO: 382769 - DNA, 708 bp, Homo sapiens
  misc_feature: GZ8MTXP02JVHSU.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggaggaggcttgatccagccgtgggggtccctgagactctcctgtgcacgcctcgtcgggtcaccggtcagtccacacctacatgacgcgtcggtcccgccgaggcctccggaaggggaacggggcgtagggacgtgccggtttctttacgtttttaatttagtaaggttagttacggtaagtacacttaccgtaccggacgaacgtccgttccgggacgggtaccggggtccgtacttaccgacctactccctaccgaagtaaccgaactaacgttacccaaagtaaccctacgtccttttacgtttacttactaaaagcgaaacgtcgacgtagaacgtcgaccgtaacgcgaacggtaccggccgtttagttaacttacggttaggaccggaacgggaggaacggtacggttacccggggaacccgttaaaccggtaaacgtttaacccggtcggaccgttaacggccgggttacggttccgggaacggggtaaaccccgggg

SEQ ID NO: 382770 - DNA, 645 bp, Homo sapiens
  misc_feature: GZ8MTXP02GSKNV.13.76.G10.1.454.CMB.2.raw
  modified_base (233)..(233): a, c, t, g, unknown or other
  modified_base (248)..(248): a, c, t, g, unknown or other
  modified_base (280)..(280): a, c, t, g, unknown or other
  modified_base (390)..(390): a, c, t, g, unknown or other
  modified_base (560)..(560): a, c, t, g, unknown or other
  modified_base (621)..(621): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgccagtgtgaggtgcagctggtggagtctgggaggaggcttgatccagccgtggggggtcccngacgactctcctgtncagcctgtgggttcaccgtcagtcacacctanatgagcgtcggtccgccgaggcctccgggaaggggaacggggtcgtaggagtcggtcgttcttacgtttttaattagtagtaggtgggtactacctactaccgtacccgntacgtaccgttcggtgggaccggggcctagttccactactctacccgaaggactaacctaattacccgaaagtaaaccgcgtcgtttagtttaccctaagaaattcgaaaaccgcgtaccgtagacgacggtaccgagtaccggaaacgccggttcgtagttacttacgnggtcgacgaggtagacggtcggaaccctacgtaacgtcgtacggaatacggtcggtaccgnggtccggggaacaaacggggtccc

SEQ ID NO: 382771 - DNA, 826 bp, Homo sapiens
  misc_feature: GZ8MTXP02FRYKG.13.76.G10.1.454.CMB.2.raw
  modified_base (293)..(293): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggtcttgactccgagccgtggggggtccctgagtactctcctgtgcacgtcctcgtgggttccaccgtcacgtcacacctacntgagtcgtcggtccgccgacgggtccgaccggaagggggaacggggtccgtagggtagtcggtccgtttacgttttacctttttaagtttagttaaggttaggttagggttaaaccgtactacgttaacccgttcccggaccgtaacggtacccgttcccggggtaggggtaaccggggggtaccctaagtttaccccgaacccgtacgtttacctacccgaaaggaaccgtaaacttaaaccgttacccgaaaacggaaccctaaacggttcctttacggtttaccttaaaccgtaaaacgttacgaaaacctacggggtcccgttaagggaacgggtaccgaccccgtaagttaccggtaacccggaaacccgggtccggttaagttaaacgtttcggtaccggttaggacccgggaaaggtaaacggtaccgggttaaccggggaacccccgtaaaggttaaaacccggttaacgtaccggtaacgtacggtacgggtacccgggtacggttaccgggggaaaacccggg

SEQ ID NO: 382772 - DNA, 926 bp, Homo sapiens
  misc_feature: GZ8MTXP02JZ9OR.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggtcttgactccgacggccggtcgggggtccctggacgtactcctccgtgtcgctacgtcctcgtcggtccaccgtcacgtacacctacctacatgacgtcgtcgggtcccgccgacggtccgtccgggaaggggacgggtcgtagggtacggtcggtacctttacgtttactttttagttaacgttaaggttacggttagggttaactaccccgtaacgttacccgtaccggtaccgtaacggtacccggttcggggtaccgggggtaaccggggggtaccccttaacgttacccgtaaccccgtacgttaccctaaccccggtaaagtaaaccgttaaacccgtaaaacgttaaccccgaaaaaccgtaacccgttaccggttaccttttacggtttttaaacccttaaaacgtaaaaacctttccgggtaaaaacccgaccggtttaacccgaacggggtacggtaaacccgggacccggttaacgttaacccgggaaacccgggtaaccggttcccggtttaacgttaacccgtttagggtacgggttacggaaccggggttaaaacggacgggtaacccgggggttacccgggtaaacccccgttaaaacgggttaaccccgttaaacggttaccggtaacgttaaaccgggtacgggttaaccggtcggggtaacccgggggaaaccgtaaaccggggtaacccccgg

SEQ ID NO: 382773 - DNA, 721 bp, Homo sapiens
  misc_feature: GZ8MTXP02H77UL.13.76.G10.1.454.CMB.2.raw
  modified_base (574)..(574): a, c, t, g, unknown or other
  modified_base (587)..(587): a, c, t, g, unknown or other
  modified_base (603)..(603): a, c, t, g, unknown or other
  modified_base (622)..(622): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagcgtggtggagtcgtgggagggaggtcttgactccaggcccggtcggggggtccctggacgtacctccttcccgtgtcgcacgtcccttcggttcggggttcctacccggtcacgtaccacctacctacagtgacgtccgtcgggtcccgccgacggtccgtaccggaagggggacggggcgtagggacggtcgtccgtttcctttactttttacgtttaagttaaggttaggttacggttaagttaccctacttaccgtccgtacgaacgtacccgttccgggtggggtaccggggacccgtacttaccacctatacctccgaaagactaaactaacttacccgaaaagaccctacgtcgtttattttacaaacatacgaaacncggtactaggganacgacgagtcggaccncgggttctagttcttacgngtcggtacgaggacgtacgggtccggaaaccctacgtaacgttaccctaagccgtaacgtacggtaccgtcggggccgggaaccggtaacggtccccgg

SEQ ID NO: 382774 - DNA, 840 bp, Homo sapiens
  misc_feature: GZ8MTXP02FJ5NH.13.76.G10.1.454.CMB.2.raw
  modified_base (317)..(317): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggtagttttggctgagcgttgggttttccttgttgctattttaaaaggtgcccagtgtgaggtgcagcgtggtggagtcgtgggaggaggtcttgatccgaggtccggtacggggggtccctggacgcctccttccgtgtacgcacgtcccttcgttcggggttacccaccggtcacgtaccaccaaccctanatcggacgtcgttcgggcccgcgacggtaccgtccgggaaggggtaaggggcttgggagttcgtccgtttctttacttttaagtttagtagttaggtaggtagtaccctacgttacctccgactacgtaccggttcgggtgggaccggggtcctacgttacccgaacctagttcccgacgaaagaccgtaaacctaaacgttaccgaaaacgtaaacccgtccgtacgttttacggttttaacctttaacgaaaaacgttccggaaaaaccgtccggtaacccgttagggaacgtaccggtaaaccgggtacgacccgggtaaaccgtacccgggggttaccggttaaggtttaaaccgtttacgggtcgggaagttacccgggaaaggtacggttaaaccgggcccgggggtaaaacccccttaacgggttaaaacccgttacccgtaaccggttaacgtacggttaacggggtacccggttacggggaacccgggaaacccggggaacggtaaacccccgg

SEQ ID NO: 382775 - DNA, 674 bp, Homo sapiens
  misc_feature: GZ8MTXP02GMBXS.13.76.G10.1.454.CMB.2.raw
  modified_base (294)..(294): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggagcttgatccagccgtgggggtccctgagactctctgtgcagcctcgtggttcaccgtcagtcacacctacagtgagcgtcgggtccnccgaggtcctccggaaggggacggggcgtaggagtcggtcgtttcgtttactttttagtttaagttaggttagtttacgttaacgttacctacgttaccgtccgacgtacggtaccgtccgggttggggaccggggtccgtacgtttaccgaccgtactcctacccgaagacgtaaacctaacttaccgaaagtaaccgtacgttacgtttgtttacctaacaaacgttcgaaaacgctaccgtaggaacgtacgaccgtatcgaacgacggtcgttagtattacgcgtagacggacgtaggaccgtaccggggaccaacggttaaccgttacgacgaacgttacgacggtacggtcggacggggacctaacgggacccg

SEQ ID NO: 382776 - DNA, 627 bp, Homo sapiens
  misc_feature: GZ8MTXP02GHNRO.13.76.G10.1.454.CMB.2.raw
  modified_base (277)..(277): a, c, t, g, unknown or other
  modified_base (291)..(291): a, c, t, g, unknown or other
tcagtcacgtactacacgaccggtgctcgatttagtcactcatacaggggggggagaggagcccagcactgggattccgaggtgtttccattcggtgatcagcactgaacacagaggactcaccatggagttttggctgagcgtggtttctgttagctatttaaaaggtgccagtgtgaggtgcagctggtggagtctggaggaggcttgatccagcctggggggtccctgagactctcctgtgcagcctctggggttcaccgtcagtcacacctanatgagcgtcggccncgacggccgtcggagggaggcgtggagtgtcttctttacttttattatagtagtgtatactatctcgcacgtaccgtcgggtggggacggtctactaccactactccacgagaactactaacgtaacaaagtacgtactgtttacttactaacaaacgtacgaacgtacgtcgtaggacgtacgaacgagacgaccgtaccggtagttaagttactagtcgacgacggagtaacgggtaccgggtacccgggaaacccgtaacgtaaccgttaccgtaacgtaacgtacggtacgggtaccgtacggggtaccgggaacccggtaaccgggaaccg

SEQ ID NO: 382777 - DNA, 671 bp, Homo sapiens
  misc_feature: GZ8MTXP02GWXSZ.13.76.G10.1.454.CMB.2.raw
  modified_base (237)..(237): a, c, t, g, unknown or other
  modified_base (297)..(297): a, c, t, g, unknown or other
  modified_base (315)..(315): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccgatctcctgcacgtgggancagctccaaacattggggcaccgattaatcgatgtacactggtaccagtcagttccaggngcaggtcccagactccanatcgaaatacgtaaacaacaactccggacccgacgtacggggtcccctgaacccgtactttaccgtccgttacgggccttacccgacggttcgtacggtaccacccgtacacgtcccgtccccgtggtaccctaacgtcctaacgtcgggtaacctcccgtacgggtaccctagggaacgggtacgtaggacgggaccttacggtagtttaactttaccgtcgtacccgtacggttaccccttaagtcggttaaaccgaacggtaccaacggtcccggttaggtaaccggtcggtacccgttttacggggttaccggttaccgggggttacccggggggggaacccctaaccgggg

SEQ ID NO: 382778 - DNA, 817 bp, Homo sapiens
  misc_feature: GZ8MTXP02JI1NG.13.76.G10.1.454.CMB.2.raw
  modified_base (289)..(289): a, c, t, g, unknown or other
  modified_base (307)..(307): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgactccaggccgtcgggggtccctgagactctcctgtgcagtcctgtcgggtccaccgtcacgtcacacctacngtcgagccgtcgggtccnccgaggcctacggaggggaacggggtcgtagggtaggtcgtccgttctttacgtttttagtttactaggttaggttaggttaatacccgtataccgtccgacgacggtaaccgtccggtggggtaccggggtacccggtacttacccgaaccctacgttccctacccgaaacggtaacgaaacccttaaaacgttaccccgaaaaggaacccgtaaccggtacccttttacggtttacccttaaacgaaaaacgttaccgaaacccgagtacccgtaagggaaacgacggaacccggtaataccgggaacccgacccggggtccgtttaggttaaagttacccgttgggaccggtagggtaaacggaaggtaccggggtaccgggggttaacccccaaaagggggtttaaaccccctttaacggaacccggttcgttaaaacgggtccgggtaaaacccggggttgggtaaacccccgggggaccggtaaaacccggggggtaacccccg

SEQ ID NO: 382779 - DNA, 623 bp, Homo sapiens
  misc_feature: GZ8MTXP02JUDUD.13.76.G10.1.454.CMB.2.raw
  modified_base (286)..(286): a, c, t, g, unknown or other
  modified_base (303)..(303): a, c, t, g, unknown or other
  modified_base (326)..(326): a, c, t, g, unknown or other
  modified_base (528)..(528): a, c, t, g, unknown or other
  modified_base (538)..(538): a, c, t, g, unknown or other
  modified_base (582)..(582): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgactccagccgtggggggtaccctgagtcctctcctgtgcagcctcgtgggttcaccggtcagtcaccacctantgatccgtggtccgacncggctcggaggggaggcgtaggngtgcgtcgtttacttttattatagttgtaggtataccgataccgtccgatacgccgtcggtgggcggggtaccgtacttaccacctagtcctacccgagtactaacaacttaccgaaaacaccgtacgtcttacggttttactaacgtaaatacgaaacgtgacccgtaggagacgtaccgaagtcgaacgtccggtacgtnttaaccgttngggtagccgtagagtaccggtcgggaccctacgggtaacccttnaccggtaatagacgtacggtgacgggtacgaacgggtaccc

SEQ ID NO: 382780 - DNA, 590 bp, Homo sapiens
  misc_feature: GZ8MTXP02GOIDS.13.76.G10.1.454.CMB.2.raw
  modified_base (263)..(263): a, c, t, g, unknown or other
  modified_base (268)..(268): a, c, t, g, unknown or other
  modified_base (298)..(298): a, c, t, g, unknown or other
  modified_base (454)..(454): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaatgtgcccagtgtgaggtgcagctggtggagtctggaggaggcttgatccagccgtgggggtccctgagactctcctgtgcagcctcgtgggttcnccgtnagtcacacctacatgagctgggtcccgccnggcctccgaggggaacggggctgggagtgcgtcttctttttagtttatagtagtgtacgtacatactccgacagctccgtgacggggccgattcacactcctcagacgacaaattacccaaagaaccacgtcttacgtttctactaaaatgaaacngccctagagacgcccaagtcgaaccgacggtccgtagtaacttacgtgtaggacgaggagtaggtccgggggacccctaacggtaaccgttacaacggcttaagtcggacgtcggtacgggggaccctaaacgggg

SEQ ID NO: 382781 - DNA, 693 bp, Homo sapiens
  misc_feature: GZ8MTXP02JI28R.13.76.G10.1.454.CMB.2.raw
  modified_base (271)..(271): a, c, t, g, unknown or other
  modified_base (299)..(299): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagtactctcctgtgcagcctcgtggggtcaccggtnagtcacacctacatgagcgtcgggtccncaggctccggaagggagggctggagtgcgttcttacttttattagtagtacgtggtagtacctataccgtccgcgagtacctccgggtggtacgggggcctattaccaccgtacttcctaccaacgacgaacctaaacttccgaaaacgtaaacccgaccgtcttacggttttacccttaacaaaacttaccggaaactacggacccgttagggaaccgtaacggacccggtaacgttacggacccgaaaccggggttcccgttaggttaacgtttaaccggtggttacggaccggtaaggacggtacggtaccgggggaccctaacggtaaccgttaaccgtacgtaacgtacgtacgggcgtacggtacggggaaccgaacggggtaacccg

SEQ ID NO: 382782 - DNA, 808 bp, Homo sapiens
  misc_feature: GZ8MTXP02IQ7I9.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgccagtgtgaggtgcagcgtggtggagtcgtggaggaggtcttgatccgaggtccggtgggggtccctgacgtacctctccgtgtgcacgtccgttcgttcgggttccaccgtcgacgtccacctacctacagtcggcgtccggttccgggcccgaccggacggtccgtacggggaacggggaacggggtccgtaggtacggtcgtccgtttacgtttttacgtttttaagtttaggttaagttaggttagggttaacttaacctacgttaccgtccgacgtacgtacccggttcgggtcgggggtaccgggtacctaccgttacccaacctacgtaccgttacccgaaagggtaaactaaacccgttaaacttaacccggaaaagttacccgtaacgtttcgttttaaacccgttttactaaaactaaacgttaaccgaaaccgttacgtaccgtagggaaccgacgttaaccggagtaccgggaccgtacggttacgttagttaaaccgtgtcggaacgaaggtaggtaggtccggtacccgggaaaacccgttacgtaaccgtttacgaccggtaagttaccggtcggggtacccggcggggtaccgggaaaccgtaaccgggtaccccgg

SEQ ID NO: 382783 - DNA, 684 bp, Homo sapiens
  misc_feature: GZ8MTXP02FNDMT.13.76.G10.1.454.CMB.2.raw
  modified_base (290)..(290): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctatttaaaaggtgcccagtgtgaggtgcagcgtggtggagtcgtggaggaggcttgatccagccgtgggggtccctgagacctctcctgtgcacgtcctcgtgggttccaccgtcacgtcacacctacntgacgcgtcggtccgccgaggccgtaccggaggggaacggggcgtgggagtcggtcgttcgtttactttttagttattaggtacgtaggtacgtacacgtacgtccgacgacgtccgtccgtgggtacgggcctaacgttccaccgtatacccgtaccgaaagtaacgtaaactaaacgttaccgaaaacgtaacccgtacggttcttacgttttaacctactaaaaattcggaaaacctaggacccttaggtaacggaacgtcccgtaagccggaaaacgtccgggtaccgttagttaacgttacggtggtacgaggaacggaaggtcggtaacgggacccgtaaacggtaacttcgaacgtctacggtaggtccggtcggacggggaacccg

SEQ ID NO: 382784 - DNA, 704 bp, Homo sapiens
  misc_feature: GZ8MTXP02IQT84.13.76.G10.1.454.CMB.2.raw
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaagtgcccagtgtgaggtgcagctggtggagtctggaggaggcttgatccagccgtggggggtccctgagactctcctgtgcagcctctggggttcaccgtcagtcacacctacatgacgctgggtcccgccgaggctcccgaaggggaaggggctggagtgcgttcttcgtttttaatttagtagtagtggtatacccatacctcgacagactccgtggacgggccgaattccactacgtactcccaagacgaactaacttacccaaaagaacccacgtccttacgttttacttaacctaaaagttcgaaaacacggtaccctaggaacgaggacccggaataccggaaccgaccggggtaccggttattagtttaaccgtggttacgtacgaaaaggggacggtacgggtacccgggggaacccctaaaaccggttaaacccggtttaaccgtaaacccggtaaccgttaaacggggttacggtaacccggtacccggggtaccgggggtaaacccgaaaacgggggtaaccccg

SEQ ID NO: 382785 - DNA, 796 bp, Homo sapiens
  misc_feature: GZ8MTXP02HDLP9.13.76.G10.1.454.CMB.2.raw
  modified_base (273)..(273): a, c, t, g, unknown or other
  modified_base (291)..(291): a, c, t, g, unknown or other
  modified_base (300)..(300): a, c, t, g, unknown or other
  modified_base (303)..(303): a, c, t, g, unknown or other
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtggggggtccctgagtactctctgtgcagcctcgtcggttcacccgtnacgtcacacctacatganctgggaccnccnggcctcggaggggaaggggccgtggacgtgtcggtctttactttttacgtttagtaagttaggtaggtaacgttaccattaacctccggcaacggtaccgttaccggtggggacggggccggttaacttccgtaacccagtcctcccgaagacgaactaaccttacaaacgtaaacaccgtacgttcgttttacttaacgaaacttacgaaaacccttagacccgttagggtaaacggaccgacccggtaaagttaccggtaacccggaaacccggggttccggttaacggtttactttaaaacccgttcgtttaaggggaccggtttagggaaacgggttaaacgggttaccggggggaaccccctaaaacggggtaaacccggtttaaacccttaaccgggtaaccgggtaaaccgtttacgggggtacccggttttaacccggacggggggaaacccccggggttaaaacccggggtaaaacccccgggg

SEQ ID NO: 382786 - DNA, 696 bp, Homo sapiens
  misc_feature: GZ8MTXP02G2UJ2.13.76.G10.1.454.CMB.2.raw
  modified_base (299)..(299): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaggtgcccaggtgtgaggtgcagcgtgggtggagtcgtgggaggaggcttgactcccaggcccggtggggggtcccctggagtactcgtcctggtgcagccctgtgggtcaccggtcagtcacacctacntgagctacgggtccaccgcggtctaccgaggggaaggggctggggagtcggtacgtctttacttttaagttagtacggttagtcgggtaactaactactacctcccgagacgaccgttcggtagggacgggtacctagttccacgtactcctaccgataaccgaactaaacttacccgaaaagtccccaacgttctttaccggttacctaactaaaaggtcgaaaccgacgtacgaggacgacgacgtacggacgaaccggaccggttcgttaagttacgttacgtcggacggtagacggtaaggtaccggggtacccgggaacccgtaaacgggtaaaccgttaacgtaaccggtacgttaccgggtacggtaccgggtaccggacgggtaaccgg

SEQ ID NO: 382787 - DNA, 640 bp, Homo sapiens
  misc_feature: GZ8MTXP02F437H.13.76.G10.1.454.CMB.2.raw
  modified_base (257)..(257): a, c, t, g, unknown or other
  modified_base (307)..(307): a, c, t, g, unknown or other
  modified_base (488)..(488): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaggtgtcctagtgtgaggtgcagctggtggagtcgtggagggaggtctgatccaggccgtggggggtcccctgacgactctcctgtgcncgtcctgtcggttcaccgtcagtccacacctacagtgcgtctcgggtccnccgtagggcctaccggaggggaggggcgtgggaggttgtcgtctttacgtttttactttagtagttagttacggttagtacctattacctcgacgtagccgtccgggtgggtacggggaccgtacgttaccacctactcctaccgagtaacgaactaactaccgaagaaccacgtcctttntactacaaatacgaaactcggatcggaagaccgacgactacgacgtaaccggtccgtagttacgttctaggtgacggaagtgaacgggtacggaccgaaacgtacggtaacaaccggtcgtacggtacgacggttccgacgggggtaacccg

SEQ ID NO: 382788 - DNA, 763 bp, Homo sapiens
  misc_feature: GZ8MTXP02IQXCT.13.76.G10.1.454.CMB.2.raw
  modified_base (287)..(287): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttggatccagccgtggggggtccctgagactctcctgtgcagcctcgtggggttcaccgtcagtcacactacatgacncgtcggtccgccgtaggcctccggaaggggtaaggggccgtagggtaggtcggtccggttactttcctttttaagtttaagttaggtaaggttagggttaacgtaacccgtaataacccgttccggccgtaaggtaaccgttcccgggtggggacgggggtacccggtaattacccaacccgtacttaccctacccgtaagaaacgaaacctaaaccgtttaacccgaaaacgtaaacgacccgtctttaacggtttacttaaacaaaagttcgaaaacgttacggacccgttaagacggaaacgtccccgggttaaagtaaccggtaaccggtaccgggttacgtttagtaacgttaccggtggcgaacggtaggtacgacggtacccggggaaacccgtaaaccggttaaaccgtcctaacggtgtacggtacggaccggttacgggaaccggaaacccggtacgggtaacccg

SEQ ID NO: 382789 - DNA, 552 bp, Homo sapiens
  misc_feature: GZ8MTXP02H8YTZ.13.76.G10.1.454.CMB.2.raw
  modified_base (192)..(192): a, c, t, g, unknown or other
  modified_base (227)..(227): a, c, t, g, unknown or other
  modified_base (258)..(258): a, c, t, g, unknown or other
  modified_base (313)..(313): a, c, t, g, unknown or other
  modified_base (318)..(318): a, c, t, g, unknown or other
  modified_base (346)..(346): a, c, t, g, unknown or other
  modified_base (354)..(354): a, c, t, g, unknown or other
  modified_base (360)..(360): a, c, t, g, unknown or other
  modified_base (384)..(384): a, c, t, g, unknown or other
  modified_base (394)..(394): a, c, t, g, unknown or other
  modified_base (463)..(463): a, c, t, g, unknown or other
  modified_base (467)..(467): a, c, t, g, unknown or other
  modified_base (486)..(486): a, c, t, g, unknown or other
  modified_base (492)..(492): a, c, t, g, unknown or other
  modified_base (523)..(523): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggtttccttgttgctatttaaaaggtgccagtgtgaggtgcagctggngagtctggaggaggctgatcagccgtgggggtccngagactctctgtgcagcctctgggtcacgtnagtcaacacctacatgagcgtcggtaccgcgaggctccgagggaagggctggagngcgtnttcgtttattacgtagtagtgtacacgntacgtcgnacgacnccgtggacgggccattccacgtancctccgaganacctaattacccgaagaaaccctgtaccttagtttacctcaaagtcgaactgaccgttgaagcgacctnacgnacggcctagtatacgcgtngtacgngaacgtgggacccagtaaccgtcgtaaccgntaagtccggatacgcgggggaacaccggg

SEQ ID NO: 382790 - DNA, 416 bp, Homo sapiens
  misc_feature: GZ8MTXP01DINJQ.4.11.A11.1.454.CMB.2.raw
  modified_base (241)..(241): a, c, t, g, unknown or other
  modified_base (264)..(264): a, c, t, g, unknown or other
tcagagcactgtagcacgaccggtgctcgatttagctacgactgcagggcagcaagatggtgttgcagacccaggtcttcatttctctgttgctctggatctctggtgccctcgggacatcgtgatgacccagtctccagactccctggctgtgtctctggacggtcgggcctacggactaacggaccgtcgactaaggccagccagattcttatacggtccgacggtaagaatattagtntgtatacagacaagacagacacnctactagtgctctattacgtggtcgtacgttcgtcgtacgtacggtccgtcgtcgtcgtaggtcgggcggtcgggtcgtcggacgacgtactaccctactctacctaccactaacgacgcgccgtcgacgagagtagaagtagtagtacggt

SEQ ID NO: 382791 - DNA, 623 bp, Homo sapiens
  misc_feature: GZ8MTXP01AY6PV.4.11.A11.1.454.CMB.2.raw
  modified_base (219)..(219): a, c, t, g, unknown or other
  modified_base (250)..(250): a, c, t, g, unknown or other
  modified_base (252)..(252): a, c, t, g, unknown or other
  modified_base (265)..(265): a, c, t, g, unknown or other
  modified_base (267)..(267): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactacggaaccgtgactaaggccagccagagtctttanacgggtccaggtaagaattattagctgtatnanacaagacagacancnctagtgctctattacgtggtcgtacttcgtgtacgttaccggtccgtcgtcgtcgtacgtcgggcggcgggtcgtggacgacgtactcctactctcaccacgtacgacgcgccgtgacgagagtagaagtagtgtgtacgtacgttacttacttcgttacgtacgtagtaactaaacttaacttaacttaaccttacccgtaccccgggtaccgtacgtaccggtaaccggtaaaccggaacgaacggtaggtaagacgtacgaacgacgaacgtaacggtcggttcgtcgacgtacctacttccgtttcttcctaaccttccgttcccgtcctacttactaacgttaacgtaacg

SEQ ID NO: 382792 - DNA, 477 bp, Homo sapiens
  misc_feature: GZ8MTXP01EVDCP.4.11.A11.1.454.CMB.2.raw
  modified_base (214)..(214): a, c, t, g, unknown or other
  modified_base (228)..(228): a, c, t, g, unknown or other
  modified_base (232)..(232): a, c, t, g, unknown or other
  modified_base (234)..(235): a, c, t, g, unknown or other
  modified_base (239)..(240): a, c, t, g, unknown or other
  modified_base (242)..(242): a, c, t, g, unknown or other
  modified_base (244)..(244): a, c, t, g, unknown or other
  modified_base (247)..(247): a, c, t, g, unknown or other
  modified_base (255)..(255): a, c, t, g, unknown or other
  modified_base (257)..(257): a, c, t, g, unknown or other
  modified_base (262)..(264): a, c, t, g, unknown or other
  modified_base (267)..(267): a, c, t, g, unknown or other
  modified_base (270)..(271): a, c, t, g, unknown or other
  modified_base (275)..(276): a, c, t, g, unknown or other
  modified_base (288)..(288): a, c, t, g, unknown or other
  modified_base (290)..(290): a, c, t, g, unknown or other
  modified_base (292)..(292): a, c, t, g, unknown or other
  modified_base (294)..(294): a, c, t, g, unknown or other
  modified_base (296)..(296): a, c, t, g, unknown or other
  modified_base (298)..(298): a, c, t, g, unknown or other
  modified_base (300)..(302): a, c, t, g, unknown or other
  modified_base (305)..(307): a, c, t, g, unknown or other
  modified_base (309)..(309): a, c, t, g, unknown or other
  modified_base (312)..(312): a, c, t, g, unknown or other
  modified_base (316)..(316): a, c, t, g, unknown or other
  modified_base (318)..(318): a, c, t, g, unknown or other
  modified_base (320)..(321): a, c, t, g, unknown or other
  modified_base (325)..(325): a, c, t, g, unknown or other
  modified_base (329)..(329): a, c, t, g, unknown or other
  modified_base (333)..(333): a, c, t, g, unknown or other
  modified_base (335)..(336): a, c, t, g, unknown or other
  modified_base (338)..(338): a, c, t, g, unknown or other
  modified_base (340)..(340): a, c, t, g, unknown or other
  modified_base (342)..(342): a, c, t, g, unknown or other
  modified_base (344)..(344): a, c, t, g, unknown or other
  modified_base (346)..(346): a, c, t, g, unknown or other
  modified_base (348)..(348): a, c, t, g, unknown or other
  modified_base (350)..(350): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggcgggtgggcctacgatacgaacctgactaaggccagccagagtcttttanacggtccaggtaanattntnntgtnnananaanacagacancnctatnnnatntgnntctnntcgtctctcgtngngngngngngnnntcnnncncancacncncnnaganaganatgngnntntntntntnananatatatactactaccggactacgtacgacgaacggaacgaaggtaggagagtacaacgacgaacgtaagtcgcgtcgcgactacttcgttcgttcttctactccttccctaccttactcttcgtaac

SEQ ID NO: 382793 - DNA, 535 bp, Homo sapiens
  misc_feature: GZ8MTXP01D1RM7.4.11.A11.1.454.CMB.2.raw
  modified_base (214)..(214): a, c, t, g, unknown or other
  modified_base (227)..(227): a, c, t, g, unknown or other
  modified_base (260)..(260): a, c, t, g, unknown or other
  modified_base (269)..(269): a, c, t, g, unknown or other
  modified_base (359)..(359): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgaccagtctccagactcctggctgtgtctctgggacgggtcgggcctacggactacggactcgactaaggtcagcagagtctttanacggtcaggtaanattattagctgtatcagacaaagcaggacaacnctactagtntctactatacgtggtcgtactcgtgtacgtacggtccgtcgtcgtcgtgtgcggcggtgtgacgacgtactccactctacacactacacncgcgtcgacgagagtagagtagtgtgtacgtagtacttattcgtacgtactatactaattaactaactactaccgtaccggtacgtacgtacgacgaacggaacgagtagagacgtacgacgacgagtgtgcgtcacactcttcgttcttctctctcctcctcttactcgttcgtc

SEQ ID NO: 382794 - DNA, 397 bp, Homo sapiens
  misc_feature: GZ8MTXP01EJXS0.4.11.A11.1.454.CMB.2.raw
  modified_base (246)..(246): a, c, t, g, unknown or other
  modified_base (255)..(255): a, c, t, g, unknown or other
  modified_base (270)..(270): a, c, t, g, unknown or other
  modified_base (279)..(279): a, c, t, g, unknown or other
  modified_base (394)..(394): a, c, t, g, unknown or other
  modified_base (397)..(397): a, c, t, g, unknown or other
tcagagcactgtagcacgaccggtgctcgatttagctacgactgcaggggcagcaagatggtgttgcagacccaggtcttcatttctctgttgctctggatctctggtgccctcgggacatcgtgatgacccagtctccagactccctggctgtgtctctggacgggtcgggcctacggacaacggaccgtcgacttaaaggccagcatattctttagtacggtacgacgtaagtaattattagtntgtatacanacaaagacagacacnctactagtntctactattacgtggtcgtacgttcgtagtacgttaccggtccgtccgtccgttcgtaggtcgggcggtcgggtcgtaggacgacgtactacctactctaccaccactaacgacncgn

SEQ ID NO: 382795 - DNA, 530 bp, Homo sapiens
  misc_feature: GZ8MTXP01D7M41.4.11.A11.1.454.CMB.2.raw
  modified_base (208)..(208): a, c, t, g, unknown or other
  modified_base (239)..(239): a, c, t, g, unknown or other
  modified_base (244)..(245): a, c, t, g, unknown or other
  modified_base (247)..(247): a, c, t, g, unknown or other
  modified_base (260)..(260): a, c, t, g, unknown or other
  modified_base (268)..(268): a, c, t, g, unknown or other
  modified_base (363)..(363): a, c, t, g, unknown or other
  modified_base (411)..(411): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactaacggaccgtcgaactaaggccancagatcttatacgtacgagtagtatatagtntgtannanacaagacagacancactagtnctactatacgtggtcgtacttcgtgtacgtacggtccgtcgtcgtcgtagtggcggcggtgtcgacgacgtactcctactctcaccactacgacncgcgcgacgagagagagtagtgtagtactagtacttattctagtacanactaattatactactaccgtaccggacgtacgtacgacgaacgacgagagagatacgacgacgagtgtcgctcactactacttcttcttctctcctcctctacttactcgttcgtaacg

SEQ ID NO: 382796 - DNA, 453 bp, Homo sapiens
  misc_feature: GZ8MTXP01EVQ7W.4.11.A11.1.454.CMB.2.raw
  modified_base (218)..(218): a, c, t, g, unknown or other
  modified_base (231)..(231): a, c, t, g, unknown or other
  modified_base (235)..(235): a, c, t, g, unknown or other
  modified_base (246)..(246): a, c, t, g, unknown or other
  modified_base (248)..(248): a, c, t, g, unknown or other
  modified_base (250)..(250): a, c, t, g, unknown or other
  modified_base (262)..(262): a, c, t, g, unknown or other
  modified_base (264)..(264): a, c, t, g, unknown or other
  modified_base (269)..(269): a, c, t, g, unknown or other
  modified_base (277)..(277): a, c, t, g, unknown or other
  modified_base (363)..(363): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactaacggacctcgactaaggccagccagatctttanacggtcaggtaanattnttagctgtatnananaagacagacacncnctatnctctattntgtcgtacttcgtgtagtacggtcctcgtcgtcgtgtggcggcggtcgtcggacgacgtactccctactctaccaccactacgacncgctcgacgagagtagtagtagtgtgtcgtagttacttactttcttacgtacgtacgtactaacttaacttaacttaaccttaacccgtt

SEQ ID NO: 382797 - DNA, 463 bp, Homo sapiens
  misc_feature: GZ8MTXP01BHM3K.4.11.A11.1.454.CMB.2.raw
  modified_base (212)..(212): a, c, t, g, unknown or other
  modified_base (220)..(220): a, c, t, g, unknown or other
  modified_base (232)..(232): a, c, t, g, unknown or other
  modified_base (246)..(246): a, c, t, g, unknown or other
  modified_base (248)..(248): a, c, t, g, unknown or other
  modified_base (250)..(250): a, c, t, g, unknown or other
  modified_base (262)..(262): a, c, t, g, unknown or other
  modified_base (264)..(264): a, c, t, g, unknown or other
  modified_base (463)..(463): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactaacggacgtcgactaaggtccagccagngtctttanacggtcagtaanattattgctgtatnananaagacagacacncnctagtgctctattacgtggtcgtcgttcgtgtacgtcggtccgtcgtcgtcgtagtcggcggtcggtcgtcggacgtacgtactcctactctcaccactaccgacgcgcgtcgacgagagtagagtagtgtgtacgtacgttacgttacgtttcgttacgtacgtacgtactaacttaacttaacttaaccgttacccn

SEQ ID NO: 382798 - DNA, 533 bp, Homo sapiens
  misc_feature: GZ8MTXP01B9SQ6.4.11.A11.1.454.CMB.2.raw
  modified_base (213)..(213): a, c, t, g, unknown or other
  modified_base (221)..(221): a, c, t, g, unknown or other
  modified_base (238)..(238): a, c, t, g, unknown or other
  modified_base (243)..(243): a, c, t, g, unknown or other
  modified_base (248)..(248): a, c, t, g, unknown or other
  modified_base (251)..(251): a, c, t, g, unknown or other
  modified_base (265)..(265): a, c, t, g, unknown or other
  modified_base (322)..(322): a, c, t, g, unknown or other
  modified_base (336)..(336): a, c, t, g, unknown or other
  modified_base (367)..(367): a, c, t, g, unknown or other
  modified_base (502)..(502): a, c, t, g, unknown or other
  modified_base (521)..(521): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcggggcctacggactaacggaccgtcgactaaggccagccagngtctttanacggtccagtaagattnttagntgtancanacaagacagacacncactagtgtctctattacgtcggtcgtacttcgtgtacgtcggtccgtcgtcgtcgngtggcggcggtcgnggacgacgtactccactctacaccacacacncgcgtcgacgagagtagagagtgtgcgtagtcttattctacgtacactactaattacttactactaccgtaccggtacgtacgtacgacgaacggacgaggagagacgtacgacgacgagtgtcgcgcgcgactnttcgttcttctctctctcncactcgttcgtc

SEQ ID NO: 382799 - DNA, 526 bp, Homo sapiens
  misc_feature: GZ8MTXP01D3OK1.4.11.A11.1.454.CMB.2.raw
  modified_base (213)..(213): a, c, t, g, unknown or other
  modified_base (243)..(243): a, c, t, g, unknown or other
  modified_base (252)..(252): a, c, t, g, unknown or other
  modified_base (266)..(266): a, c, t, g, unknown or other
  modified_base (274)..(274): a, c, t, g, unknown or other
  modified_base (370)..(370): a, c, t, g, unknown or other
  modified_base (375)..(375): a, c, t, g, unknown or other
  modified_base (394)..(394): a, c, t, g, unknown or other
  modified_base (404)..(404): a, c, t, g, unknown or other
  modified_base (406)..(406): a, c, t, g, unknown or other
  modified_base (408)..(408): a, c, t, g, unknown or other
  modified_base (410)..(410): a, c, t, g, unknown or other
  modified_base (412)..(412): a, c, t, g, unknown or other
  modified_base (479)..(479): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactaacggaccgtcgataaggccagcagattnttagtacggtacgagtaagtaatattagtntgtatacanacaagacagacacncactagtntctactattacgtggtcgtacttcgtgtacgtacggtccgtcgtcgtcgtgtggcggtcggtcgtggacgacgtactcctactcacacacaacacncgcgngacgagagagagagtgtgngatcttattntntnananaatatactactacctaccggactacgtacgacgaacgaacgagagagagtacgaacgacgagtgtgngcacgactacttcgttcttctctctcctcctcttactcgttcgtaac

SEQ ID NO: 382800 - DNA, 565 bp, Homo sapiens
  misc_feature: GZ8MTXP01AKR0K.4.11.A11.1.454.CMB.2.raw
  modified_base (241)..(241): a, c, t, g, unknown or other
  modified_base (246)..(247): a, c, t, g, unknown or other
  modified_base (249)..(249): a, c, t, g, unknown or other
  modified_base (251)..(251): a, c, t, g, unknown or other
  modified_base (254)..(254): a, c, t, g, unknown or other
  modified_base (261)..(261): a, c, t, g, unknown or other
  modified_base (263)..(263): a, c, t, g, unknown or other
  modified_base (269)..(269): a, c, t, g, unknown or other
  modified_base (272)..(272): a, c, t, g, unknown or other
  modified_base (317)..(317): a, c, t, g, unknown or other
  modified_base (359)..(359): a, c, t, g, unknown or other
tcagagcactgtagcacgaccggtgctcgatttagctacgactgcagggcagcaagatggtgttgcagacccaggtcttcatttctctgttgctctggatctctggtgccctcggggacatcgtgatgacccagtctccagactccctggctgtgtctctggacggtcgggcctacggactaacggaccgtcgactaaggccagccaggagtctttatacggtccgacgtagatattagtntgtannananaancagacancnctagtnctntattacgtggtcgtacttcgtgtacgtacggtccgtcgtcgtcgngtggcggcggtgtggacgagtactccactctcacacacgacncgctcgcgagagtagtagagtgtgtcgtacgtcttattctagtactacgtactaattaattaactaacctaccgtacccggtacgtacgtaccgaccgaacggtaacgaaggtaggacgacgtacgaacgtacgacgtgtcgttcgtcgacgtaccgtacttcgttcgttcttctactccgttcccgtccttactcgttcgtaacg

SEQ ID NO: 382801 - DNA, 583 bp, Homo sapiens
  misc_feature: GZ8MTXP01CBRBG.4.11.A11.1.454.CMB.2.raw
  modified_base (212)..(212): a, c, t, g, unknown or other
  modified_base (259)..(259): a, c, t, g, unknown or other
  modified_base (366)..(366): a, c, t, g, unknown or other
tcagagcactgtagcacgaccggtgctcgatttagctacgactgcagggcagcaagatggtgttgcagacccaggtcttcatttctctgttgctctggatctctggtgccctcgggacatcgtgatgacccagtctccagactccctggctgtgtctctggacggtcgggcctacggactaaggaccgtcgataaggcagcagagtctttanacggtccgaggtagaattatagctgtatcagacaacgacacgacacncactagtgtctctattacgtcgtcgtacgtcgtcgtacgtacggtcgtcgtcgtcgtgtggcggtcggtcgtcgacgacgtactccgtactctcaccacgtacgacncgcgtcgacgacgagtagagtagtagtgtacgtagtcttagttcgtacgtacgtacgtactaattacgttactacgtaccgtaccggtacgtacgttaccgtaccgtaacggtaacgtacggtacggtacgtacgtacgacgtacgtacgtcgtcgttcgtacgacgtacgtacttcgttcgttctctcgtccgtccgtccttactcgttcgtaacg

SEQ ID NO: 382802 - DNA, 657 bp, Homo sapiens
  misc_feature: GZ8MTXP01COQJN.4.11.A11.1.454.CMB.2.raw
  modified_base (219)..(219): a, c, t, g, unknown or other
  modified_base (245)..(245): a, c, t, g, unknown or other
  modified_base (254)..(254): a, c, t, g, unknown or other
  modified_base (268)..(268): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacgatacgaccgtcgactaaggtccagccagtagtcttttanacgggtccgaggtaagattatttagntgtatacanacaagacagacacnctactagtgtctctattacgtggtcgtacgttcgtgtacgttaccgggtcccgtccgttccggtcgtacggtcgggcgggtcgggtcggtacggacgtacgtacttaccctacctctaccacctactaacgacgcgcgtcgacgaggagtagaagtagtagtgtacgtacgttacttagtttacgttacgtacgtacgtactaattaacttaacttaacctacccgtaccccggggtaacgtacgttaccggtaaccggaaaccgggaaccggtaacgggtacggtagtaacgtacgaacgtacgtacgtaacggtcggttcgtacgacgtaccgtacttcgttcgttccttaactccttccttccctaccttactcgttaacgtaacg

SEQ ID NO: 382803 - DNA, 531 bp, Homo sapiens
  misc_feature: GZ8MTXP01ALG59.4.11.A11.1.454.CMB.2.raw
  modified_base (210)..(210): a, c, t, g, unknown or other
  modified_base (246)..(246): a, c, t, g, unknown or other
  modified_base (270)..(270): a, c, t, g, unknown or other
  modified_base (279)..(279): a, c, t, g, unknown or other
  modified_base (327)..(327): a, c, t, g, unknown or other
  modified_base (342)..(342): a, c, t, g, unknown or other
  modified_base (358)..(358): a, c, t, g, unknown or other
  modified_base (368)..(368): a, c, t, g, unknown or other
  modified_base (370)..(370): a, c, t, g, unknown or other
  modified_base (391)..(391): a, c, t, g, unknown or other
  modified_base (399)..(399): a, c, t, g, unknown or other
  modified_base (402)..(402): a, c, t, g, unknown or other
  modified_base (404)..(404): a, c, t, g, unknown or other
  modified_base (406)..(406): a, c, t, g, unknown or other
  modified_base (408)..(408): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactaacggaaccgtcgactaagccagcanattcttagtacggtacgacgtaagtaattattagtntgtatacagacaacgacagacacnctactagtntctctatacgtggtcgtacttcgtgtacgtacggtccgtcgtcgtcgngtggcggtcggtcgngacgatactccactcncacacacacncncgcgagagagtagagatgtgntagtactnttntntnanataatatactactaccgtaccggtactacgtacgacgaacggaacgtaggtaggagacgtacgaacgacgacgtgtcgcgcacactcttcttcttctctctcctcctcttactcgttcgtaac

SEQ ID NO: 382804 - DNA, 524 bp, Homo sapiens
  misc_feature: GZ8MTXP01EWT1O.4.11.A11.1.454.CMB.2.raw
  modified_base (222)..(222): a, c, t, g, unknown or other
  modified_base (237)..(237): a, c, t, g, unknown or other
  modified_base (246)..(246): a, c, t, g, unknown or other
  modified_base (252)..(252): a, c, t, g, unknown or other
  modified_base (254)..(254): a, c, t, g, unknown or other
  modified_base (268)..(268): a, c, t, g, unknown or other
  modified_base (276)..(276): a, c, t, g, unknown or other
  modified_base (323)..(323): a, c, t, g, unknown or other
  modified_base (336)..(336): a, c, t, g, unknown or other
  modified_base (364)..(364): a, c, t, g, unknown or other
  modified_base (368)..(368): a, c, t, g, unknown or other
  modified_base (389)..(389): a, c, t, g, unknown or other
  modified_base (466)..(466): a, c, t, g, unknown or other
  modified_base (482)..(482): a, c, t, g, unknown or other
  modified_base (512)..(512): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctcgtgggacggggtcgggcctacggactaacggaccgtcgactaaggccagccagattctttanacgggtccaggtaanattattagntgtatnanacaagacagacacncactagtnctctatacgtggtcgtacttcgtgtacgtacggtccgtcgtcgtcgngtggcggcggtgngacacgtactcctactcacacacacacncgcncgacgagagtagagagtgtgntagtcttattctatactatataattataactactaccgtaccggtactacgtacgacgaacgaacgaggagagatanacgacgagtgtgcgcncgactacttcgttcttctctctcctcctcnctcgttcgtaac

SEQ ID NO: 382805 - DNA, 540 bp, Homo sapiens
  misc_feature: GZ8MTXP01DXM55.4.11.A11.1.454.CMB.2.raw
  modified_base (211)..(211): a, c, t, g, unknown or other
  modified_base (219)..(219): a, c, t, g, unknown or other
  modified_base (230)..(230): a, c, t, g, unknown or other
  modified_base (239)..(239): a, c, t, g, unknown or other
  modified_base (244)..(244): a, c, t, g, unknown or other
  modified_base (247)..(247): a, c, t, g, unknown or other
  modified_base (261)..(261): a, c, t, g, unknown or other
  modified_base (270)..(270): a, c, t, g, unknown or other
  modified_base (480)..(480): a, c, t, g, unknown or other
  modified_base (496)..(496): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctcgtgggcgggtcgggcctacggactaacggacgtcgactaaggccagccagngtctttanacggtcagtanattattagntgtancanacaagacagacacnctactagtntctactatacgtcgtcgtacgttcgtgtacgtcggtccgtcgtcgtcgtgtggcggtcggtcgtcggacgacgtactacctactactaccaccacgtacgacgcgccgtcgacgagagtagaagtagtagtgtcgtacgtcttacttctagtacatactaatactactactacctaccggtactacgtacgacgacgacgagagagatanacgacgagtgtgcgcncgactcttcgttcttctctctcctcctcttactcgttcgtaacg

SEQ ID NO: 382806 - DNA, 564 bp, Homo sapiens
  misc_feature: GZ8MTXP01B69WS.4.11.A11.1.454.CMB.2.raw
  modified_base (245)..(245): a, c, t, g, unknown or other
  modified_base (267)..(267): a, c, t, g, unknown or other
  modified_base (275)..(275): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactaacggacgtcgataaggccagcagagtctttatacggtccgacggtaagtaattattagtntgtatcagacaagacagacacncactagtnctctattacgtggtcgtacttcgtcgtacgtacggtccgtcgtcgtcgtcggtcgggtcgggtcgggtcggtacggacgtacgtactaccctactctacctacctactaacgacgcgcgtacgacgagtagtagaagtagtgtgacgtagtcttattctgtacacgtataattatactactaccgtaccggtacgtacgtacgacgaacggacgaggagagactacgacgacgagtgtcgcgcgcgtactcttcgttcttctctctcctcctcttactcgttcgtaacg

SEQ ID NO: 382807 - DNA, 467 bp, Homo sapiens
  misc_feature: GZ8MTXP01DR25G.4.11.A11.1.454.CMB.2.raw
  modified_base (206)..(206): a, c, t, g, unknown or other
  modified_base (208)..(208): a, c, t, g, unknown or other
  modified_base (225)..(225): a, c, t, g, unknown or other
  modified_base (228)..(228): a, c, t, g, unknown or other
  modified_base (230)..(232): a, c, t, g, unknown or other
  modified_base (234)..(234): a, c, t, g, unknown or other
  modified_base (236)..(236): a, c, t, g, unknown or other
  modified_base (239)..(239): a, c, t, g, unknown or other
  modified_base (245)..(246): a, c, t, g, unknown or other
  modified_base (248)..(248): a, c, t, g, unknown or other
  modified_base (252)..(253): a, c, t, g, unknown or other
  modified_base (255)..(255): a, c, t, g, unknown or other
  modified_base (260)..(260): a, c, t, g, unknown or other
  modified_base (264)..(264): a, c, t, g, unknown or other
  modified_base (285)..(285): a, c, t, g, unknown or other
  modified_base (287)..(287): a, c, t, g, unknown or other
  modified_base (289)..(289): a, c, t, g, unknown or other
  modified_base (291)..(291): a, c, t, g, unknown or other
  modified_base (293)..(293): a, c, t, g, unknown or other
  modified_base (295)..(295): a, c, t, g, unknown or other
  modified_base (298)..(299): a, c, t, g, unknown or other
  modified_base (303)..(303): a, c, t, g, unknown or other
  modified_base (305)..(305): a, c, t, g, unknown or other
  modified_base (312)..(312): a, c, t, g, unknown or other
  modified_base (315)..(315): a, c, t, g, unknown or other
  modified_base (317)..(317): a, c, t, g, unknown or other
  modified_base (319)..(319): a, c, t, g, unknown or other
  modified_base (321)..(321): a, c, t, g, unknown or other
  modified_base (323)..(323): a, c, t, g, unknown or other
  modified_base (327)..(327): a, c, t, g, unknown or other
  modified_base (329)..(329): a, c, t, g, unknown or other
  modified_base (331)..(334): a, c, t, g, unknown or other
  modified_base (336)..(336): a, c, t, g, unknown or other
  modified_base (338)..(338): a, c, t, g, unknown or other
  modified_base (340)..(340): a, c, t, g, unknown or other
  modified_base (342)..(342): a, c, t, g, unknown or other
  modified_base (345)..(345): a, c, t, g, unknown or other
  modified_base (347)..(347): a, c, t, g, unknown or other
  modified_base (349)..(349): a, c, t, g, unknown or other
  modified_base (405)..(405): a, c, t, g, unknown or other
  modified_base (419)..(419): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgaccccagtctccagactccctggctgtgtctcgtgggcgggtgggcctacggatacggaactcgataagcagcagtntnttagacgcagtatattntgntnnnananaanacaganncntatnntntatgngctntcgtgtcgtcgtctctcgtgngngngngngngannctcncncacacanacncncncngnagananannnntntntntntanananatatactactactaccgaccggtacgtacgtacgacgacggaacgtagagagatanacgacgagtgtgcncactactacttcgttcttctctctcctctcttactaacgttcgtaacg

SEQ ID NO: 382808 - DNA, 576 bp, Homo sapiens
  misc_feature: GZ8MTXP01E31NT.4.11.A11.1.454.CMB.2.raw
  modified_base (210)..(210): a, c, t, g, unknown or other
  modified_base (245)..(245): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactaacggaccgtcgactaaggccagcanatttcttagtacggtacgacgtaagtatattagtntgtatacagacaacgacagacacgcactagtgtctactattacgtggtcgtacttcgtcgtacgtacggtccgtcgtcgtcgtacggtcgggcggtcgggtcggtacggacgtacgtactacctactctacacacgtaacgacgcgctcgacgagtagtagaagtagtagtacgacgtacgtacttacttactacgtacacgtactaatactaactactaccgtaccggtactacgtacgacgaacggaacgaaggtagagatacgacgacgagtcgtgcgtcacgactacttcgttcttctctctcctcctcttactaacgttcgtaacg

SEQ ID NO: 382809 - DNA, 525 bp, Homo sapiens
  misc_feature: GZ8MTXP01AJTH6.4.11.A11.1.454.CMB.2.raw
  modified_base (208)..(208): a, c, t, g, unknown or other
  modified_base (264)..(264): a, c, t, g, unknown or other
  modified_base (266)..(266): a, c, t, g, unknown or other
  modified_base (275)..(275): a, c, t, g, unknown or other
  modified_base (315)..(315): a, c, t, g, unknown or other
  modified_base (328)..(328): a, c, t, g, unknown or other
  modified_base (334)..(334): a, c, t, g, unknown or other
  modified_base (339)..(339): a, c, t, g, unknown or other
  modified_base (343)..(343): a, c, t, g, unknown or other
  modified_base (358)..(358): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctcgtgggacgggtcgggcctacggactacggacgtcgactaagccagcanagtctttagacggtccgagtaagattattagcttgatcagacaaagccaggacacncnctagtgctntatcgtggtcgtcttcgtgtacgtcggtcctcgtcgtcgngtggcggcggtgngacacnctccnctcncacacacacgcgcgngcgagagagagagtgtgacgtatactattctagtactacgtactaattacttactacctaccgtaccggtacgtacgtacgacgaacggacgaggagagacgtacgacgacgacgtgtcgcgcgcgtactcttcgttcttctctctcctcctcttctcgttcgtaac

SEQ ID NO: 382810 - DNA, 536 bp, Homo sapiens
  misc_feature: GZ8MTXP01AMX67.4.11.A11.1.454.CMB.2.raw
  modified_base (294)..(294): a, c, t, g, unknown or other
  modified_base (334)..(334): a, c, t, g, unknown or other
  modified_base (370)..(370): a, c, t, g, unknown or other
  modified_base (382)..(382): a, c, t, g, unknown or other
  modified_base (398)..(398): a, c, t, g, unknown or other
  modified_base (402)..(402): a, c, t, g, unknown or other
  modified_base (411)..(411): a, c, t, g, unknown or other
  modified_base (414)..(414): a, c, t, g, unknown or other
  modified_base (416)..(416): a, c, t, g, unknown or other
  modified_base (420)..(420): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctcgtgggacggggtcgggcctacgatacgaacgtgactaaggtccagccagagttcttttagacgggtccgaggtaagaattattagcttggtatcagacaaagccaggacagcctactaagtgctctatttacgngggctactttcgagtacttaccggggtccctgtccggttnaggtgggcggcgggtctgggacagtacttccactcncaccatccgacncgctgacgagatagangtgngatagtctnttntntcanatatatactactaccgtaccggtacgtacgtacgacgaacggacgaggagagatacgagacgagtgtgcgtcgcgactacttcgttcttctctctcctcctcttctcgttcgtaac

SEQ ID NO: 382811 - DNA, 691 bp, Homo sapiens
  misc_feature: GZ8MTXP01B5ACX.4.11.A11.1.454.CMB.2.raw
  modified_base (221)..(221): a, c, t, g, unknown or other
  modified_base (235)..(235): a, c, t, g, unknown or other
  modified_base (325)..(325): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctcgtgggacgggtcgggcctacggactaacggaacgtcgactaaggccagccagagtctttanacgggtcaggtaanattattagcttggtatcagacaaaagaccaggacaagctcctaaatgctctattactggcgacttcgtgagttacggtcctcgtcgtcgngtggcggcgggtcgttcgggacgacggacttcctacttacctacctaccacgtaacgacgcgtcgtacgacgagagtagtaagtagtaggtacggtacgtacgttacgttacgtttacgtacgttacgtacgtaactaattaacttaacttaaccgttaacccgtacccggggtaaccgtaacgttaccggtaaccggtaaaccgggtaaccggtaaacgggtaacggtaacgtaaacgtaacgtaacgtaacggtaacggtaacggtacggttacgtacgttaccgtaaccgtacgttacgttcgttaccgttaaccttaccgttcccgttacccgtaccgttaccgttaaccgttaacgtaacg

SEQ ID NO: 382812 - DNA, 570 bp, Homo sapiens
  misc_feature: GZ8MTXP01DTWLC.4.11.A11.1.454.CMB.2.raw
  modified_base (219)..(219): a, c, t, g, unknown or other
  modified_base (232)..(232): a, c, t, g, unknown or other
  modified_base (236)..(236): a, c, t, g, unknown or other
  modified_base (242)..(242): a, c, t, g, unknown or other
  modified_base (247)..(247): a, c, t, g, unknown or other
  modified_base (251)..(251): a, c, t, g, unknown or other
  modified_base (266)..(266): a, c, t, g, unknown or other
  modified_base (273)..(273): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctcgtgggcgggtcgggcctacggactacggacgtcgactaaggtccagcagtattctttanacggtcaggtaanattnttagtntgtanacanacaacgacagacacncactatntctctatacgtggtcgtacgttcgtgtacgtcgtcctctcgtcgtgtggcggcggtcgtcgacgacgtctccactctacacacgtacgacgcgctcgacgagagtagtagtagtgtgtacgtagtactacttacgtacgtactacgtactaattaactactacctaccgtaccggtacgtacgtacgacgaacggacgaacggtagacgtacgtacgacgacgtacgtcgtcgttcgtacgttacgtactacttcgttcgttcttctacgttcctccgtacttactcgttcgtaacg

SEQ ID NO: 382813 - DNA, 547 bp, Homo sapiens
  misc_feature: GZ8MTXP01B8QW4.4.11.A11.1.454.CMB.2.raw
  modified_base (221)..(221): a, c, t, g, unknown or other
  modified_base (235)..(235): a, c, t, g, unknown or other
  modified_base (245)..(245): a, c, t, g, unknown or other
  modified_base (253)..(253): a, c, t, g, unknown or other
  modified_base (267)..(267): a, c, t, g, unknown or other
  modified_base (276)..(276): a, c, t, g, unknown or other
  modified_base (367)..(367): a, c, t, g, unknown or other
  modified_base (505)..(505): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctcgtgggacgggtcgggcctacggactaacggaccgtcgactaaggccagccagagtctttanacggtccaggtaanaattattagntgtatcanacaagacagacacnctactagtnctctatacgtgtcgtacttcgtcgtacgtacggtccgtcgtcgtcgtgtggcggcggtcgtgacgacgtactccactctacacacacgacncgcgcgacgagagtagagagtgtacgtcgtacgtacttacttcgtagtacacgtactaattacttactacctaccgtaccggtacgtacgtacgacgaacggacgaggtagagacgtacgacgacgagtgtcgcgtcncgactcttcgttcttctctctcctcctcactcgttcgtaacg

SEQ ID NO: 382814 - DNA, 599 bp, Homo sapiens
  misc_feature: GZ8MTXP01D3VDC.4.11.A11.1.454.CMB.2.raw
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctcgtgggcgggtcggcctacgactacgactgactaagtccagcagagtctttagacggtccgaggtaataattattagcttaggtatacagacaaagaccaggacgacgacctacctaacggttcgtactactattacgtacggtcgtacgttcgtacgtacgttaccggtccgtcgtcgtcgtacggtcgggtcggtcgggtcggtacggtacgtacgtactaccctacctactacctaccgtacgtaacgacgcgcgtacgacgagtagtagagtagtagtacgtacgtacgttacttagttacgtacgtactagtactaattactactactaccgtaccggtacgtacgtacgacgacgacgagagagacgtacgagacgagtgtcgcgtcacgtactacttcgttcttctctctcctcctcttactcgttcgtaacg

SEQ ID NO: 382815 - DNA, 549 bp, Homo sapiens
  misc_feature: GZ8MTXP01EWFYY.4.11.A11.1.454.CMB.2.raw
  modified_base (220)..(220): a, c, t, g, unknown or other
  modified_base (232)..(232): a, c, t, g, unknown or other
  modified_base (241)..(241): a, c, t, g, unknown or other
  modified_base (247)..(247): a, c, t, g, unknown or other
  modified_base (249)..(249): a, c, t, g, unknown or other
  modified_base (251)..(251): a, c, t, g, unknown or other
  modified_base (263)..(263): a, c, t, g, unknown or other
  modified_base (271)..(271): a, c, t, g, unknown or other
  modified_base (366)..(366): a, c, t, g, unknown or other
  modified_base (505)..(505): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactaacggaccgtcgactaaggccagccagattctttanacggtcaggtanattattagntgtatnananaagacagacacncactagtntctactattacgtgtcgtacgttcgtgtacgtacggtcctcgtcgtcgtagtcggcggcggtcgtgacgacgactcctactctacacacacgacncgcgcgacgagagtagagtagtagtagtacgtacgtacttacttacgtagtactacgtactaattactactactaccgtaccggtacgtacgtacgacgaacggacgtaggtagagacgtacgacgacgagtgtgcgcncgactcttcgttcttctctctcctcctcttactcgttcgtaacg

SEQ ID NO: 382816 - DNA, 558 bp, Homo sapiens
  misc_feature: GZ8MTXP01DLFQE.4.11.A11.1.454.CMB.2.raw
  modified_base (241)..(241): a, c, t, g, unknown or other
  modified_base (264)..(264): a, c, t, g, unknown or other
  modified_base (272)..(272): a, c, t, g, unknown or other
  modified_base (545)..(545): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactaacggacgtcgactaaggccagccagatcttatacggtcgacgtaagaatattagtntgtatacagacaagacagacacncactagtnctctacttacgtggcgtacttcgtcgtacgtacggtccgtcgtcgtcgtagtgggcggcggtcgtcggacgtacgtactacctactctactaccactacgacgcgactacgacgacgagtagaagagtagtagacgtacgtacttacttctacgtactactactaatattaactactaccgtaccggtacgtacgtacgtacgaacggaacgaacggaggagatacacgacgacgtgtcgcgtcgcgacacttcgttcttctctctctcctcnctcgttcgtaacg

SEQ ID NO: 382817 - DNA, 589 bp, Homo sapiens
  misc_feature: GZ8MTXP01ETSVY.4.11.A11.1.454.CMB.2.raw
  modified_base (217)..(217): a, c, t, g, unknown or other
  modified_base (231)..(231): a, c, t, g, unknown or other
  modified_base (241)..(241): a, c, t, g, unknown or other
  modified_base (252)..(252): a, c, t, g, unknown or other
  modified_base (264)..(264): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctggacgggtcgggcctacggactaacggaccgtcgactaagccagccagatctttanacggtccaggtaanaattattagntgtatacaganaagacagacacnctactagtgtctctattacgtggtcgtcgttcgtgtacgtcggtccgtcgtcgtcgtgtcggcggtcggtcgtcggacgacgtacctccctacctactaccacctactaacgacgcgacgtcgacgagagtagagtagtgtgtacgtacgttacttacgtttacgttacgtacgtacgtaactaaacttacttaacttaccgttaacccgtaccccggggtacgttaccggttaccggtaaccggtaaaccggtaacggtaacggtacggtaacgtaacgtaacgtaacggtaacgtaacggtcggtcggttacgtacgttaccg

SEQ ID NO: 382818 - DNA, 561 bp, Homo sapiens
  misc_feature: GZ8MTXP01DKFZ1.4.11.A11.1.454.CMB.2.raw
  modified_base (211)..(211): a, c, t, g, unknown or other
  modified_base (224)..(224): a, c, t, g, unknown or other
  modified_base (233)..(233): a, c, t, g, unknown or other
  modified_base (239)..(239): a, c, t, g, unknown or other
  modified_base (241)..(241): a, c, t, g, unknown or other
  modified_base (243)..(243): a, c, t, g, unknown or other
  modified_base (255)..(255): a, c, t, g, unknown or other
  modified_base (257)..(257): a, c, t, g, unknown or other
  modified_base (263)..(263): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggcgggtcgggcctacgatacgacgtgactaaggcagcagagtctttanacggtcaggtaanattattagntgtatnananaagacagacacncnctagtnctctatacgtggtcgtacttcgtgtacgtacggtcctcgtcgtcgtgtggcggtcggtcgtcggacgtacgtactacctactctaccacctacgtacgacgcgcgtcgacgagagtagagtagtagtgtacgtagtcttattctacgtacgtacgtactaattaacttaactacgtaccgtaccgggtacgtacgtaccggtacgaacggaacgaaggtaggacgtacgtacgacgacgagtcgtcgcgtcgcgtactacttcgttcttctctctcctcctcttactcgttcgtaacg

SEQ ID NO: 382819 - DNA, 623 bp, Homo sapiens
  misc_feature: GZ8MTXP01A9NF5.4.11.A11.1.454.CMB.2.raw
  modified_base (214)..(214): a, c, t, g, unknown or other
  modified_base (229)..(229): a, c, t, g, unknown or other
  modified_base (265)..(265): a, c, t, g, unknown or other
  modified_base (274)..(274): a, c, t, g, unknown or other
  modified_base (277)..(277): a, c, t, g, unknown or other
  modified_base (284)..(284): a, c, t, g, unknown or other
  modified_base (322)..(322): a, c, t, g, unknown or other
  modified_base (377)..(377): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacgactacgactcgactaagtccagcagagtctttanacggtccgaggtaanattattagcttggtatcagcaaagccaggacagccnctaagttcnctntattcgnggtctacgttcgtgtacgttcggtccctcgtcggtcgnggtcgggcggtcggtacgtcggacacgtaccttccactctacaccacgtacgacncgcgtcgacgagtagtagagtagtgtacgtacgtacgttacttacgttcgttacgtacgtacgtactaattaacttaacttaccgtacccgtacccgggtaccgtacgttaccggtaaccggaaacgggtaaccggtaacggtacggtaacgtaacgtaacgtaacgtacgtacgtcggtcggacgtacgacgtacctacttcgttcgttccttctacctcctccctaccttactcgttcgtaacg

SEQ ID NO: 382820 - DNA, 554 bp, Homo sapiens
  misc_feature: GZ8MTXP01EOFLN.4.11.A11.1.454.CMB.2.raw
  modified_base (365)..(365): a, c, t, g, unknown or other
  modified_base (385)..(385): a, c, t, g, unknown or other
  modified_base (513)..(513): a, c, t, g, unknown or other
  modified_base (543)..(543): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctcgtgggcgggtcggcctacgactacgactgactaagtccagccaggtattctttagacgggtccgaggtaataattattagcttaggtatcagacaaagccaggacagctcctaagtgctctattactggcgtacgttccgtgtacgtacgggtccctcctccggttcgtggtggtcgggcgggtcgttgggacgacgtacttccnctctacaccactacgaaccncgcgcgacgagtagtagagtagtgtgtcgtagtacttattcgtacgtactatactaattactactactaccgtaccggtacgtacgtacgacgaacggacgaggagagatagagacgagtgtgcgtcncgactcttcgttcttctctcgtcctcctcnctcgttcgtcg

SEQ ID NO: 382821 - DNA, 557 bp, Homo sapiens
  misc_feature: GZ8MTXP01DFOCS.4.11.A11.1.454.CMB.2.raw
  modified_base (219)..(219): a, c, t, g, unknown or other
  modified_base (232)..(232): a, c, t, g, unknown or other
  modified_base (240)..(240): a, c, t, g, unknown or other
  modified_base (244)..(245): a, c, t, g, unknown or other
  modified_base (247)..(247): a, c, t, g, unknown or other
  modified_base (261)..(261): a, c, t, g, unknown or other
  modified_base (370)..(370): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactaacggaccgtcgactaaggccagccagatctttanacggtcaggtaanattattgntgtnnanacaagacagacacncactagtgtctactacttacgtcggtcgtacttcgtgtacgtacggtccgtcgtcgtcgtgtcggcggcggtcgtcgacgacgtactcctactctacacacgtacgacncgcgacgacgagagtagagagtgtgtacgtagtacttacttacgtacgtactacgtactaattactactactaccgtaccggtacgtacgtacgacgaacggacgacggagacgactacgacgacgacgtgtcgcgtcgacgtactacttcgttcttctctactcctcctcttactcgttcgtaacg

SEQ ID NO: 382822 - DNA, 567 bp, Homo sapiens
  misc_feature: GZ8MTXP01ASWTD.4.11.A11.1.454.CMB.2.raw
  modified_base (209)..(209): a, c, t, g, unknown or other
  modified_base (238)..(238): a, c, t, g, unknown or other
  modified_base (249)..(249): a, c, t, g, unknown or other
  modified_base (262)..(262): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctcgtgggacgggtcgggcctacggactaacggacgtcgataaggcagcagngtcttatacggtcgagtagtatattagtntgtatacaganaacgacagacacncactagtgtctactatacgtcgtcgtacgttcgtacgtacgtacggtccgtcgtcgtcgtggtcggcggtcggtcgtacggacgacgtactcctactactacctacctacgtaacgacgcgcgtacgacgagtagtagagtagtgtacgtcgtacgtacttattacgtacgtactactactattactactactaccgtaccggtactacgtacgacgacgacgagagagacgtagagacgacgtgtcgttcgtacgacgactacttcgttcgttctctctcctcctcttactcgttaacgtaacg

SEQ ID NO: 382823 - DNA, 574 bp, Homo sapiens
  misc_feature: GZ8MTXP01EJADP.4.11.A11.1.454.CMB.2.raw
  modified_base (216)..(216): a, c, t, g, unknown or other
  modified_base (229)..(229): a, c, t, g, unknown or other
  modified_base (233)..(233): a, c, t, g, unknown or other
  modified_base (238)..(238): a, c, t, g, unknown or other
  modified_base (242)..(242): a, c, t, g, unknown or other
  modified_base (245)..(245): a, c, t, g, unknown or other
  modified_base (266)..(266): a, c, t, g, unknown or other
tcagagcactgtagcacgaccggtgctcgatttagctacgactgcaggggcagcaagatggtgttgcagacccaggtcttcatttctctgttgctctggatctctggtcgcccgtcggggacatcgtgatgacccagtctccagactccctggctgtgtctcgtgggcgggtcggcctacggactacgacgtcgactaagccagcagagtctttanacggtcgagtaanattnttagntgancanacaagcagacactcactagtntctactatacgtggtcgtacgttcgtgtacgtcggtccgtcgtcgtcgtaggtggcggtcggtcgtacggacgtacgtactacctactactacacactaacgacgcgtcgtacgacgagagtagagtagtagtagtagtagtacttacgttcgtacgtactactaataattactaactactaccgtaccggtacgtacgtacggaacgaacggaacgaaggtagacgacgtacgacgtacgtagtcgtcgacgtacgacgtacgtacttcgttcttcttctctcctcctcttactcgttaacgtaacg

SEQ ID NO: 382824 - DNA, 584 bp, Homo sapiens
  misc_feature: GZ8MTXP01ET7JQ.4.11.A11.1.454.CMB.2.raw
  modified_base (234)..(234): a, c, t, g, unknown or other
  modified_base (242)..(242): a, c, t, g, unknown or other
  modified_base (247)..(247): a, c, t, g, unknown or other
  modified_base (250)..(250): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctcgtgggacgggtcgggcctacggactaacggaccgtcgactaaggccagcagtattctttagacggtcaggtaanattattgntgtancanacaagacagacacgtcactagtctctactactacgtcggtcgtacttcgtcgtacgtacggtccgtcgtcgtcgtcggtcggcggtcggtcgtacggacgtacgtactcctactactactacctacgtacgacgcgcgtacgacgagagtagagtagtagtgtacgtacgtactattcgtacgtacgtacgtactaacttactaactaccgtaccgtaccggtacgtacgtaccgaacgaacggacgacggtaggagacgtacgacgtacgagtgtcgttcgtcgacgtactacttcgttcttctctctcctcctcttacgtcgttaacgtaac

SEQ ID NO: 382825 - DNA, 617 bp, Homo sapiens
  misc_feature: GZ8MTXP01BG2AL.4.11.A11.1.454.CMB.2.raw
  modified_base (275)..(275): a, c, t, g, unknown or other
  modified_base (285)..(285): a, c, t, g, unknown or other
  modified_base (298)..(298): a, c, t, g, unknown or other
  modified_base (327)..(327): a, c, t, g, unknown or other
  modified_base (378)..(378): a, c, t, g, unknown or other
  modified_base (399)..(399): a, c, t, g, unknown or other
  modified_base (403)..(403): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctcgtgggcgggtggccaccgatcaactgcaagtccagccagagttctttagacgggtccgaacggtaagaatttattagcttaggtatcagacaaaagccaggacagcctctaagtnctcattacgngggctactttcgngacgtttaccggggtccctcgtccggttnaggtcgggcggcgggtctggggacacgtacttccactctcaccatccgacngcctgacgaggataggaagtntggngctagtcttagttcagtcagtctaaattacttataaccttaccgtccccggggaattacggtcccgggaaccgaaaacgggtacccgtaaaggggtgaaacggtactacggtaaaacgccggtaaacgtggttaacgggccctaacgacccgtaacttgttccgttgttaccttcctaccgttcccttacccgattacgttccgttaacgtaac

SEQ ID NO: 382826 - DNA, 493 bp, Homo sapiens
  misc_feature: GZ8MTXP01ERLAT.4.11.A11.1.454.CMB.2.raw
  modified_base (209)..(209): a, c, t, g, unknown or other
  modified_base (219)..(219): a, c, t, g, unknown or other
  modified_base (222)..(222): a, c, t, g, unknown or other
  modified_base (227)..(227): a, c, t, g, unknown or other
  modified_base (231)..(232): a, c, t, g, unknown or other
  modified_base (234)..(234): a, c, t, g, unknown or other
  modified_base (236)..(236): a, c, t, g, unknown or other
  modified_base (238)..(238): a, c, t, g, unknown or other
  modified_base (242)..(242): a, c, t, g, unknown or other
  modified_base (244)..(244): a, c, t, g, unknown or other
  modified_base (246)..(246): a, c, t, g, unknown or other
  modified_base (250)..(252): a, c, t, g, unknown or other
  modified_base (257)..(257): a, c, t, g, unknown or other
  modified_base (259)..(259): a, c, t, g, unknown or other
  modified_base (261)..(261): a, c, t, g, unknown or other
  modified_base (266)..(266): a, c, t, g, unknown or other
  modified_base (282)..(282): a, c, t, g, unknown or other
  modified_base (289)..(289): a, c, t, g, unknown or other
  modified_base (301)..(301): a, c, t, g, unknown or other
  modified_base (434)..(434): a, c, t, g, unknown or other
  modified_base (448)..(448): a, c, t, g, unknown or other
  modified_base (457)..(457): a, c, t, g, unknown or other
tcagagcactgtagcacgaccggtgctcgatttagctacgactgcaggggcagcaagatggtgttgcagacccaggtcttcatttctctgttgctctggatctctggtgccctcgggacatcgtgatgacccagtctcagactcctggctgtgtctcgtgggacgggtcgggcctacgactacggacgtgactaagcagcagatcttancggtcagtanatnttagntgtnnananancagnancncatnnntatgngntntcgtntgtcgtctcgtcgtgngtgcggngtcgtcgacganctcctactctcacacacacgcgcgtcgacgagagtagagatcgtagtacgtacgtacttacttagtacgtacgtactataattactaactactaccgaccggtacgtacgtacgacgacgagagtagagatanacgacgagtgtgcncgacgactnttcgttcttctctctcctcctcttactcgttcgtcg

SEQ ID NO: 382827 - DNA, 531 bp, Homo sapiens
  misc_feature: GZ8MTXP01AR0VI.4.11.A11.1.454.CMB.2.raw
  modified_base (205)..(205): a, c, t, g, unknown or other
  modified_base (245)..(245): a, c, t, g, unknown or other
  modified_base (259)..(259): a, c, t, g, unknown or other
  modified_base (272)..(272): a, c, t, g, unknown or other
  modified_base (479)..(479): a, c, t, g, unknown or other
tcagagcactgtagcacgaccggtgctcgatttagctacgactgcaggggcagcaagatggtgttgcagacccaggtcttcatttctctgttgctctggatctctggtcgccctcggggacatcgtgatcgaccagtctccagacctcctggctgtgtctcgtgggacgggtcggcctacgactacgacgtcactaagcagcagnttcttagacggtcgaggtaatattattagcttgtatacanacaaagacacgganacgcacctaagtnctctattactcggtcgtacttcgtgtacgtacggtccgtctcgtcgtggtcggcggtcggtcgtcggagacgtactaccactctcaccaactacacgcgcgcgacgagagagagtagtgtagtatacgtcttattgtactatatatatactactactaccgtaccgtacgtacgtacgacgacgacgagagacgagtacgacgacgngtgtcgctcgcgtactcttcgttcttctctctctctcttactcgttcgtaac

SEQ ID NO: 382828 - DNA, 634 bp, Homo sapiens
  misc_feature: GZ8MTXP01E25LV.4.11.A11.1.454.CMB.2.raw
  modified_base (248)..(248): a, c, t, g, unknown or other
  modified_base (409)..(409): a, c, t, g, unknown or other
  modified_base (479)..(479): a, c, t, g, unknown or other
tcagagcactgtagcacgaccggtgctcgatttagctacgactgcgaagggaagggggagaactgctcagttaggacccagacggaaccatggaagccccagcgcagcttctcttcctcctgctactctggctccagaaagcagtggagaagtagtgatgacgcagtctccagccacctgcctgtgtcctacgagggacactcgcccaccctctcctgcagggccagtcagagtgtgctattattgcngtacagcagaactgaccaagcctccaggctgactcatactataactacaatcgaacgaagggtactagttacggtacgtacccaggtacgtacggttacggagtcggcgtagggtacgggttcgaacgggtacaagggtacttcaacttcactaacgttanacgtacgacgacgtccttggactacgtttagaagttgtttcatagttaccttagtactagttccggtaanaacgtaattaaggttacgtaaggttcggtacggtacccgtcggtacgggttaacgaaccggttaaacgggtaacgaaaggtaacggtaaaccttaacggttaaacgaaccggttgggtaccgtaacgtcgtacccgttaacgtaacgttcgttcg

SEQ ID NO: 382829 - DNA, 432 bp, Homo sapiens
  misc_feature: GZ8MTXP02HSWAH.4.11.A11.1.454.CMB.2.raw
  modified_base (208)..(208): a, c, t, g, unknown or other
  modified_base (431)..(432): a, c, t, g, unknown or other
tcagagcactgtagcacgaccggtgctcgatttagctacgactgcagggcagcaagatggtgttgcagacccaggtcttcatttctctgttgctctggatctctggtgccctcgggacatcgtgatgacccagtctccagactccctggctgtgtctctgggacgggtcgggcctacggactaacggaccgtcgactaaggccagcanattcttatacggtcgacgtaagtaattattagtctgtatcagacaaagacagacacgcctactaagtgtctctattacgtggtcgtactttccgtcgtacgttacggtcccgtccgtccgttcgtagtggcggtcgggtcgtggacgacgtactcctactctcaccactacgacgcgccgtcgcgagagtagaagagtgtgcgtacgtcttatttcgttcgtnn

SEQ ID NO: 382830 - DNA, 415 bp, Homo sapiens
  misc_feature: GZ8MTXP02G96YX.4.11.A11.1.454.CMB.2.raw
  modified_base (211)..(211): a, c, t, g, unknown or other
  modified_base (231)..(231): a, c, t, g, unknown or other
  modified_base (246)..(246): a, c, t, g, unknown or other
  modified_base (415)..(415): a, c, t, g, unknown or other
tcagagcactgtagcacgaccggtgctcgatttagctacgactgcagggcagcaagatggtgttgcagacccaggtcttcatttctctgttgctctggatctctggtgccctcggggacatcgtgatgacccagtctccagactccctggctgtgtctctgggacgggtcgggcctacggactaacggaccgtgactaaaggccagccagnttcttagacggtcgagtaanattattagctgtatnagacaaagacagacagctctagtgctctattactggtcgtacttcgtgtacgtacggtccgtcgtcgtcgtacgtggcggcggtcgtcggacgacgtactcctactctcacactacgacgcgcgtcgacgagagtagaagagtagtgacgtacgtacttacttacgttn

SEQ ID NO: 382831 - DNA, 447 bp, Homo sapiens
  misc_feature: GZ8MTXP02FXZWW.4.11.A11.1.454.CMB.2.raw
  modified_base (442)..(442): a, c, t, g, unknown or other
tcagagcactgtagcacgaccggtgctcgatttagctacgactgcagggcagcaagatggtgttgcagacccaggtcttcatttctctgttgctctggatctctggtgccctcgggacatcgtgatgacccagtctccagactccctggctgtgtctctgggacggtcgggcctacggactaacggaccgtcgactaaaggtccagccagagtcttagtacggtcgacgtaagtaattattagtcttgtatcagacaaagacagacacgcctcctaagtgctctattacgtggtcgtactttcgtgtagtacggtccgtcgtccgtcgtgtggcggcggtcgtggacgagtactcctactcctcaccactacgacgcgccgtcgcgagagtagaagtagtgtggtcgtagtacttactttcgttgtcgtagtactaattaanaactt

SEQ ID NO: 382832 - DNA, 448 bp, Homo sapiens
  misc_feature: GZ8MTXP02HJFYA.4.11.A11.1.454.CMB.2.raw
  modified_base (448)..(448): a, c, t, g, unknown or other
tcagagcactgtagcacgaccggtgctcgatttagctacgactgcagggcagcaagatggtgttgcagacccaggtcttcatttctctgttgctctggatctctggtgccctcgggacatcgtgatgacccagtctccagactccctggctgtgtctctggacggtcgggcctacggactaacggaccgtcgactaaaggccagccagagttctttagtacggtcgacggtaagtaattattagtcttgtatcagacaaacgacgagacgacgcctacctagtgtctctacttacgtggtcgtacgttcgtgtacgttacggtccgtcgtccgtcgtacgtggcggcggtcgtcggacgacgtactcctactctcaccactacgacgcgccgtcgcgagagtagaagtagtagtggtcgtagtacgttactttcgttcgtcgtacgtn

SEQ ID NO: 382833 - DNA, 434 bp, Homo sapiens
  misc_feature: GZ8MTXP02JXWY0.4.11.A11.1.454.CMB.2.raw
  modified_base (247)..(247): a, c, t, g, unknown or other
  modified_base (393)..(393): a, c, t, g, unknown or other
  modified_base (434)..(434): a, c, t, g, unknown or other
tcagagcactgtagcacgaccggtgctcgatttagctacgactgcagggcagcaagatggtgttgcagacccaggtcttcatttctctgttgctctggatctctggtgccctcggggacatcgtgatgacccagtctccagactccctggctgtgtctctgggacgggtcgggcctacggactacggaaccgtcgactaaaggccagcagagtctttatacggtccgacggtaagaattatttagtnttgtatcagacaaacgacagacacgcctctagtgctctattacgtggtcgtactttccgtgtacgttaccggtcccgtccgtccggttcgtaggtgggcggtcgggtcgtcggacgacgtactcctactctcacctactaccgacncgccgtcgacgagagtagaagtagtagtggacgtacgttcn

SEQ ID NO: 382834 - DNA, 566 bp, Homo sapiens
  misc_feature: GZ8MTXP02GHVQM.4.11.A11.1.454.CMB.2.raw
  modified_base (218)..(218): a, c, t, g, unknown or other
  modified_base (233)..(233): a, c, t, g, unknown or other
  modified_base (565)..(566): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactacggaccgtgactaaggccagccagagtctttanacgggtccaggtaanattattagctgtatcagacaaagacagacacgcctctagtgctctattacgtcggtcgtactttccgtgtacgttaccggtcccgtccgtccgttcgtagtggtcgggtcgggtcgtggacgacgtacttccctactcctcacctactacgacgcgcctcgacgagtagtagaagtagtgtggtcgtacgttacttactttcgttcgtacccgtacgtactaaacttaattaacttaaccttaacccgtaccccggtaccgtagggtaaccggaaaccgggtaaccggtaacgggtacgggtaacggtaactaacgtacggtacggtcgtann

SEQ ID NO: 382835 - DNA, 463 bp, Homo sapiens
  misc_feature: GZ8MTXP02I8QXZ.4.11.A11.1.454.CMB.2.raw
  modified_base (208)..(208): a, c, t, g, unknown or other
  modified_base (212)..(212): a, c, t, g, unknown or other
  modified_base (235)..(235): a, c, t, g, unknown or other
  modified_base (241)..(241): a, c, t, g, unknown or other
  modified_base (243)..(243): a, c, t, g, unknown or other
  modified_base (245)..(245): a, c, t, g, unknown or other
  modified_base (256)..(256): a, c, t, g, unknown or other
  modified_base (263)..(266): a, c, t, g, unknown or other
  modified_base (268)..(268): a, c, t, g, unknown or other
  modified_base (271)..(272): a, c, t, g, unknown or other
  modified_base (291)..(291): a, c, t, g, unknown or other
  modified_base (293)..(293): a, c, t, g, unknown or other
  modified_base (295)..(295): a, c, t, g, unknown or other
  modified_base (299)..(299): a, c, t, g, unknown or other
  modified_base (301)..(301): a, c, t, g, unknown or other
  modified_base (303)..(303): a, c, t, g, unknown or other
  modified_base (305)..(305): a, c, t, g, unknown or other
  modified_base (309)..(309): a, c, t, g, unknown or other
  modified_base (311)..(311): a, c, t, g, unknown or other
  modified_base (313)..(313): a, c, t, g, unknown or other
  modified_base (319)..(319): a, c, t, g, unknown or other
  modified_base (323)..(323): a, c, t, g, unknown or other
  modified_base (325)..(325): a, c, t, g, unknown or other
  modified_base (327)..(328): a, c, t, g, unknown or other
  modified_base (334)..(334): a, c, t, g, unknown or other
  modified_base (343)..(343): a, c, t, g, unknown or other
  modified_base (345)..(346): a, c, t, g, unknown or other
  modified_base (350)..(350): a, c, t, g, unknown or other
  modified_base (353)..(353): a, c, t, g, unknown or other
  modified_base (355)..(355): a, c, t, g, unknown or other
  modified_base (357)..(357): a, c, t, g, unknown or other
  modified_base (359)..(359): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggctaacggaccgtcgactaaggccagcnagtnttagtcgtcgagtagatattatntgtatnananaagacagacanctctatnnnntntgnntctgtgtcgtctctcgtcngngngcgngngnanctcncncncacacncacncncnncgaganagagagtgngnntctnttntntnanatatatactactactaccgactacgtacgacgacgacgacggaggagagacgagacgacgtacgtgcgtcgcacactctctctctctctcctacactctacacg

SEQ ID NO: 382836 - DNA, 488 bp, Homo sapiens
  misc_feature: GZ8MTXP02ITT8N.4.11.A11.1.454.CMB.2.raw
  modified_base (242)..(242): a, c, t, g, unknown or other
  modified_base (248)..(248): a, c, t, g, unknown or other
  modified_base (488)..(488): a, c, t, g, unknown or other
tcagagcactgtagcacgaccggtgctcgatttagctacgactgcagggcagcaagatggtgttgcagacccaggtcttcatttctctgttgctctggatctctggtgccctcggggacatcgtgatgacccagtctccagactccctggctgtgtctctgggacgggtcgggcctacggactacggaccgtcgactaaggccagccagatctttatacggtccgacgtaagaatattagtntgtatnagacaagacagacacgctactagtgctctattacgtcggtcgtacttcgtgtacgtacggtccgtcgtcgtcgtagtcggcggcggtcgtcggacgacgtactccctactctacctacctactacgacgcgtccgtcgacgagagtagaagtagtagtgtacgtacgtacttagttcgttacgtacgtacgtaactaaacttaacttaacttaaccttacccgtacccggtaaccgtaan

SEQ ID NO: 382837 - DNA, 616 bp, Homo sapiens
  misc_feature: GZ8MTXP02HYIOZ.4.11.A11.1.454.CMB.2.raw
  modified_base (216)..(216): a, c, t, g, unknown or other
  modified_base (289)..(289): a, c, t, g, unknown or other
  modified_base (301)..(301): a, c, t, g, unknown or other
  modified_base (348)..(348): a, c, t, g, unknown or other
  modified_base (367)..(367): a, c, t, g, unknown or other
  modified_base (371)..(371): a, c, t, g, unknown or other
  modified_base (378)..(378): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggcgggtcgggcctacgactacgactcgactaaggtccagccagagtcttttanacgggtccgacggtaagattattagcttggtatcagcaaaagccaggacagcctctaagttgctcatttacgnggctactttcgngtacgttaccgggtccctcgtccggttcaggtcgggcggtcggtcgngggacagtacttccactcncacntccgacngcctgacaggtatagagagtgtgcgtagtacttatttcttcgtacgtacgtactaattaattaacttaaccttaccgttacccggtaaccgtacgttaccggtaccggaaaccgggaaccggaacggtacggtaacgtaacgtacgaaacgacgtaacgtacggtacggtacgtacgacgacctacgtacgttcgttacttaacgtacttaccgttcccgtacctactactacgtacg

SEQ ID NO: 382838 - DNA, 635 bp, Homo sapiens
  misc_feature: GZ8MTXP02HRPRN.4.11.A11.1.454.CMB.2.raw
  modified_base (220)..(220): a, c, t, g, unknown or other
  modified_base (236)..(236): a, c, t, g, unknown or other
  modified_base (251)..(251): a, c, t, g, unknown or other
  modified_base (267)..(267): a, c, t, g, unknown or other
  modified_base (382)..(382): a, c, t, g, unknown or other
tcagagcactgtagcacgaccggtgctcgatttagctacgactgcagggcagcaagatggtgttgcagacccaggtcttcatttctctgttgctctggatctctggtgccctcggggacatcgtgatgacccagtctccagactccctggctgtgtctctgggacgggtcgggcctacggactacggacctcgactaaaggtccagccagagtcttttanacgggtccaggtaaanattattagctgtatnagacaaagacagacancctctagtgctctattactggtcgtactttcgtgtacgttacggtccgtccgtccggttcgtaggtggtcggcgggtcgtggacgacgtactccctactctcaccactaccgacncgcctcgacgagagtagaagtagtagtggtacgtacgtacgttactttcgttcgtacgtacgtactaattatttaacttaaccttacccgttaccccggtaccgtacgttaccggtacccggtaaacgggaaccggtaaacgggtacgggaacggtaacgtacgtaacgtacgtaacgtacggtacggtacgtacgtaccgacctactcgttcgttcttcgtacttaccttcccgtacctactactacgtacg

SEQ ID NO: 382839 - DNA, 601 bp, Homo sapiens
  misc_feature: GZ8MTXP02F0J86.4.11.A11.1.454.CMB.2.raw
  modified_base (219)..(219): a, c, t, g, unknown or other
  modified_base (234)..(234): a, c, t, g, unknown or other
  modified_base (249)..(249): a, c, t, g, unknown or other
  modified_base (251)..(251): a, c, t, g, unknown or other
  modified_base (253)..(253): a, c, t, g, unknown or other
  modified_base (264)..(264): a, c, t, g, unknown or other
  modified_base (271)..(271): a, c, t, g, unknown or other
  modified_base (364)..(364): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactacggaccgtcgactaaggccagccagattctttanacgggtccaggtaanattattagctgtatnananaagacagacanctctatnctctattacgtgcgtacttcgtgtacgtacggtcctcgtcgtcgtagtggcggcggtcgtcgacgacgtactcctactctacacactacgacncgcgtcgacgagagtagaagagtagtggcgtacgtacttacttcgtacgtactacgtactaacttaattaacttaacctaacccgtacccgtaccgtacgttaccggtaccggaaacggtaaccgtaacggtacggtacgtacgtacgaacgacgtaacgtacggtacggtacgtacgtactacgtacgtacgtacgttacttcgtactaccgttcccgtacctactactacgtacg

SEQ ID NO: 382840 - DNA, 516 bp, Homo sapiens
  misc_feature: GZ8MTXP02I3EJ2.4.11.A11.1.454.CMB.2.raw
  modified_base (210)..(210): a, c, t, g, unknown or other
  modified_base (234)..(234): a, c, t, g, unknown or other
  modified_base (251)..(251): a, c, t, g, unknown or other
  modified_base (376)..(376): a, c, t, g, unknown or other
  modified_base (516)..(516): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagacctccctggctgtgtctcgtgggacgggtcgggcctacgactacggacgtcgataaggccagccagngtctttagacgggtccgaggtaanattattagcttggtatnagacaagacgagacacgctactagtgctctattacgtcgtcgtacgttcgtgtacgtcggtcctcgtcgtcgtgtcggcggtcggtcgtcggacgacgtactcctactctacaccacgtacgacncgccgtacgacgagtagtagaagtagtagtcgtacgtacgttacgttacttcgttacgtacgtaacgtaacgtaaacttaacttaacttaaccgtaaccccggtacggtacgtacgtaccgtaaccgtacgttaaccgtn

SEQ ID NO: 382841 - DNA, 588 bp, Homo sapiens
  misc_feature: GZ8MTXP02I6OCN.4.11.A11.1.454.CMB.2.raw
  modified_base (210)..(210): a, c, t, g, unknown or other
  modified_base (241)..(241): a, c, t, g, unknown or other
  modified_base (275)..(275): a, c, t, g, unknown or other
  modified_base (322)..(322): a, c, t, g, unknown or other
  modified_base (372)..(372): a, c, t, g, unknown or other
  modified_base (549)..(549): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctggacgggtcgggcctacggactaacggacgtcgataaggcagcagattnttagtacggtcgacgtaagtaattattagtntgtatcagacaaacgacagacacgcctactagtntctctattacgtggtcgtcttcgtgtacgtcggtccgtcgtcgtcgngtggcggcggtcgtcggacgagtactacctactcctcacctactacgacncgtccgtcgacgagtagtagaagagtagtcgtacgtacgttacttatttctacgtactaaactaattaattaacttaacctaccgtacccgtaaccgtacgttacgaccgaacgggaacgaacggtacggtaagacgtacgaacgacgtaacgtacggtacgtacgtcgacactacnttaaccgttcccgtacctactacgtacgtactacgtacg

SEQ ID NO: 382842 - DNA, 621 bp, Homo sapiens
  misc_feature: GZ8MTXP02GAJRA.4.11.A11.1.454.CMB.2.raw
  modified_base (221)..(221): a, c, t, g, unknown or other
  modified_base (235)..(235): a, c, t, g, unknown or other
  modified_base (250)..(250): a, c, t, g, unknown or other
  modified_base (254)..(254): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactacggaacctcgactaaaggtccagccagattctttanacggtccaggtaanattattagctgtatnaganaagacagacacgctactagtgtctctattacgtggtcgtacgttcgtgtacgtacggtccgtcgtccgtcgtacgtcgggtcggtcgggtcgtcggacgacgtactcctactctactaccactacgacgcgccgtcgacgagagtagaagtagtagtaggtacgtacgttacgttacttcgttcgtacgtacgtactaacttaacttaacttacctacccgtacccgtacgtacgtaccggtaccggtaacggtaacgtaacggtacggtaacgaacgtacgaacgacgtacgtacgtcgtacgtacgtactacgtacgtcgtcgtacgttaacgtactaccgttccctacctactacgtacgtacg

SEQ ID NO: 382843 - DNA, 535 bp, Homo sapiens
  misc_feature: GZ8MTXP02HIU67.4.11.A11.1.454.CMB.2.raw
  modified_base (217)..(217): a, c, t, g, unknown or other
  modified_base (231)..(231): a, c, t, g, unknown or other
  modified_base (240)..(240): a, c, t, g, unknown or other
  modified_base (244)..(244): a, c, t, g, unknown or other
  modified_base (246)..(246): a, c, t, g, unknown or other
  modified_base (248)..(248): a, c, t, g, unknown or other
  modified_base (250)..(250): a, c, t, g, unknown or other
  modified_base (262)..(262): a, c, t, g, unknown or other
  modified_base (269)..(269): a, c, t, g, unknown or other
  modified_base (355)..(355): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactacggactcgactaaggccagccagagtctttancgggtccaggtaanattattagntgtntnananaagacagacacnctctatnctctattacgtgcgtacttcgtgtacgtcggtcctctcgtcgtgtggcggcggtgtgacgacgtactcctactctcacacacgacncgcgcacgagagtagaagagtagtagacgtacgtcttacttcgtcgtacatactaatacttactacctaccgtaccgtacgtacgtacgtacgaacggaacgaaggaggagacgtacgaacgacgacgtacgtgcgcgacactactctcgtctctactacctcctcctactactactacg

SEQ ID NO: 382844 - DNA, 542 bp, Homo sapiens
  misc_feature: GZ8MTXP02JEPVL.4.11.A11.1.454.CMB.2.raw
  modified_base (239)..(239): a, c, t, g, unknown or other
  modified_base (541)..(542): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactaacggacgtcgactaaggccagccagattcttatacggtcgagtagatattagtntgtatcagacaagacgagacacgcctactagtgtctactattacgtggcgtacttcgtgtacgtacggtccgtcgtcgtcgtgtggcggtcggtcggtcggacgacgtacgtccctactcctaccactacgtacgacgcgtcgtcgacgagagtagaagagtagtcgcgtacgtacgttacttcgtcgtacgactactaatattactacctaccgtacccgtacgtacgtaccggaccgaacggacgaggtaggacgtacgtacgaacgacgtacgtacggtcgtacgtacgactacgtacnn

SEQ ID NO: 382845 - DNA, 608 bp, Homo sapiens
  misc_feature: GZ8MTXP02HUM9Y.4.11.A11.1.454.CMB.2.raw
  modified_base (218)..(218): a, c, t, g, unknown or other
  modified_base (231)..(231): a, c, t, g, unknown or other
  modified_base (240)..(240): a, c, t, g, unknown or other
  modified_base (246)..(246): a, c, t, g, unknown or other
  modified_base (262)..(262): a, c, t, g, unknown or other
  modified_base (373)..(373): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactaacggacgtcgactaaggtccagcagatctttanacggtcaggtaanattattagntgtatnagacaagacagacacnctctagtgctctattacgtggtcgtacttcgtgtacgtacggtccgtcgtcgtcgtagtggcggtcggtcgtcggacgacgtactaccctactcctacacctactacgacncgaccgtacgtacgagtagtagtaagtagtagtaggtacgtacgttacgttacttcgttacgtacgtacgtaactaattacttaacttaaccgtaccgtacccgtacgttacgttaccggtaccggaacggaacgtaacggtaggtaacgtacgtacgtaacgacgtacgtacgtacgtacgtacgtactactactacgtcgtctcgtactaccgtcctactactactacgtacg

SEQ ID NO: 382846 - DNA, 482 bp, Homo sapiens
  misc_feature: GZ8MTXP02GK6VF.4.11.A11.1.454.CMB.2.raw
  modified_base (215)..(215): a, c, t, g, unknown or other
  modified_base (228)..(228): a, c, t, g, unknown or other
  modified_base (236)..(236): a, c, t, g, unknown or other
  modified_base (240)..(240): a, c, t, g, unknown or other
  modified_base (242)..(242): a, c, t, g, unknown or other
  modified_base (246)..(246): a, c, t, g, unknown or other
  modified_base (482)..(482): a, c, t, g, unknown or other
tcagagcactgtagcacgaccggtgctcgatttagctacgactgcagggcagcaagatggtgttgcagacccaggtcttcatttctctgttgctctggatctctggtgccctcgggacatcgtgatgacccagtctccagactccctggctgtgtctctggacggtcgggcctacggactaacggaccgtcgactaaggccagccagatctttanacggtcaggtaanattatagntgtntnaganaagcagacacgctctagtgctctatactgtcgtacttcgtgtcgtacggtcctcgtcgtcgtgtggcggcggtcgtcggacgacgtactcctactctacacctacgtacgacgcgccgtcgacgagagtagtaagtagtgtggtacgtacgttacgttactttcgttcgtacgtacgtactaattaacttaacttaaccgtacccgtaccccaaccgtaaccgttaccggtaaacn

SEQ ID NO: 382847 - DNA, 455 bp, Homo sapiens
  misc_feature: GZ8MTXP02G2O13.4.11.A11.1.454.CMB.2.raw
  modified_base (206)..(206): a, c, t, g, unknown or other
  modified_base (208)..(208): a, c, t, g, unknown or other
  modified_base (234)..(234): a, c, t, g, unknown or other
  modified_base (240)..(240): a, c, t, g, unknown or other
  modified_base (242)..(242): a, c, t, g, unknown or other
  modified_base (244)..(244): a, c, t, g, unknown or other
  modified_base (264)..(264): a, c, t, g, unknown or other
tcagagcactgtagcacgaccggtgctcgatttagctacgactgcagggcagcaagatggtgttgcagacccaggtcttcatttctctgttgctctggatctctggtgccctcggggacatcgtgatgacccagtctccagactccctggctgtgtctctggacggtcgggcctacggactaacggaccgtcgataaggcagcagntnttagtacgtcgacgtagtatatagtntgtatnananaagcagacacgctactagtnctctattacgtgtcgtacttcgtgtacgtacggtccgtcgtcgtcgtagtcggcggcggtcgtggacgacgtactcctactctactactactacgacgcgccgtcgacgagtagtagaagtagtagtcgtcgtacgtacttacttctacgtacgtacgtactaattaacttaacttaacctaccgtacccc

SEQ ID NO: 382848 - DNA, 455 bp, Homo sapiens
  misc_feature: GZ8MTXP02IR67U.4.11.A11.1.454.CMB.2.raw
  modified_base (219)..(219): a, c, t, g, unknown or other
  modified_base (232)..(232): a, c, t, g, unknown or other
  modified_base (243)..(246): a, c, t, g, unknown or other
  modified_base (248)..(248): a, c, t, g, unknown or other
  modified_base (250)..(253): a, c, t, g, unknown or other
  modified_base (255)..(255): a, c, t, g, unknown or other
  modified_base (259)..(262): a, c, t, g, unknown or other
  modified_base (264)..(264): a, c, t, g, unknown or other
  modified_base (266)..(267): a, c, t, g, unknown or other
  modified_base (271)..(271): a, c, t, g, unknown or other
  modified_base (285)..(285): a, c, t, g, unknown or other
  modified_base (287)..(287): a, c, t, g, unknown or other
  modified_base (289)..(289): a, c, t, g, unknown or other
  modified_base (291)..(291): a, c, t, g, unknown or other
  modified_base (293)..(293): a, c, t, g, unknown or other
  modified_base (295)..(295): a, c, t, g, unknown or other
  modified_base (297)..(298): a, c, t, g, unknown or other
  modified_base (302)..(302): a, c, t, g, unknown or other
  modified_base (304)..(304): a, c, t, g, unknown or other
  modified_base (306)..(306): a, c, t, g, unknown or other
  modified_base (308)..(308): a, c, t, g, unknown or other
  modified_base (310)..(311): a, c, t, g, unknown or other
  modified_base (313)..(313): a, c, t, g, unknown or other
  modified_base (315)..(315): a, c, t, g, unknown or other
  modified_base (317)..(317): a, c, t, g, unknown or other
  modified_base (319)..(320): a, c, t, g, unknown or other
  modified_base (326)..(326): a, c, t, g, unknown or other
  modified_base (330)..(330): a, c, t, g, unknown or other
  modified_base (333)..(333): a, c, t, g, unknown or other
  modified_base (335)..(335): a, c, t, g, unknown or other
  modified_base (337)..(337): a, c, t, g, unknown or other
  modified_base (339)..(339): a, c, t, g, unknown or other
  modified_base (341)..(341): a, c, t, g, unknown or other
  modified_base (344)..(344): a, c, t, g, unknown or other
  modified_base (346)..(346): a, c, t, g, unknown or other
  modified_base (348)..(348): a, c, t, g, unknown or other
  modified_base (350)..(350): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactaacggaccgtcgactaaggccagccagatctttanacgggtcaggtanatattgctgtnnnnancnnnncncatnnnntngnntctntgtcgtctctcgtngngngngngngnnctcncncncncnncncncncnncgagangagntgngntntntnttntntnanatatatactactaccgtccgactacgtacgacgaacggacgagagagagagagacgtacgtcgtgcgcgacactactctctctctctcctcctctactctactac

SEQ ID NO: 382849 - DNA, 633 bp, Homo sapiens
  misc_feature: GZ8MTXP02JHBFF.4.11.A11.1.454.CMB.2.raw
  modified_base (219)..(219): a, c, t, g, unknown or other
  modified_base (233)..(233): a, c, t, g, unknown or other
  modified_base (251)..(251): a, c, t, g, unknown or other
  modified_base (388)..(388): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggcgggtcgggcctacggactaacggacctcgactaaaggccagccagagtctttanacggtcgaggtaanattattgcttggtatcanacaaacgacgagacacgcctactaagtgctctattacgtcggtcgtacgtttcgtgtacgttaccggtccgtcgtccgtcgtaggtgggcggtcgggtcgtcggacgacgtactcctactctccacctactacgacncgccgtcgacgagagtagaagtagtgtgtcgtacgttacgttacgtttcgttcgtacgtacgtactaaattaattaacttaaccttacccgttacccggtaaccgtacgttaccggtaccggaaaccgggtaaccgtaaacgggtacggtaaggtaacgtaacgaaacgacgtaacgtacggtacggacgtacgacctactacgtacgttcgttctcgtactcctccctcctactcgtacgtacg

SEQ ID NO: 382850 - DNA, 500 bp, Homo sapiens
  misc_feature: GZ8MTXP02F6D4I.4.11.A11.1.454.CMB.2.raw
  modified_base (220)..(220): a, c, t, g, unknown or other
  modified_base (235)..(235): a, c, t, g, unknown or other
  modified_base (243)..(243): a, c, t, g, unknown or other
  modified_base (247)..(248): a, c, t, g, unknown or other
  modified_base (250)..(250): a, c, t, g, unknown or other
  modified_base (252)..(252): a, c, t, g, unknown or other
  modified_base (254)..(255): a, c, t, g, unknown or other
  modified_base (257)..(259): a, c, t, g, unknown or other
  modified_base (261)..(261): a, c, t, g, unknown or other
  modified_base (266)..(267): a, c, t, g, unknown or other
  modified_base (269)..(269): a, c, t, g, unknown or other
  modified_base (274)..(274): a, c, t, g, unknown or other
  modified_base (300)..(300): a, c, t, g, unknown or other
  modified_base (302)..(302): a, c, t, g, unknown or other
  modified_base (311)..(311): a, c, t, g, unknown or other
  modified_base (338)..(338): a, c, t, g, unknown or other
  modified_base (340)..(340): a, c, t, g, unknown or other
  modified_base (441)..(441): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactacggaaccgtcgactaaggccagccagattctttanacggtccgaggtaanattattgntgtnnananannannncnctatnntntatgngctctcgtgtcgtcgtctcgtcgtgngngcggcgtgngacgactctcctctctacacacacacncncgcgagagtagagagagtgtgtagtacgtacttacttgtcgtactactataatatactactaccgtaccgtacgtacgtacgacgaacgaacgagagaganagagacgacgtacgtgcgcacactactctctctctctacctcctactactactactacg

SEQ ID NO: 382851 - DNA, 612 bp, Homo sapiens
  misc_feature: GZ8MTXP02JU438.4.11.A11.1.454.CMB.2.raw
  modified_base (213)..(213): a, c, t, g, unknown or other
  modified_base (229)..(229): a, c, t, g, unknown or other
  modified_base (273)..(273): a, c, t, g, unknown or other
  modified_base (284)..(284): a, c, t, g, unknown or other
  modified_base (296)..(296): a, c, t, g, unknown or other
  modified_base (323)..(323): a, c, t, g, unknown or other
  modified_base (372)..(372): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggcgggtcgggcctacgatacgactgactaagtccagccagagtcttttanacgggtccgaggtaanattattagcttggtatcagcaaaagccaggcagcctctaagttnctctattacgnggctactttcgngtacgttaccgggtccctcgtccggtnaggtgggcggtcggtctgggacagtacttccactctacaccatccgacncgcctcgcgagagtagaagagtagtaggtacgtacgttacttactttcgttagtactacgtactaaattattaacttaaccttaacccgttaccccggtaccgtacgttaccggtaccggaaacgggaaccgaacggtacgggaagaacgtacgaacgacgtaacgtacgtacggtacgtacgaccgacctactcttcgttcttctacttaccgttcccgtaccgtacttactacgtacg

SEQ ID NO: 382852 - DNA, 562 bp, Homo sapiens
  misc_feature: GZ8MTXP02F1ME3.4.11.A11.1.454.CMB.2.raw
  modified_base (213)..(213): a, c, t, g, unknown or other
  modified_base (288)..(288): a, c, t, g, unknown or other
  modified_base (299)..(299): a, c, t, g, unknown or other
  modified_base (347)..(347): a, c, t, g, unknown or other
  modified_base (381)..(381): a, c, t, g, unknown or other
  modified_base (407)..(407): a, c, t, g, unknown or other
  modified_base (419)..(419): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggcgggtcgggcctacgactacgacctgacaagtccagccagagtctttanacgggtccgaggtaagaattattagcttggtatcagcaaaagccaggacagcctctaagttgctcatttaccggnggctctttcgngtacgttaccggtccctcgtccgttcgaggtcgggcggtcgggtacgngggacagtacttccacctcacacctagtccgacncgcctcgacgagagtagagagtgtgngtagtcttattntgtcatactaattattactactaccgtacccgtactacgtacggacgaacggaacggaacggtaggagacgtacgaacgacgtacgtcgtcgtcgtcgacactactacgtctcttctcttcctccctcctactcgtacgtacg

SEQ ID NO: 382853 - DNA, 586 bp, Homo sapiens
  misc_feature: GZ8MTXP02HCOSN.4.11.A11.1.454.CMB.2.raw
  modified_base (211)..(211): a, c, t, g, unknown or other
  modified_base (227)..(227): a, c, t, g, unknown or other
  modified_base (271)..(271): a, c, t, g, unknown or other
  modified_base (274)..(274): a, c, t, g, unknown or other
  modified_base (281)..(281): a, c, t, g, unknown or other
  modified_base (375)..(375): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctggcgggtggcctacgatacgaactgacaaggtccagccagagtcttttanacgggtccacggtaanattattagcttggtatcagcaaaagccaggacagcctctaagtnctntattcgnggctactttcgtgtacgttccggtcctcgtccggttacaggtcgggcggtcggtcgtagggactagtacttccgactctacaccgtatacgacncgccgtcgacgagagtagaagagtgtgacgtagtacttacgttcgtcgtactacgtactaattattacttacttaccgtacccgtacgtacgtacggtaccgtaacggaacgtaacggtacggacgacgtacgaacgacgtacgtacgtacgacgtcgacgacctacgtacgtcgtacttcgtactccgttccgtacctactctacgtacg

SEQ ID NO: 382854 - DNA, 454 bp, Homo sapiens
  misc_feature: GZ8MTXP02IYTPA.4.11.A11.1.454.CMB.2.raw
  modified_base (208)..(208): a, c, t, g, unknown or other
  modified_base (216)..(216): a, c, t, g, unknown or other
  modified_base (228)..(228): a, c, t, g, unknown or other
  modified_base (236)..(236): a, c, t, g, unknown or other
  modified_base (240)..(240): a, c, t, g, unknown or other
  modified_base (242)..(242): a, c, t, g, unknown or other
  modified_base (244)..(244): a, c, t, g, unknown or other
  modified_base (246)..(246): a, c, t, g, unknown or other
  modified_base (249)..(249): a, c, t, g, unknown or other
  modified_base (266)..(266): a, c, t, g, unknown or other
  modified_base (271)..(271): a, c, t, g, unknown or other
  modified_base (278)..(278): a, c, t, g, unknown or other
  modified_base (431)..(431): a, c, t, g, unknown or other
  modified_base (454)..(454): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactaacggacgtcgataaggcagcagngtctttancggtcaggtaanattattgntgtntnananaanacagacacgctactatnctctntacgtgngtacttcgtgtacgtacggtcctcgtcgtcgtggtggcggcggtcgtggacgtacgtacgtcctactctacacactcgacgcgtcgtcgacgagtagtagaagtagtgtaggtacgtacgttacgttacgtttcgtacgtacgtacgtaactnttacttaacttaacgtacccgtn

SEQ ID NO: 382855 - DNA, 605 bp, Homo sapiens
  misc_feature: GZ8MTXP02IXS6O.4.11.A11.1.454.CMB.2.raw
  modified_base (217)..(217): a, c, t, g, unknown or other
  modified_base (232)..(232): a, c, t, g, unknown or other
  modified_base (248)..(248): a, c, t, g, unknown or other
  modified_base (273)..(273): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactacggacctcgataaggccagccagtatctttanacgggtccaggtaanattattagctgtatanagacaagacagacacgctactagtnctctattacgtggtcgtacgttcgtcgtacgtacggtccgtccgtccgtcgtggtggcggtcggtcgtcggacgtacgtactacctactctctacctactaccgacgcgtccgtcgacgagagtagaagtagtgtggacgtacgtacttacttacgttacgtacgtacgtaactaacttacttaacgtactaccgtacccgtacgtacgtacggtaccggtaacggaacggaacggtaggtaagacgtaacgaacgacgtaacgtacggtcggtacgtacgacacgtacgtcgtctactaacgtactccgtacctacctactactacgtacg

SEQ ID NO: 382856 - DNA, 594 bp, Homo sapiens
  misc_feature: GZ8MTXP02IJVNW.4.11.A11.1.454.CMB.2.raw
  modified_base (235)..(235): a, c, t, g, unknown or other
  modified_base (245)..(245): a, c, t, g, unknown or other
  modified_base (281)..(281): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctggcgggtcgggcctacgactacggactcggactaaggtccagccagtattctttatacgggtccgaacggtaanattattagtntgtatcgagaacaacgacgacgacactctactagtntctactacgtcgtcgtcgtacgtcgtgtacgtccgtccgtccgtcgtcgtaggtcggtcggtcggtcggtacgacgtacgtactcctactctactactacacgacgcgtcgtcgagagtagtagagtagtgtgcgtacgtacttacttcgtcgtacgtactactaattactactacctacccgtaccgtacgtacgtaccggaaccggaacgtaacgtaggaggtagtacgacgacgtacgtacgtacgtcgtcgacgacctactacgtcgtcttactaacgtctacctacctaccgtacctacgtacgtacg

SEQ ID NO: 382857 - DNA, 514 bp, Homo sapiens
  misc_feature: GZ8MTXP02HAR63.4.11.A11.1.454.CMB.2.raw
  modified_base (238)..(238): a, c, t, g, unknown or other
  modified_base (244)..(244): a, c, t, g, unknown or other
  modified_base (248)..(248): a, c, t, g, unknown or other
  modified_base (260)..(260): a, c, t, g, unknown or other
  modified_base (268)..(268): a, c, t, g, unknown or other
  modified_base (271)..(271): a, c, t, g, unknown or other
  modified_base (346)..(346): a, c, t, g, unknown or other
  modified_base (351)..(351): a, c, t, g, unknown or other
  modified_base (373)..(373): a, c, t, g, unknown or other
  modified_base (375)..(375): a, c, t, g, unknown or other
  modified_base (384)..(384): a, c, t, g, unknown or other
  modified_base (386)..(386): a, c, t, g, unknown or other
  modified_base (388)..(388): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggcgggtgggcctacggactaacggaccgtcgataaaggccagccagattcttatacggtcgagtaagatattatntgtatnaganaagacagacacnctctagtnctntatatgtcgtactcgtgtacgtacggtcctctcgtcgtgtggcggcggtcgtggacgatactcctctctcacacncgacncgctcgacgagagagagagtgngngatctattntntnatataatatactactaccgtaccgtactacgtacgtacgaacgaacgacggagagacgacgacgacgacgtacgtagcgtacgacacactactctctctactacctacctacctactactactacg

SEQ ID NO: 382858 - DNA, 598 bp, Homo sapiens
  misc_feature: GZ8MTXP02G1HYI.4.11.A11.1.454.CMB.2.raw
  modified_base (217)..(217): a, c, t, g, unknown or other
  modified_base (232)..(232): a, c, t, g, unknown or other
  modified_base (241)..(241): a, c, t, g, unknown or other
  modified_base (247)..(247): a, c, t, g, unknown or other
  modified_base (249)..(249): a, c, t, g, unknown or other
  modified_base (262)..(262): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactacggacgtcgactaaggccagccagatctttanacggtccgaggtaanattattagntgtatnanacaagacagacanctactagtgctctattacgtcggtcgtacttcgtagtacgttacggtcctcgtcgtcgtaggtggcgggtcgggtcgtcggacgacgtactacctactactacacctactacgacgcgtccgtcgacgagagagaagagtgtgtgtacgtacttacttcgtgtacagtactaatattaacttacctaccgtacccgtacgtacgtacggtaaccgaacggaaccgaacggtaggtagaacgtaacgaacgtacgtaacgtacggtacggtcgtacgacaaccgtactacgttcgttacttaacgtactaccttaccctacctactacgtacgtacg

SEQ ID NO: 382859 - DNA, 570 bp, Homo sapiens
  misc_feature: GZ8MTXP02JOX2N.4.11.A11.1.454.CMB.2.raw
  modified_base (215)..(215): a, c, t, g, unknown or other
  modified_base (227)..(227): a, c, t, g, unknown or other
  modified_base (236)..(236): a, c, t, g, unknown or other
  modified_base (242)..(242): a, c, t, g, unknown or other
  modified_base (271)..(271): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggcgggtcgggcctacggactacggacgtcgactaaggccagcagatctttanacggtcaggtanattattagntgtatnagacaacgacgacgacacactactagtcnctctattacgtcgtcgtacgttcgtcgtacgtaccggtccgtcgtcgtcgtggtcgggtcgggtcgggtcggtcggacgtacgtactacctactcctacacacgtacgacgcgtcgtacgacgagagtagagagtgtcgtacgtacgtacttacttcgtacgtacgacgtactaatacttaactactaccgtaccgtacgtacgtacggacggaacggacgaggagagacgagacgacgacgtacgtcgcgacgactactactctactctcgtactacctcctactactactacgtacg

SEQ ID NO: 382860 - DNA, 525 bp, Homo sapiens
  misc_feature: GZ8MTXP02GRU9S.4.11.A11.1.454.CMB.2.raw
  modified_base (212)..(212): a, c, t, g, unknown or other
  modified_base (276)..(276): a, c, t, g, unknown or other
  modified_base (282)..(282): a, c, t, g, unknown or other
  modified_base (295)..(295): a, c, t, g, unknown or other
  modified_base (321)..(321): a, c, t, g, unknown or other
  modified_base (337)..(337): a, c, t, g, unknown or other
  modified_base (369)..(369): a, c, t, g, unknown or other
  modified_base (378)..(378): a, c, t, g, unknown or other
  modified_base (383)..(383): a, c, t, g, unknown or other
  modified_base (386)..(386): a, c, t, g, unknown or other
  modified_base (388)..(388): a, c, t, g, unknown or other
  modified_base (399)..(399): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggcgggtcggccaccgatacgaactgacaagtccagccagagttctttanacgggtccgacggtaagattattagcttggtatcagacaaagccaggacagcctctaagtgctnattacnggctactttccgngagttccggggtccctcgtccggttnagtgggcggcggttcnggggacaggtacttccactctcaccatcgacngctgcaganagagntgngntgtcttattcngtacagataattatactacctaccgtcccgatacgtcgaacgaacggaacaggtgaatacacgaagacgacgtacgtgcgacgtacactactctctctcgtctacctcctcctactactacgtacg

SEQ ID NO: 382861 - DNA, 667 bp, Homo sapiens
  misc_feature: GZ8MTXP02HGMDI.4.11.A11.1.454.CMB.2.raw
tcagagcactgtagcacgaccggtgctcgatttagctacgactgcagggcagcaagatggtgttgcagacccaggtcttcatttctctgttgctctggatctctggtgccctcgggacatcgtgatgacccagtctccagactccctggctgtgtctcgtgggacgggtcggcctacgatacgaacgtcgactaaggccagccagagtcttttagacgggtccgaggtaatattattagcttggtatcagacaaaagccaggacaaccgcctactagtcgtctactattacgtcggtcgtacgttcgtcgtacgtacggtccgtcgtcgtcgtcggtcgggtcggtcggtcgtacggacgtacgtactaccctactctacacctacgtacgacgcgcgtcgacgagagtagtaagtagtgtcgtacgtacgttacgttacgttacgtacgtacgtacgtaactaacttaacttaacttaaccgtacccgttacccgtaccgtaccgtaccggtaaccggtaaccggtaaacggtaacggtacggtaacgtaacgtaacgtaacgtaacgtaacgtacggtacggtacgtacgaccgtactacgttacgttacgttacgttaaccgtaccgttacccgttacccgtaccgtaccgtaccgtacgtacg

SEQ ID NO: 382862 - DNA, 621 bp, Homo sapiens
  misc_feature: GZ8MTXP02JIUV7.4.11.A11.1.454.CMB.2.raw
  modified_base (208)..(208): a, c, t, g, unknown or other
  modified_base (222)..(222): a, c, t, g, unknown or other
  modified_base (277)..(277): a, c, t, g, unknown or other
  modified_base (289)..(289): a, c, t, g, unknown or other
  modified_base (311)..(311): a, c, t, g, unknown or other
  modified_base (358)..(358): a, c, t, g, unknown or other
  modified_base (380)..(380): a, c, t, g, unknown or other
tcagagcactgtagcacgaccggtgctcgatttagctacgactgcaggggcagcaagatggtgttgcagacccaggtcttcatttctctgttgctctggatctctggtgccctcgggacatcgtgatgacccagtctccagactccctggctgtgtctctgggcgggtggccacgatacgaactgacaagtccagccagagtctttanacgggtcacggtanattattagcttgtatcagcaaagccaggactagcctctaagttgctcatttacgnggtctacttcgngtacgtccggtcctcgtcgtgnggtgggcggtcggtcgtggactacgtactccactctcacatacgacncgtcctagacgagtatagaagngtgagtctagttacttactttcgtcgtacgacgtactaaattattaacttaccgtaccgtacccggaactacgttaccgggaccgtaaacgggtaccgtaaggtacggtaagtaacgtaaccgaaacggtacgtaaacgttcggtacggtacctacggtacctaaccgtacgttaccgttcgttaccgttaacctaacgttaccccgttaccccgtaccttaccttaccggtacgtaaccg

SEQ ID NO: 382863 - DNA, 563 bp, Homo sapiens
  misc_feature: GZ8MTXP02IPRSN.4.11.A11.1.454.CMB.2.raw
  modified_base (218)..(218): a, c, t, g, unknown or other
  modified_base (234)..(234): a, c, t, g, unknown or other
  modified_base (278)..(278): a, c, t, g, unknown or other
  modified_base (281)..(281): a, c, t, g, unknown or other
  modified_base (317)..(317): a, c, t, g, unknown or other
  modified_base (364)..(364): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacgactacgacgtcgactaaggtccagccagagtcttttanacgggtccgaggtaanattattagcttggtatcagcaaaagccaggacagctctaagttnctntattctggcgtcttcgtgtgtcggtcctctcgtcgngtggcggcggtcgtcggacgacgtactcctactctcacactacgacncgcgtcgacgagagtagagtagtgtcgtacgtacgttcttactttcgtgtctactactaatattacttactacctacccgtaccgtacgtaccggaccgaacggaacgtaggtaggacgagtacgaacgacgacgtacgtcggtcgtacgacacctacgtctcgttcttcgtcttccttccctcctactactacgtacg

SEQ ID NO: 382864 - DNA, 541 bp, Homo sapiens
  misc_feature: GZ8MTXP02GX3UB.4.11.A11.1.454.CMB.2.raw
  modified_base (219)..(219): a, c, t, g, unknown or other
  modified_base (234)..(234): a, c, t, g, unknown or other
  modified_base (243)..(243): a, c, t, g, unknown or other
  modified_base (251)..(251): a, c, t, g, unknown or other
  modified_base (274)..(274): a, c, t, g, unknown or other
  modified_base (358)..(358): a, c, t, g, unknown or other
  modified_base (362)..(362): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactacggacgtcgactaaggtccagccagagtctttanacggtccgaggtaanattattagntgtatcanacaacgacagacacgctctagtnctctattacgtgtcgtcttcgtgtacgtacggtcctcgtcgtcgtgtggcggcggtcgtgacgacgtactcctactctcacacncacncgcgtcgcgagagtagagagtgtgcgtagtcttacttcgtcgtactacgtactaactactactactaccgtaccgtacgtacgtacgtacgaacgacgacgtagagacgtacgacgacgtacgtacgtcgcgtcgacactactctcgtctcgtactacctcctactactactacgtacg

SEQ ID NO: 382865 - DNA, 683 bp, Homo sapiens
  misc_feature: GZ8MTXP02GWEU5.4.11.A11.1.454.CMB.2.raw
  modified_base (220)..(220): a, c, t, g, unknown or other
  modified_base (236)..(236): a, c, t, g, unknown or other
  modified_base (253)..(253): a, c, t, g, unknown or other
  modified_base (255)..(255): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactaacggaccgtcgactaaggccagccagattctttanacgggtccgaggtaanaattattagctggtatnanacaagacagacacgctactagtgctctattacgtcggtcgtacgttcgtagtacgttaccggtccgtccgtccgttcgtacggtcgggtcggtcgggtcggtacggacgtacgtactaccctactcctacacctacgtacgacgcgccgtacgacgagagtagaaagtagtagtgtacgtacgtacgttacgttcgtacgtacgtacgtaacgtaaacttaacttaacgttaaccgttaacccgtacccggtaaccgtaccgtaccggtaaccggtaaaccgggtaaaccggtaaacggtaacggtaacggtaacgtaacgtaaacgtaacgtaacgtacggtacggtacgtacgtaccgtaccgtacgtacgttacgttacgttaacgtaccttaccgttacccgtaccgtacgtaccgtacgtacg

SEQ ID NO: 382866 - DNA, 617 bp, Homo sapiens
  misc_feature: GZ8MTXP02FPA42.4.11.A11.1.454.CMB.2.raw
  modified_base (212)..(212): a, c, t, g, unknown or other
  modified_base (226)..(226): a, c, t, g, unknown or other
  modified_base (235)..(235): a, c, t, g, unknown or other
  modified_base (241)..(241): a, c, t, g, unknown or other
  modified_base (243)..(243): a, c, t, g, unknown or other
  modified_base (245)..(245): a, c, t, g, unknown or other
  modified_base (257)..(257): a, c, t, g, unknown or other
  modified_base (265)..(265): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggcgggtcgggcctacggactacgactcgactaagcagcagattctttanacggtccaggtaanattattagntgtatnananaagacagacacnctctagtnctctattacgtggtcgtacttcgtgtacgtacggtcctcgtcgtcgtaggtcgggcggtcgggtcggtcggacgacgtacttccctacctcctacctacctacgtaccgaacgcgccgtcgacgagtagtagaagtagtagtggtacgtacgttacgttacttcgttcgtacgtagtactaattaacttaacttaaccgttacccgtacccgtaccgtacgtaccggtaaccgggaaacggtaacggtaacgggtaggtacgtacgtacgtaacgacgtaacgtacggtacggtcgtacgactaccgtacgtcgtcgtctaacgtactacctccctacctactctacgtacg

SEQ ID NO: 382867 - DNA, 537 bp, Homo sapiens
  misc_feature: GZ8MTXP02JV01B.4.11.A11.1.454.CMB.2.raw
  modified_base (207)..(207): a, c, t, g, unknown or other
  modified_base (228)..(228): a, c, t, g, unknown or other
  modified_base (234)..(235): a, c, t, g, unknown or other
  modified_base (240)..(241): a, c, t, g, unknown or other
  modified_base (256)..(256): a, c, t, g, unknown or other
  modified_base (258)..(258): a, c, t, g, unknown or other
  modified_base (267)..(267): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctcgtgggcgggtcgggcctacggactacgacgtcgactaaggcagcagngtcttagacggtcgaggtaanattatnntagtnnagacaagacgagacncnctactagtntctctatgtgtcgtctcgtcgtcgtcggtctcgtcgtcgtgtcggcggtcggtcgtgacgacgtctcctactctacacactcgacgcgcgcgacgagagtagagagtgtgtcgtacgtcttacgttcgtcgtacgtacgtactaattacttactaccgtaccgtaccgtacgtacgtacgacggaacggtacgtaggagacgagtacgacgacgtacgtcgtagtcgacacactcgtcgtctctcgtcctcctcctctctactacgtacg

SEQ ID NO: 382868 - DNA, 675 bp, Homo sapiens
  misc_feature: GZ8MTXP02GC7M5.4.11.A11.1.454.CMB.2.raw
  modified_base (239)..(239): a, c, t, g, unknown or other
tcagagcactgtagcacgaccggtgctcgatttagctacgactgcagggcagcaagatggtgttgcagacccaggtcttcatttctctgttgctctggatctctggtgccctcggggacatcgtgatgacccagtctccagacctccctggctgtgtctcgtgggcgggtcggccacgactacgacgtcgactaagccagccagtagtctttagacggtccgaggtaatattagttagngttagtatacagacaacgacgacgacacgtctactagtcgtctactacgttacgtcgtacgtacgttcgtcgtacgtccggtccgtcgtcgtcgtggtcgggtcggtcggtcggtacgtacgtacgtactaccctactcctacacctacgtaccgacgcgtcgtcgacgagtagtagtaagtagtacgtagtacgtacgttacgttacgttacgtacgtacgtaacgtaactaacttaacttaacgttaaccgttacccgtaacccgtaaccgttaccggtaccggtaaccgggtaaaccggtaaacggtaaacggtacggtaacgtaacgtaacgtaacgtaacgtacgtacggtacgtcgtacgtacgtaccgtacgttacgttacgttacttaacgttaccgtaccgtacccgtacctacgtacgtacgtacg

SEQ ID NO: 382869 - DNA, 492 bp, Homo sapiens
  misc_feature: GZ8MTXP02FI3BN.4.11.A11.1.454.CMB.2.raw
  modified_base (222)..(222): a, c, t, g, unknown or other
  modified_base (237)..(237): a, c, t, g, unknown or other
  modified_base (252)..(252): a, c, t, g, unknown or other
  modified_base (254)..(254): a, c, t, g, unknown or other
  modified_base (256)..(256): a, c, t, g, unknown or other
  modified_base (264)..(264): a, c, t, g, unknown or other
  modified_base (266)..(266): a, c, t, g, unknown or other
  modified_base (274)..(274): a, c, t, g, unknown or other
  modified_base (277)..(277): a, c, t, g, unknown or other
  modified_base (314)..(314): a, c, t, g, unknown or other
  modified_base (316)..(316): a, c, t, g, unknown or other
  modified_base (326)..(326): a, c, t, g, unknown or other
  modified_base (328)..(328): a, c, t, g, unknown or other
  modified_base (341)..(341): a, c, t, g, unknown or other
  modified_base (347)..(347): a, c, t, g, unknown or other
  modified_base (351)..(351): a, c, t, g, unknown or other
  modified_base (354)..(354): a, c, t, g, unknown or other
  modified_base (361)..(361): a, c, t, g, unknown or other
  modified_base (366)..(366): a, c, t, g, unknown or other
  modified_base (379)..(379): a, c, t, g, unknown or other
  modified_base (382)..(382): a, c, t, g, unknown or other
  modified_base (387)..(387): a, c, t, g, unknown or other
  modified_base (389)..(389): a, c, t, g, unknown or other
  modified_base (431)..(431): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactaacggaccgtcgactaaaggccagccagagtcttttanacgggtccaggtaanattattagctgtatnananaagcagananctctagtnctntatacgtggcgtcttcgtgagtcggtcctctcgtcgngngcggcggtgngngagtctccactcncacacncacngcngcgaganagagngtgtgctagtctnttntgcananatatatactactccgactacgtacgacgacgacgagagaganagagacgacgtacgtgcgcgcactactctctctcgtactcctccctactactactactacg

SEQ ID NO: 382870 - DNA, 686 bp, Homo sapiens
  misc_feature: GZ8MTXP02JPKZF.4.11.A11.1.454.CMB.2.raw
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctcgtgggacgggtcgggcctacggactacggaacgtcgactaaggtccagccatattctttagtacgggtccgaggtaaagattatttagcttagtatcgagacaaagcgagacacgtcctcgtaagtgtctactattacgtcggtcgtacgttcgtacgtacgttaccggtccgtccgtccggtcgtacggtcgggtcgggtcgggtcggtacggacgacgtactacctacctcctacaccacgtacgacgcgtcgtcgacgagagtagtagtagtgtcggtacgtacgttacgttactttcgttacgtacgtacgtaactaacttacttaacttaccctaccccgtaaccccgtaaccgtacgtaccggtaaccggtaaaccgggtaaccggtaacgggtacggtaacgtacgtacgaacggtacggtaacggtacggtacggtacgtacgtaccgtaaccgtacgttcgttcgttccttaaccgtaccgttacccgttacccgtacctaccgtaccgtacgtacg

SEQ ID NO: 382871 - DNA, 648 bp, Homo sapiens
  misc_feature: GZ8MTXP02IQQKY.4.11.A11.1.454.CMB.2.raw
  modified_base (214)..(214): a, c, t, g, unknown or other
  modified_base (230)..(230): a, c, t, g, unknown or other
  modified_base (270)..(270): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatcgacccagtctccagacctccctggctgtgtctcgtgggcgggtcggcctacgactacgactgactaagcagccagagttctttanacgggtccgaggtaanaattattagcttggtatcagacaaaagaccaggacaaccncctactagtgtctactacttacgtcggtcgtacgtttcgtcgtacgttaccggtcccgtccgttccggttcgtacggtgggcgggtcggtcggtcggacgacgtacttaccctactcctactaccacgtacgacgcgtccgtcgacgaggtagtaggtaagtagtgtggtacgtacgttacgttacgttcgttacgtacgtacgtaactaaattaacttaacttacctaacccgtacccgtaacgtacgtaccggtaccggaaacggaacgtaaggtaggtagtactaacgtaacgacgtaacgtacggtcgtacgtcgtactacgtactcttcgttacttaactacttaccgttcccgtacctactacgtacgtacg

SEQ ID NO: 382872 - DNA, 641 bp, Homo sapiens
  misc_feature: GZ8MTXP02F0N6B.4.11.A11.1.454.CMB.2.raw
  modified_base (214)..(214): a, c, t, g, unknown or other
  modified_base (230)..(230): a, c, t, g, unknown or other
tcagagcactgtagcacgaccggtgctcgatttagctacgactgcagggcagcaagatggtgttgcagacccaggtcttcatttctctgttgctctggatctctggtgccctcgggacatcgtgatgacccagtctccagactccctggctgtgtctctgggacggtcggcctacggactacggaccgtgactaagtccagccagagtctttanacggtccgaggttaanattagttacgcttaggatcgagacaacgacgagacgacgctactagtcgctactagttacgtcggtcgtacttcgtacgtacgttacggtccgtcgtccgtcgtacggtcggtcggtcggtcgtcggtacgtacgtacgtccctactctactaccacgtacgacgacgcgtacgtacgagagtagtaagtacgtgtacggtacgtacgtacgttacgttacgtacgtacgtacgtactaactacttaacttaccgtaccgtacccgtacgtacgttaccggtaccgtaacgtaaccgtaacggtacggtacgtacgtacgaacgtacgtaacgtacggtacgtacgtcgaccacctacgtacgtacgtacgtaacgtacgtaccgtcccgtaccgtacgtacgtacgtacg

SEQ ID NO: 382873 - DNA, 565 bp, Homo sapiens
  misc_feature: GZ8MTXP02HUHY5.4.11.A11.1.454.CMB.2.raw
  modified_base (216)..(216): a, c, t, g, unknown or other
  modified_base (229)..(229): a, c, t, g, unknown or other
  modified_base (237)..(237): a, c, t, g, unknown or other
  modified_base (247)..(247): a, c, t, g, unknown or other
  modified_base (250)..(250): a, c, t, g, unknown or other
  modified_base (257)..(257): a, c, t, g, unknown or other
  modified_base (259)..(259): a, c, t, g, unknown or other
  modified_base (267)..(267): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactaacggacgtcgactaaggcagcagatctttanacggtcaggtaanattattgntgtatcaganaanacagacncnctctagtntctctacttacgtggtcgtctcgtcgtcgtacggtcctcgtcgtcgtgtggcggtcggtcgtacggtacgtacgtactcctactctactactacgtacgactcgcgtcgacgagtagtagtagagtagtacgtacgtacgtacttacttcgtcgtactactactaacttattactactaccgtaccgtacgtacgtacggaccgaacggtacgaaggtagagtacgacgacgacgtacgtacgtacgtcgacgtactactactctcgtctcgtctacctcctacctactactacgtac

SEQ ID NO: 382874 - DNA, 571 bp, Homo sapiens
  misc_feature: GZ8MTXP02FTNFD.4.11.A11.1.454.CMB.2.raw
  modified_base (208)..(208): a, c, t, g, unknown or other
  modified_base (239)..(239): a, c, t, g, unknown or other
  modified_base (246)..(246): a, c, t, g, unknown or other
  modified_base (248)..(248): a, c, t, g, unknown or other
  modified_base (264)..(264): a, c, t, g, unknown or other
  modified_base (272)..(272): a, c, t, g, unknown or other
  modified_base (322)..(322): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggcgggtcgggcctacggactacgacgtcgataagcagcagagttnttagtacggtacgacgtaagtattattagtntgtatananacaaacgacagacacnctctagtnctactattacgtcggtcgtcgttcgtcgtcgtacggtccgtcgtcgtcgnggtggcggtcgggtcgtggacgacgtactcctactcctaccaccacgtcgacgtcgccgtcgacgagagtagaagtagtgtagtcgtacgttattacttcgtcgtactactactaacttacttaactaccgtacccgtacccgtacgtacgtaccggtacggaacggaacgaaggagaagacgtacgacgacgtacgtcgtgcgtcgcactctcttcttcttcgtctccgtcctcctactcgtactacg

SEQ ID NO: 382875 - DNA, 545 bp, Homo sapiens
  misc_feature: GZ8MTXP02FXN1G.4.11.A11.1.454.CMB.2.raw
  modified_base (215)..(215): a, c, t, g, unknown or other
  modified_base (280)..(280): a, c, t, g, unknown or other
  modified_base (388)..(388): a, c, t, g, unknown or other
  modified_base (390)..(390): a, c, t, g, unknown or other
  modified_base (392)..(392): a, c, t, g, unknown or other
  modified_base (427)..(427): a, c, t, g, unknown or other
  modified_base (433)..(433): a, c, t, g, unknown or other
  modified_base (435)..(435): a, c, t, g, unknown or other
  modified_base (437)..(437): a, c, t, g, unknown or other
  modified_base (481)..(481): a, c, t, g, unknown or other
  modified_base (483)..(483): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactaacggaccgcgataaaggtccagccagattnttatacggtcgacgtaagtaattattagtcttgtatacagacaaagacagacagacctactagtntctactattacgtggtacgtacttcgtagacgttaccggtccgtcgtccgtacgtagtggcggtcgggtcgtcggacgacgtactacctactactacaccacacgacncncngacgagagtagaagatgtagacgtagtacttattntagtanananaatatatactacctaccgacactacgacgacgaacgagagagananagagatagtgcgacacacactactagtactaacgtactacctaccctacctactctactacg

SEQ ID NO: 382876 - DNA, 628 bp, Homo sapiens
  misc_feature: GZ8MTXP02HDJCX.4.11.A11.1.454.CMB.2.raw
  modified_base (285)..(285): a, c, t, g, unknown or other
  modified_base (296)..(296): a, c, t, g, unknown or other
  modified_base (388)..(388): a, c, t, g, unknown or other
  modified_base (398)..(398): a, c, t, g, unknown or other
  modified_base (404)..(404): a, c, t, g, unknown or other
  modified_base (427)..(427): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctcgtgggcggggtcggccaccgatacgaactcgacaaggtccagccagagttcttttagacgggtccgaacggtaagaatttattagcttaggtatcagacaaaagccaggacagcctactaagttnctcatttacgnggctactttccgtagagtttaccggggtccctcgtccggttcaggtgggcggcgggtctggggacaggtactccgactctcaccatccgacncgcctgcagntggaantgtgcagtcttattcgtgtacanactaaatattaactaaccttacccgtccccggaactacgttaccggaccggaaaacgggacccgtaaagggtacggaacggtaacgtaacgaaacgtaccgtaaacggtacggttacggtacgtacgaacctacctacgttacgttcgttccttaaccgtaccgttcccgttacccgtacctacgttaccgtacgtaaccg

SEQ ID NO: 382877 - DNA, 644 bp, Homo sapiens
  misc_feature: GZ8MTXP02FKAJ9.4.11.A11.1.454.CMB.2.raw
  modified_base (284)..(284): a, c, t, g, unknown or other
  modified_base (296)..(296): a, c, t, g, unknown or other
  modified_base (373)..(373): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggcgggtggccacgatacgaactgacaagtccagccagagtcttttagacgggtccgacggtaagattatttagcttggtatcagacaaaagccaggacagcctctaagtgctcatttacgnggctactttcgngtacgttccggtcctcgtccggtcaggtcgggcggtcgggtcgtgggactagtacttccactccacaccatccgacncgcctagacgaaggtatagaagtagtgtcgtactagttcttatttcgtagtacagtactaaattacttaacgtaaccctaacccgtacccggtaactacgttacccgggaaccggaaaacggggaacccgtaaaggggtacggaaagtaacgtaaccgaaaacggtcgtaaacgtggtacggtcgtacgtaccgtaacctacgttacgttcgttaccttaaccgttaccgttacccgttaccccgtacccgtacgtaccgttacgtaaccg

SEQ ID NO: 382878 - DNA, 578 bp, Homo sapiens
  misc_feature: GZ8MTXP02FQJPF.4.11.A11.1.454.CMB.2.raw
  modified_base (291)..(291): a, c, t, g, unknown or other
  modified_base (338)..(338): a, c, t, g, unknown or other
tcagagcactgtagcacgaccggtgctcgatttagctacgactgcaggggcagcaagatggtgttgcagacccaggtcttcatttctctgttgctctggatctctggtgccctcgggacatcgtgatgacccagtctccagactccctggctgtgtctcgtgggacgggtcggcctacgactacggaacgtcgactaaggtccagccagtagtcctttagacgggtccgaaggtaatattattagcttggtaatcgacgacaaaagccaggacagtcctacctaaggttcnctactacgttcgcggtctcgttcgtgtacgttcggtcctcgtcgtgnggtcggcggtcggtacgagactacgtactaccactcgtaccacacgcgacgtgctagacgagagtagagtagtagtacgtacgtagtacttattgtcgtactatatatactactactaccgtaccgtacgtacgtacgtacgaacgacgtagtacgacgacgtagacgacgtacgtacgtagtcgtacgtactactactctcgtactcgtacgtaccgtcctacgtactacgtacgtacg

SEQ ID NO: 382879 - DNA, 657 bp, Homo sapiens
  misc_feature: GZ8MTXP02FE6NA.4.11.A11.1.454.CMB.2.raw
  modified_base (217)..(217): a, c, t, g, unknown or other
  modified_base (231)..(231): a, c, t, g, unknown or other
  modified_base (239)..(239): a, c, t, g, unknown or other
  modified_base (275)..(275): a, c, t, g, unknown or other
  modified_base (278)..(278): a, c, t, g, unknown or other
  modified_base (286)..(286): a, c, t, g, unknown or other
  modified_base (297)..(297): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggactacgacgtcgactaaggtccagcagagtctttanagggtccaggtaanattattancttgatcagcaaaagccaggacagcctctaaggttnctntattacgnggctacttcgngacgttaccggtcctcgtccggtcgaggtcgggcggtcgggtcgtgggactacggtacttcccactctacacctacgtacgacgcgccgtcgacgtagtagtagaagtagtagtgtacgtacgttacttatttacgttacgtacgtacgtaacgtaattaacttaacttaaccgttaacccgtacccggtacgtaacgtaccggtaaccggaaacgggtaaaccggtaaacgggtaacggtacgtacgtaacgaacgtaacgtaacgtacggtacggtacgtacgaccgtaccgtacgtacgttacgttacttaaccgttaccgttacccgttacccgtacctacgtaccgtacgtaacg

SEQ ID NO: 382880 - DNA, 540 bp, Homo sapiens
  misc_feature: GZ8MTXP02FLMPI.4.11.A11.1.454.CMB.2.raw
  modified_base (285)..(285): a, c, t, g, unknown or other
  modified_base (540)..(540): a, c, t, g, unknown or other
tcagagcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggacgggtcgggcctacggacaacggaccgtcgataaggcagcagagttcttagtacggtacgacggtaagtaattattagtgtagtatacagacaaacgacgagacacgacctactacgtcnctactattacgtcggtcgtacgtttcgtgtacgttacggtccgtccgtccggtcgtaggtggcggtcgggtacggtacggacgtacgtacgtcctactactcactactcgacgcgcgacgacgacgagtagacgagtgtggcgtagttattacgttcgtagtacgtagactaattaacttaacgttacctacccgttacccgtacgtacgttaccggtaaccgggtaaacgggtaaccggtaacggtacggtaan

SEQ ID NO: 382881 - DNA, 499 bp, Homo sapiens
  misc_feature: GZ8MTXP01BKBPD.22.77.G11.1.454.CMB.2.raw
tcagacatacgcgtcacgaccggtgctcgatttagctagtcactcaagggaaaggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcggcaagtcagagcattgatatcctttaaactggtatcatcagagaccagggaaggcccctaagttcctgatccatgatgcatccactctgcagagtgacgtccatccaggttcaagtgcagtgggtctgggacagagttcactctcacatcaacagtactgcagccagagtactttggggaaccttatattagcaacagacttaacacgtacccccccagttccggcgaacgggccacacgttcgagacttcgaaacgactgtaggctgcaccaattccttg

SEQ ID NO: 382882 - DNA, 539 bp, Homo sapiens
  misc_feature: GZ8MTXP01C1LRO.22.77.G11.1.454.CMB.2.raw
  modified_base (220)..(220): a, c, t, g, unknown or other
  modified_base (247)..(247): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctccggtctgcatctgttggagaaagaatcaccatcacttgcgggnaagtcagagcattgatatactttaaangtatcatcagagaccagggaacgcccctaagtcctgatccatgatgcatccactctgcagagtggaccgtcccatccaggtcaaggtgctaggtgggtctggggacagacgttcactctcacatacaacagtctgcagccagagtacttaggggaacctatatacgaccaaacacgtaccttaaccacccgtacccccccgtacggttccggacgggaacgggaccacgtacggaccgaagaacttaccgaaaacgacgtggtacggctacggaccacctaacgttcgttcg

SEQ ID NO: 382883 - DNA, 528 bp, Homo sapiens
  misc_feature: GZ8MTXP01EUWSL.22.77.G11.1.454.CMB.2.raw
  modified_base (283)..(283): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatccctcccggtctgcatctgtggagaaagatcaccatcacttgtcggcaagtcagagcattgatatccttttaaactggtatcatcagagaccagggagcccctaagtccngatccatgatgcatccactctgcagagtggacgtcccatccaggttcaagtgcagtgggtctggggacagagttcactctcacatcaacagtctgcagcccaagagtactttaggggaaccttacgtattcgaccaaacagtaccttaaccgaccgtacccccccgacggttccggcgggaacgggaccacgcgttacgaagacttacgaaaccgacgtggtggctcggacacctaagttcttcg

SEQ ID NO: 382884 - DNA, 482 bp, Homo sapiens
  misc_feature: GZ8MTXP01EXRLN.22.77.G11.1.454.CMB.2.raw
  modified_base (197)..(197): a, c, t, g, unknown or other
  modified_base (336)..(336): a, c, t, g, unknown or other
  modified_base (406)..(406): a, c, t, g, unknown or other
tcagacatacgcgtcacgaccggtgctcgatttagctagtcactcaagggaaagggggagtcagtctcagtcaggacacagcatggacatgagggtccccgcttagctcctggggctcctgctactctggctccgaggtgccaggtgtgacatccagatgacccagtctccatcctcccggtctgcatctgttgganaaagatcaccatcacttgtcggcaagtcagagcattgatatcctttaaactggtatcatcagagaccagggaaggcccctaagtcctgatccatgatgcatccactctgcagagtggagtcccccatcagttcagtgcngtgggtctgggacagagttcactctcacatcaacagtactgcagcagagacttggaactactatgacaangacttacacgtaccccctagtcggcgagggaaccacgagtcgagactacaaacgacttgtgctgcacatcgttgtc

SEQ ID NO: 382885 - DNA, 532 bp, Homo sapiens
  misc_feature: GZ8MTXP01ELOSX.22.77.G11.1.454.CMB.2.raw
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatccctcccggtctgcatctgttggagaaagatcaccatcacttgtcgggcaagtcagagcattgatatcctttaaactgtatcatcagagacagggaacgcccctaagttcctgatccatgatgcatccactctgcagagtggacgttcccatccgaggttcaagtggcgaggtgggtctgggacagacgttcactctcaccatacaacagtctgcagccagagtacttaggggaacctatacttagacctaacacgacttaaccacccgtacccccctacgttccggaccgggaacgggaccgacgacgttacgaacgacgttacaaacgacctgtaggctgacactaacgttcgttcg

SEQ ID NO: 382886 - DNA, 533 bp, Homo sapiens
  misc_feature: GZ8MTXP01C6V50.22.77.G11.1.454.CMB.2.raw
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctccggtctgcatctgttggagaaagatcaccatcacttgtcgggcaagtcagagcattgatatccttttaaactggtatcatcagagaccagggaacggcccctaagttccctgatccatgatgcatccactctgcagagtggacgtccatccaggtcaagtgcagtgggtctgggacagagtcactctcacatcaacagtctgcagccagagactttggggaaccttacgtattcgaccaaacacgtactttaaccaccgtaccccccccacggttccggcggaacgggaccacgacgttacgaagacttaaccgaaacgaacgtgttcggctcggccacctaacttcgtttaaccg

SEQ ID NO: 382887 - DNA, 518 bp, Homo sapiens
  misc_feature: GZ8MTXP01BGQPH.22.77.G11.1.454.CMB.2.raw
  modified_base (222)..(222): a, c, t, g, unknown or other
  modified_base (316)..(316): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatccctcccggtctgcatctgttggaagaaagatcacatcacttgtcgggnaagtcagagcattgatatccttttaaactggtatcatcagagaccagggaaggcccctaagttccctgatccatgatgcatcccactctgcagngtggacgtcccatccaggttcaaggtggcaggtggggtctggggacagagttcactctcaccatcaacagtctgcagcagaggtacgtttggggaacttactattcgaccaacagacttacaccgtaccccccgacgttccggcggaacggaccgacgacgttcgagacttacgaacgacgtgtagctgcactaattcgttc

SEQ ID NO: 382888 - DNA, 497 bp, Homo sapiens
  misc_feature: GZ8MTXP01A0BX2.22.77.G11.1.454.CMB.2.raw
  modified_base (416)..(416): a, c, t, g, unknown or other
  modified_base (432)..(432): a, c, t, g, unknown or other
  modified_base (458)..(458): a, c, t, g, unknown or other
  modified_base (493)..(493): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagatcaccatcacttgtcgggcaagtcagagcattgatatccttttaaactggtatcatcagagaccagggaagcccctaagttcctgatccatgatgcatccactctgcagagtggacgtcccatccaggttcaagtgcagtgggtctgggacagagttcactctcaccatcaacagtctgcagccagagtacttggggaacctatattgaccaanagacttacagtacccncccctacgttcggcggacggaccacngtaccgagattcaaacgaactgtcggctgcaaccngttc

SEQ ID NO: 382889 - DNA, 504 bp, Homo sapiens
  misc_feature: GZ8MTXP01CGOQD.22.77.G11.1.454.CMB.2.raw
  modified_base (248)..(248): a, c, t, g, unknown or other
  modified_base (282)..(282): a, c, t, g, unknown or other
  modified_base (375)..(375): a, c, t, g, unknown or other
tcagacatacgcgtcacgaccggtgctcgatttagctagtcactcaagggaaaggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagatcaccatcacttgcgggcaaagtcagagcattgatatcctttaaacngtatcatcagagacagggaacgcccctaagtccngatccatgatgcatccactctgcagagtgacgtcccatccagttcaagtgcaggtgggctggggacaggattcactctcacatacaacagtcngcacgacgagacgtacttacgggaactactatacgacaacacgtactaccgacccgtaccccgacgtccggcggaacgacacgacgacgagaacacgaaacgacgtgcgctcgaccactaacgttcgtg

SEQ ID NO: 382890 - DNA, 535 bp, Homo sapiens
  misc_feature: GZ8MTXP01A442X.22.77.G11.1.454.CMB.2.raw
  modified_base (514)..(514): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttggtcgggcaaagtcagagcattgatatccttttaaactggtatcatcagagaccagggaacggcccctaagttcctgatccatgatgcatcccatctgcagagtggacgtcccatcccaggttcaagttgggcaggtgggtctgggacaggagttcactctcaccatacaacagtctgcacgccagaggtacgttaggggaacctactattcgacctaacacgaccttaaccacccgtaccccccctaggttcccggcgggtaacggacccacgacgttcgagacttacgaacgactgngaactgcacgtaagttcttcg

SEQ ID NO: 382891 - DNA, 562 bp, Homo sapiens
  misc_feature: GZ8MTXP01BJBXW.22.77.G11.1.454.CMB.2.raw
  modified_base (288)..(288): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatccctcccggtctgcatctgttggagaaagatcaccatcacttgtcgggcaagtcagagcattgatattccttttaaactggtatcatcagagacagggaacgcccctaagttccngatccatgatgcatcccactctgcagagtggacctcccatccgaggttcaagtgcaggtgggtctggggacagagttcactctcaccatacaacagtctgcagaccaggacgtactttacggggaaacttactaattcgaccaaacacgtaccttaaaccgacccgtaacccccccgtacggttacccgggccgggaacgggacccgaacgacggttcgaaacgtacttaaccgaaacgaactggtacggctcggaccacctaacttcgttccg

SEQ ID NO: 382892 - DNA, 791 bp, Homo sapiens
  misc_feature: GZ8MTXP01DM2QP.22.77.G11.1.454.CMB.2.raw
  modified_base (770)..(770): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatccctcccggtctgctattcgttggtaggaagaaagtaactaccaacctatcctacgttcgggtaccggactaagtacgaaggacgacttaagttagtaaattacttttaacccttttaaagtgttaatcatacaggacgaacggaaggggaacccgtaccccttaagttcctagtactacctagtagtatcgactacctaccctacctcgtagacgtaaggtaggtacggtacccccgtacccctaacgtacccggttaacgggtttcgaaacgggttcgggtaacggtacgggggtttcgggggttaccgggttacgggggaaacccgtaggggtttaccggttacccttaacccgtttcctaacccgaaccctaactaaccctaaaacgtacgtttccgtacgaccggaaccgacccggaaagggttaacggtttacccggtttaacggggtaaaccctttactttaacgttccgaaaccctaaacgtaccgttaacccttaacccgtaacccccgttaccccccggtaggttccgggacgggaacggtaccacgacggttacgaagtacttaaacgaacgttacgtggtcgtcncgacccttactcttcgtttcc

SEQ ID NO: 382893 - DNA, 549 bp, Homo sapiens
  misc_feature: GZ8MTXP01EJCJW.22.77.G11.1.454.CMB.2.raw
  modified_base (185)..(185): a, c, t, g, unknown or other
  modified_base (199)..(199): a, c, t, g, unknown or other
  modified_base (288)..(288): a, c, t, g, unknown or other
tcagacatacgcgtcacgaccggtgctcgatttagctagtcactcaaggggaaagggggagtcagtctcagtcaggacacagcatggacatgagggtccccgctcagctcctggggctcctgctactctggctccgaggtgccaggtgtgacatccagatgacccagtctccatccctcccggtntgcatctgttgganaaagatcaccatcacttgcgggacaagtcagagcattgaatattacctttaaactggtatcatcagagaccagggacgcccctaagtcngatccatgatgacatcccactctgcagagtggaccgtcccatcccgtaggttcaaggttgcgtaggtgggtctggggacaggtacgttcactctacacatacatagtctgcagccaggaacgtacgttacgggaaccttacttacttcgaccaacactaccttaaccaccccgtaccccccgtagtccgggaccggaacggaccagtacggacgtaagacttaacgaacgacgtgtacggctgaccactcgttaacgttcc

SEQ ID NO: 382894 - DNA, 532 bp, Homo sapiens
  misc_feature: GZ8MTXP01EUE7D.22.77.G11.1.454.CMB.2.raw
  modified_base (184)..(184): a, c, t, g, unknown or other
  modified_base (198)..(198): a, c, t, g, unknown or other
  modified_base (285)..(285): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatccctcccggtntgcatctgttgganaaagatcacatcacttgtcggcaagtcagagcattgatatccttttaaactggtatcatcagagaccagggacgcccctaagttccngatccatgatgcatcccactctgcagagtggacgtcccatccgaggttcaaggttgcgaggtgggtcgtgggacagacgttcactctacaccatacaactagtctgcagaccagacgtactttaggggaacttatattcgaccaacacgtacttaccacccgtaccccccgtacggttccgggccggaacgggaccacgacgttacgagaacacgaacgaactggcgctcgccactaacgttcttcg

SEQ ID NO: 382895 - DNA, 643 bp, Homo sapiens
  misc_feature: GZ8MTXP01D8P28.22.77.G11.1.454.CMB.2.raw
  modified_base (322)..(322): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatccctcccggtctgcatctgttggaagaaagaatcaccatcacttggtcgggacaagtcaagagctattgaattattaccttttaaactggtatcatcagagacgagggacgcccctaagttccagactcatgatgactatcccatcgtncgagagtggaccgtcccagtccgtaggttcaaggttcgggcgtagggttcggggtctgggggaactaaggggtacgtttacactcctaccaacctaataccaaactacggttctcgacgacgtaccgaaggtacgttaccgtttaacgggggtaaaccctttaacgttaacttacggaaccaaactacgtaaccttaacccgtaccccggtaaccccccgtacgggttcccggaccggggaacgggaacccacgtacggttacgaaacgtaacgttaaccgaaacgaacgttggacggtctcgaccactaacttcgttccg

SEQ ID NO: 382896 - DNA, 556 bp, Homo sapiens
  misc_feature: GZ8MTXP01AEWC0.22.77.G11.1.454.CMB.2.raw
  modified_base (196)..(196): a, c, t, g, unknown or other
  modified_base (305)..(305): a, c, t, g, unknown or other
tcagacatacgcgtcacgaccggtgctcgatttagctagtcactcaagggaaaggggagtcagtctcagtcaggacacagcatggacatgagggtccccgctcagctcctggggctcctgctactctggctccgaggtgccaggtgtgacatccagatgacccagtctccatcctcccggtctgcatctgttgganaaagatcaccatcacttgcggcaagtcagagcattgatatccttttaaatggtatcatcagagaccagggaacgcccctaagttccctgactcatgatgcatccactcngcagagtgactcccatccgagttcaaggtgcaggtgggctgggacagtagttcactctacacatacaacagtctgacacgccgaagacggtactttacggggaaccttacgttattaccgaccaaacgtacgaacctttaaccacccgtaacccccccgtacggttacccgggcgggaacgggacccaacgacggttacgaacgtaacttacgaaacgacgttaaggcgccgtgacccactaacttcgtcg

SEQ ID NO: 382897 - DNA, 508 bp, Homo sapiens
  misc_feature: GZ8MTXP01EV9VA.22.77.G11.1.454.CMB.2.raw
  modified_base (489)..(489): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatccctcccggtctgcatctgtgagaaagatcaccatcattgtcgggcaagtcagagcattgatatcctttaaactggtatcatcagagacagggagcccctaagttcctgatccatgatgcatcccactctgcagagtggacgtcccatccgaggttcaagtggcgagtgggtctgggacagagttcactctcacatcaacagtctgcagccagagtacttaggggaactactattcgaccaacacgtactaaccaccgtaccccccgacgttccggcgggaacggaccgacgacgttcgagattacgaacgactgnggctgcactaagttcttcg

SEQ ID NO: 382898 - DNA, 588 bp, Homo sapiens
  misc_feature: GZ8MTXP01COTN5.22.77.G11.1.454.CMB.2.raw
  modified_base (183)..(183): a, c, t, g, unknown or other
  modified_base (252)..(252): a, c, t, g, unknown or other
  modified_base (317)..(317): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtntgcatctgttggaagaaagatcaccatcacttgtcgggcaagtcagagcattgatataccttttaaacnggtatcatcagagaccgagggaacgcccctaagttcctgactccatgatgcatccactctgcagngtgacgtcccatcgaggttcaaggtggcgtaggtggggtctaggggacaggtcgttacactctcaccatacaacagtctacgcacgaccgaaggaacggttacgtttaacggggtaaaccttacttaacgttcgaacctaaacgaacgtaaccttaacccgacccgtaacccccccgtacggttaccgggccgggaacgggaccgacgtacgacgaacgtacttaacgaaacgttacgtggtacgtcgtcgccacctaacgttcttaaccg

SEQ ID NO: 382899 - DNA, 536 bp, Homo sapiens
  misc_feature: GZ8MTXP01D6D01.22.77.G11.1.454.CMB.2.raw
  modified_base (183)..(183): a, c, t, g, unknown or other
  modified_base (197)..(197): a, c, t, g, unknown or other
  modified_base (294)..(294): a, c, t, g, unknown or other
  modified_base (370)..(370): a, c, t, g, unknown or other
  modified_base (389)..(389): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatccctcccgtntgcatctgttgganaaagatcaccatcacttgtcgggacaagtcagagcattgaattatacctttttaaaactggtatcatcagagaaccagggaacgcccctaagttccngatccatgatgcatccactctgcagagtggacctcccatccgaggttcaaggtgcgtaggtcgggtctgggacagngttcactctacacatcaanacgtctgcagcagagtacttacgggaactatattacaccaacacgtacttaaccacccgtaccccccgacggttccggcggaaccggaccgacgacgttacgaagacttaacgaacgaactggtacggctcgcacctaagttcttcg

SEQ ID NO: 382900 - DNA, 547 bp, Homo sapiens
  misc_feature: GZ8MTXP01EYVMG.22.77.G11.1.454.CMB.2.raw
  modified_base (184)..(184): a, c, t, g, unknown or other
  modified_base (198)..(198): a, c, t, g, unknown or other
  modified_base (288)..(288): a, c, t, g, unknown or other
  modified_base (315)..(315): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatccctcccggtntgcatctgttgganaaagatcaccatcacttgtcggcaagtcagagcattgattattacccttttaaatggtatcatcagagaccagggacgcccctaagtccngactcatgatgcatcccactctgcagngtcggactccccatcagttcaaggtgcgtaggtgggtactaggggactaggtacgttccacttctcaacatacaactagtctcgcacgcgagacgtacttaggggtaaccttactacgttacaccaacacgtaccttaccgaccctacccccgacgttccggcggaacggaccacgacgttacgaacgtacaacgaacacgtaagtcggaactcgaccactcgttaacttcg

SEQ ID NO: 382901 - DNA, 529 bp, Homo sapiens
  misc_feature: GZ8MTXP01B3X9J.22.77.G11.1.454.CMB.2.raw
  modified_base (287)..(287): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatccctcccggtctgcatctgttggagaaagatcaccatcacttgtcgggcaagtcagagcattgatatccttttaaactggtatcatcagagaccagggaagcccctaagttccngatccatgatgcatccactctgcagagtggacgtcccatccaggttcaagtggcagtgggtctgggacagagttcactctcacatcaacagtctgcagccagagtactttaggggaaccttactattcgaccaacgacgtacttaccaccgtacccccccacggttccggccgggaacggacccacgacggttcgaacgacttacgaaacgacgtggtggctggcaccgtaattcgttaacg

SEQ ID NO: 382902 - DNA, 667 bp, Homo sapiens
  misc_feature: GZ8MTXP01EQ4U4.22.77.G11.1.454.CMB.2.raw
  modified_base (292)..(292): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatccctcccggtctgcatctgtggaagaaagaatcaccatcacttgtcgggacaagtcagagcattgatattacctttaaactggtatcatcagagaccgagggaacgcccctaagttccngactccatgatgacatcccactctgacagagtcgaccgtcccatcccgtaggttccaagtcggcgtagggtggggtcgtagggactaggagttcaccttctacaaccataccaactaacgtctacgacgacgaccgtaaggtaacgttaccgtttacggggtaaaccctttaacgttaacgttacggaacccaaacgtaccggtaaacctttaaaccccgtaaccccgttacccccccccgtaacggggtttcccgggaacccggggaaccgggaaacccgaccggaacgggttaaccggaaacgtaacgttaaaccgaaaaccggttaaacgtcgggtacgtccgtacggaccaccgtaacttcggtttaaccg

SEQ ID NO: 382903 - DNA, 657 bp, Homo sapiens
  misc_feature: GZ8MTXP01A53M0.22.77.G11.1.454.CMB.2.raw
  modified_base (389)..(389): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatccctcccggtctgcatctgttaggaagaaagatcacatctacttggtcggacaagtcagagctattagattacttacccttttaaagtggtatacatcaagacgaccgaagggaaccgaccccttaagttcctagactccagtcgacgtcactactccgtctcgtgacgaggtggtaccggtccccgtacctacgtacgtacggtgaacgggtcgnggttagggtcgggtacgtacgggacgtaggtactcctacctcaccactacgtaaccaacgtcgtcgacgaccgaacgacggtaaggtacgtttaaccgttaacggtaaccttacttacgtaccaaccgtaactaccgttaacccgtaccccgtacccccgtaccccggtacggtccggaccgggaacgaccttaggtacgacgtaaacgtacgttaaaccggacgttacggtggtccgtcgtaccaccttacgtcgttctttaacccg

SEQ ID NO: 382904 - DNA, 729 bp, Homo sapiens
  misc_feature: GZ8MTXP01BF8PC.22.77.G11.1.454.CMB.2.raw
  modified_base (197)..(197): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatccctcccggtctgcatctgtgaanaagatcacatcacttgcgggacaagtcagagctattagtaacttaatttaccctttttaaactggttaactacaatacgaaggaacgaaaccgagggggtaaacccgtccccttaaaggttccccagtactaccctagtgacttacgacctaactcccctattccgtgacgaaggtacggtcggaaccccgtcccctaagttccggtaacgggtttcgaaagggttcggccggtaggggtttcggggtacgtacggggactaggtaacgttccctacttccacctacctactacaacgacgtacctacgaccacgacgtaacggtacgttacgtttacggggtaaaccctacgttaacgttacgaaccgtaaacgtaaccgttaaccccgttaacccgtaacccccgttaccccccccggtaaggttcccggggaaccggtaaccgggaaccacggtacggttacgaaacgtacgttaaccgaaacggttacgttaacgtcggtcctacggacccttactaacgttccttcg

SEQ ID NO: 382905 - DNA, 606 bp, Homo sapiens
  misc_feature: GZ8MTXP01EMS15.22.77.G11.1.454.CMB.2.raw
  modified_base (185)..(185): a, c, t, g, unknown or other
  modified_base (198)..(198): a, c, t, g, unknown or other
  modified_base (379)..(379): a, c, t, g, unknown or other
  modified_base (437)..(437): a, c, t, g, unknown or other
tcagacatacgcgtcacgaccggtgctcgatttagctagtcactcaagggaaagggggagtcagtctcagtcaggacacagcatgggacatgagggtccccgctcagctcctggggctcctgctactctggctccgaggtgccaggtgtgacatccagatgacccagtctccatccctcccggtntgcatctgtgganaagatcaccatcacttgtcgggcaagtcagagctattgattattaccttttaaactggtaatcatcagagaaccgagggaacgtacccctaagttcccagtactccaagttgactgactactcccactcgtgaccgaggtaggtcggacctcccgtaatcccgtaggttccaaggttcggngtagggttggggtctaggggacctagagttacactctacactataccaatacgtctcncgagaccgaagacggttaccgtttacggggtaaccttagtacttacgaacctaacacgttacctaaccgtaaccccgtacccccgtacgtccgggacggaacggaaccgacgacgttacgaacgtaacttaaccgaacttacgtggtacgctgaccacctaagttcgtc

SEQ ID NO: 382906 - DNA, 658 bp, Homo sapiens
  misc_feature: GZ8MTXP01BL9LO.22.77.G11.1.454.CMB.2.raw
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatccctccggtctgcatctgttaggaagaaagatcaccatcacttggcgggacaagtcagagctattgattattaccttttaaactgtatcatcagagacgagggacgccctaagttcagactccatgatgactactccactctgacagagtcggacctcccagtccgaaggttcgaaggttggcgtagggtcgggtacggtagggggtaactagggtacttacctactacctaccaacctactaccaaacgtaacgtcgttacgaccgaacgaccgtaacggtaacggttaaccgtttaacgggggtaaaccttaaccgttacgttaaccgaccctaaaccgtaacgttaaccttaaccccgtaaccccgttaaaccccccccggtacggttacccggggaccgggaaccgggacccgaacggtcgttacgtaagaacgttacgaaacgttacgtaagtcgctcgacacctaacgttcgttaaccg

SEQ ID NO: 382907 - DNA, 492 bp, Homo sapiens
  misc_feature: GZ8MTXP02FNSCL.22.77.G11.1.454.CMB.2.raw
tcagacatacgcgtcacgaccggtgctcgatttagctagtcactcaagggaaaggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccaggaagcccctaagtcctgatccatgatgcatccactctgcagagtggagtcccatccaggttcagtggcagtgggtctggggacagagttcactctcaccatcaatagtctgcagccagaggacttggaacctactattgccaacagacttacacgtaccccccagttccggcgacgggaccacacgtcgagactacaaacgaactgtaggctcgcaccatctcg

SEQ ID NO: 382908 - DNA, 492 bp, Homo sapiens
  misc_feature: GZ8MTXP02JJ5C9.22.77.G11.1.454.CMB.2.raw
tcagacatacgcgtcacgaccggtgctcgatttagctagtcactcaagggaaaggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccaggagccctaagtcctgatccatgatgcatccactctgcagagtggacgtcccatccaggttcagtgcagtggtctgggacagagttcactctcaccatcaacagtctgcagccagaggactttggaacctactattgaccaacacgacttacacgtaccccccacgttcggcggacgggaccacacgtccgagacacaaacgaactgtcggctggcaccatctcg

SEQ ID NO: 382909 - DNA, 511 bp, Homo sapiens
  misc_feature: GZ8MTXP02IAADX.22.77.G11.1.454.CMB.2.raw
  modified_base (280)..(280): a, c, t, g, unknown or other
  modified_base (300)..(300): a, c, t, g, unknown or other
  modified_base (347)..(347): a, c, t, g, unknown or other
  modified_base (349)..(349): a, c, t, g, unknown or other
tcagacatacgcgtcacgaccggtgctcgatttagctagtcactcaagggaaaggggagtcagtctcagtcaggacacagcatggacatgagggtccccgctcagctcctggggctcctgctactctggctccgaggtgccaggtgtgacatccagatgacccagtctccatcctcccggtctgcatctgttgagaaagatcacatcattgcgggcaagtcagagcattgattatccttttaaactggtatcatcagagaccaggaaggccctaagtccngatccatgatgcatccatcngcagagtggacgtcccatccaggttcagtggcaggtggtctgggacngngttcactctcaccatacaacagtctgcagccagagtactttaggaaccttatattacgacctaacacgacttaacaccgttaccccccacggttaccggccggtacggaccacgacgtacgacgactacgaaacgacgtgtcggactcgcacctactcttcg

SEQ ID NO: 382910 - DNA, 523 bp, Homo sapiens
  misc_feature: GZ8MTXP02II2CF.22.77.G11.1.454.CMB.2.raw
  modified_base (197)..(197): a, c, t, g, unknown or other
  modified_base (334)..(334): a, c, t, g, unknown or other
  modified_base (361)..(361): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttgganaaagatcaccatcacttgtcggcaagtcagagcattgatatcttttaaactgtatcatcagagacaggaacgcccctaagttcctgatccatgatgcatccactctgcagagtggacgtcccatccaggttcagtgngagtggtcgtgggacagagttcactcncacatcaacagtctgcagccgagagtacttaggaaccttatattagaccaacacgtacttacaccgtaccccccacgttccggacggtacggaccacgacgtacgaacgacgtaaaccgaaacgtaacgtaaggtacggactacgaccacctaactcttacg

SEQ ID NO: 382911 - DNA, 525 bp, Homo sapiens
  misc_feature: GZ8MTXP02JOGU7.22.77.G11.1.454.CMB.2.raw
  modified_base (197)..(197): a, c, t, g, unknown or other
  modified_base (359)..(359): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttgganaaagaatcaccatcacttgtcgggcaagtcagagcattgatatccttttaaactggtatcatcagagaccagggaacggcccctaaagttcctgatccatgatgcatccactctgcagagtggacgtcccatccaggttcagtgcgagtgggtcgtgggganagagttcacgtctcaccatacaacagtctgcagccagagtacttaggaacctatattcgaccaacagacttacaccgtaccccccacgtccggacggacgggaccacgacgtcgaacgtacaacgaaacgaaccgtaagacggacgtacgacacccactctttccg

SEQ ID NO: 382912 - DNA, 514 bp, Homo sapiens
  misc_feature: GZ8MTXP02FYSJS.22.77.G11.1.454.CMB.2.raw
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagatcaccatcacttgtcgggcaagtcagagcattgatatccttttaaactggtatcatcagagaccagggagcccctaagttcctgatccatgatgcatccactctgcagagtggacgtcccatccagttcagtggcagtgggtctgggacagagttcactctcaccatcaacagtctgcagccagaggtactttaggaaccttatattgaccaacagacttaccacgtacccccccacgttccggcggacgggaccacgacgtacgacgacgtaaccgaaacgaacgtcgtaggctcgcaaccactctttacg

SEQ ID NO: 382913 - DNA, 524 bp, Homo sapiens
  misc_feature: GZ8MTXP02HJBTM.22.77.G11.1.454.CMB.2.raw
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagatcaccatcacttgtcgggcaagtcagagcattgatatccttttaaactggtatcatcagagaccagggaaggccctaagttcctgatccatgatgcatccactctgcagagtggagtcccatccagttcagtgcgagtgggtcgtgggacaggacgttcgactctccacactcaacagtctcgcacgccaagaggtacgtttacggaaccttactattcgaccaacacgactaaccgaccgtaccccctacgttacggcggacgggaccacgacgtacgaacgactacaaacgacgtaacgcggactcgacaccactcgttc

SEQ ID NO: 382914 - DNA, 507 bp, Homo sapiens
  misc_feature: GZ8MTXP02H3Y6B.22.77.G11.1.454.CMB.2.raw
  modified_base (197)..(197): a, c, t, g, unknown or other
  modified_base (249)..(249): a, c, t, g, unknown or other
  modified_base (283)..(283): a, c, t, g, unknown or other
  modified_base (380)..(380): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttgganaaagatcaccatcacttgtcgggcaagtcagagcattgatatcctttaaacnggtatcatcagagaccagggagcccctaagtccngatcatgatgcatccactctgcagagtgacgtcccatccgagttcagttcgcgtagtgggtctggggacagagttcactctcacatacaacagttcngcacgcagagtacgttacgaactatatacgacaacacgtacttaccacccgtacccccgtacgtccggacggacggaccacgacgacgaacacgacaaacgactcgacgtactcgacactactctcg

SEQ ID NO: 382915 - DNA, 511 bp, Homo sapiens
  misc_feature: GZ8MTXP02JPKJE.22.77.G11.1.454.CMB.2.raw
  modified_base (197)..(197): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttgganaaagaatcaccatcacttgtcggcaagtcagagcattgatatcctttaaactggtatcatcagagaccagggaacggcccctaagttcctgatccatgatgcatccactctgcagagtggacgtcccatccaggttcagtgcaggtggtctgggacagagttcactctcaccatacaacagtctgcagaccagaggtactttaggaaccttactattcgaccaacagacttacaccgtaccccccacgttccggacggacgggaccacgacggtcgacgactacgaaacgaactgtacgctcgacaccatctcg

SEQ ID NO: 382916 - DNA, 580 bp, Homo sapiens
  misc_feature: GZ8MTXP02G7MO0.22.77.G11.1.454.CMB.2.raw
  modified_base (199)..(199): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatccctcccggtctgcatctgttggaanaaagaatcaccatcacttgtcgggcaagtcagagcattgatatccttttaaactggtatcatcagagaccagggaacgcccctaagttcctgatccatgatgcactccactctgcagagtggacgtccatccgaggttcaggtgcgtagtggggtcgtggggacaggtagttcgactctaccaccactcaaactgtctcgcacgaccgagacgtacgtttaacggaacccttaacttagttacgaccaaacgagtaaccttaaccgacccgtaaccccccctacggttaccggaccgggaaccggacccgaacgacgtacgaaacgtacgaaccgtaaacgaaacgtcggtacggactacggaccacctacgtactttccg

SEQ ID NO: 382917 - DNA, 544 bp, Homo sapiens
  misc_feature: GZ8MTXP02HVK98.22.77.G11.1.454.CMB.2.raw
  modified_base (183)..(183): a, c, t, g, unknown or other
  modified_base (198)..(198): a, c, t, g, unknown or other
  modified_base (250)..(250): a, c, t, g, unknown or other
  modified_base (285)..(285): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtntgcatctgttggaanaaagatcaccatcacttgcggcaagtcagagcattgattatccttttaaacnggtatcatcagagaccaggaacgccctaagttccngatccatgatgcatccactctgcagagtggacgtccatccgaggttcaggtggctaggtgggtctggggacaggagttcactctacacatcaacagtctgcacgcagacgtacttacggaacttatattacgaccaacgtaacgaaccttaaccgaacccgttaacccccccgtacggttacccgggacgggaaccggaccacgacgtacggaacgaacgtacgaaaacgacgtaagtcgactacgaccaccatcgtcg

SEQ ID NO: 382918 - DNA, 542 bp, Homo sapiens
  misc_feature: GZ8MTXP02GHDJW.22.77.G11.1.454.CMB.2.raw
  modified_base (353)..(353): a, c, t, g, unknown or other
  modified_base (358)..(358): a, c, t, g, unknown or other
  modified_base (361)..(361): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtcctccatccctcccggtctgcatctgttggaagaaagatcaccatcacttggtcgggacaagtcagagcattgatataccttttaaactggtatcatcagagaccagggaacgcccctaagtcctgatccatgatgcatcccactctgcagagtggacgtcccatcagttcagtgcagtggttcgnggganagngttctactctcaccatacaacatctgcagccgagaggtactttaggaaccttatattacgaccaaacagtaccttaccaaccccgtacccccctacggttacccggacggacgggaccaacgacgtacgtacgactaacgaaacgtaacgtcggtacggcgtacgacaccactcctttacg

SEQ ID NO: 382919 - DNA, 515 bp, Homo sapiens
  misc_feature: GZ8MTXP02ILPL0.22.77.G11.1.454.CMB.2.raw
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagatcaccatcacttgtcgggcaagtcagagcattgatatctttaaactggtatcatcagagacaggagcccctaagttcctgatccatgatgcatcccactctgcagagtggacgtcccatccaggttcagtggcgagtgggtcgtgggacagtagttcactctcacatacaaacagtctgcacgcagaggtacgtttaggaaccttactattcgacctaacagtaccttacaccgtaccccccacgtccggcggaacggaccacgacgtacgaacgacgtaacaaacgaactgtggactcgaccacactcttcg

SEQ ID NO: 382920 - DNA, 551 bp, Homo sapiens
  misc_feature: GZ8MTXP02JGG2P.22.77.G11.1.454.CMB.2.raw
  modified_base (198)..(198): a, c, t, g, unknown or other
  modified_base (290)..(290): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggaanaaagaatcaccatcacttggtcgggcaagtcagagcattgatatccttttaaactggtatcatcagagaccagggaacgcccctaagttccngatccatgatgcatcccactctgcagagtggacgtccatcagttcagtgcagtggtctgggacagagttcactctcaccatcaacagtctgcagaccagacggtacttaggaacctatattacgaccaaacgagtaaccttacgaccgtaaccccccctacggttaccggaccgggaacgggacccgaaacgacggtacgaacgacgtaaccgaaaacgaacgtcggtacggaccttaggacctaaccgtactactttccg

SEQ ID NO: 382921 - DNA, 564 bp, Homo sapiens
  misc_feature: GZ8MTXP02GFHJ0.22.77.G11.1.454.CMB.2.raw
  modified_base (286)..(286): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatccctcccggtctgcatctgttggaagaaagatcaccatcacttgtcgggcaagtcagagcattgatattccttttaaactggtatcatcagagacaggacgcccctaagtccngactccatgatgcatccactctgccagagtcggacgtcccatcctaggttccagttgggcgtaggtggggtcgtaggggacaggagttcacgtctcaccagtacaacagtctgcagaccgagaggtactttagggaaccttactagttacgtaccaaacgacgtaccttaacaccgtaccccccgtacggttccggacgggacggaccgacgacgtacgacggactaaccgaaacgaacgtaagttacggcctacggaccgaccacgttcgtttaccg

SEQ ID NO: 382922 - DNA, 521 bp, Homo sapiens
  misc_feature: GZ8MTXP02JMWWA.22.77.G11.1.454.CMB.2.raw
  modified_base (197)..(197): a, c, t, g, unknown or other
  modified_base (438)..(438): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttgganaaagaatcaccatcacttgtcgggcaagtcagagcattgatatccttttaaactggtatcatcagagaccgaagggaacggcccctaagttcctgatccatgatgctatcccactctgcagagtggacgtcccatccaggttcagtggcgtaggtgggtctggggacaggtagttcactctaccaccatacaacgagtctagcacgacacggagtactttaggaacctactatcgaccaanacactacacctacccccacgtcgcggtacggaccacgacgacgacgactacgaacgaacgtgcgactcgcaccgactcttacg

SEQ ID NO: 382923 - DNA, 550 bp, Homo sapiens
  misc_feature: GZ8MTXP02IQ423.22.77.G11.1.454.CMB.2.raw
  modified_base (197)..(197): a, c, t, g, unknown or other
  modified_base (372)..(372): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttgganaagatcaccatcattgtcggcaagtcagagcattgattattcctttaaactggtatcatcagagaccagggaacgcccctaagttcctgatccatgatgcactcccactctgcagagtggacgtcccatccaggttcagtggcgaggttgggtcgtgggacagtagttcacgtcncacatcaaacagtctgcagaccagagtacgtttcggaaccttattactacgaccaaacgacgtaccttaccaacccgtaccccccgtacggttccggacggtacggacctacgacgtacgacgtacgtaaccaaacggtactcggtacggcttacggaccaacctacgtacgtttccg

SEQ ID NO: 382924 - DNA, 723 bp, Homo sapiens
  misc_feature: GZ8MTXP02F7FR3.22.77.G11.1.454.CMB.2.raw
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgctatcgttggttaggaaagaaagtaactccaacctatacctacgtttgggccggactaacgtcgaaggacgacttaagttagtaacttaacttttaaaccctttttaaaggtaggttactactagtaccgaaggaaccgaaccggaaaggggaaccccgtaccccgtttaaaggttccccgtagtacctacctaagtggtaactcgactacctaccctacttcgtacgacgaggtacggtacggtacccctacccctacgtaccggtaggtttacgaggttcggcgtaggggttcggtacggtaggactaagggttctaccacttcctaccactactaaccaagtcgtactacgacacgaccgaaggtaacgttacggttacggtaaacccttagttactacgaaccctaaagaccgttaacctaccgtaacccccgtacccccgtacgggtaccggacgggtaaaccgaccgaacgacggtaaccgaagtacaaacgaaaccgtaagtcggtacgcaccgacaacgtctacgtttcg

SEQ ID NO: 382925 - DNA, 511 bp, Homo sapiens
  misc_feature: GZ8MTXP02FS539.22.77.G11.1.454.CMB.2.raw
  modified_base (183)..(183): a, c, t, g, unknown or other
  modified_base (197)..(197): a, c, t, g, unknown or other
  modified_base (352)..(352): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtntgcatctgttgganaaagatcaccatcacttgcgggcaagtcagagcattgatatccttttaaactggtatcatcagagaccagggaacgcccctaagtcctgatccatgatgacatcccactctgcagagtggacttcccatcaggttcagtgcagtgggtcgtgganagagttcactctctacatcaacagctgcagcagagacttaggaacctatattacgaccaacagactacaccgtaccccccagtccggacgtacgggaccacgacgtacgacgactacaaacgtaactaaggtcgacgtacgaccacctactccgttacg

SEQ ID NO: 382926 - DNA, 526 bp, Homo sapiens
  misc_feature: GZ8MTXP02GBW1T.22.77.G11.1.454.CMB.2.raw
  modified_base (353)..(353): a, c, t, g, unknown or other
  modified_base (374)..(374): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagatcaccatcacttgtcgggcaagtcagagcattgatatccttttaaactggtatcatcagagaccaggaaggcccctaagttcctgatccatgatgcatccactctgcagagtggactcccatcaggttcagtgcagtgggtctgggacagngttcactctacaccatcaacngtcctgcagaccagacggtactttaggacccttatattcgaccaaacacgtaaccttacacccgtacccccccagttccgggacgggacggaccacgacgtacgaacgtactacaaaacgtaactgtcggacttcgacaacctctactttcg

SEQ ID NO: 382927 - DNA, 489 bp, Homo sapiens
  misc_feature: GZ8MTXP02IILAR.22.77.G11.1.454.CMB.2.raw
  modified_base (346)..(346): a, c, t, g, unknown or other
  modified_base (357)..(357): a, c, t, g, unknown or other
  modified_base (373)..(373): a, c, t, g, unknown or other
  modified_base (469)..(469): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcacatcacttgtcgggcaagtcagagcattgatatcctttaaactgtatcatcagagaccaggaacgccctaagtcctgatccatgatgcatccatctgcagagtgacgtcccatccaggttcagtgcagtggtctgggacngagttcactcncaccatacaacagtcngcagacagagtacgttacgaactatatacacaacgacactacacccgtaccccctacgtccggacggacggacacacgacgaagacaacaaacgangtcgacacgacacactctcg

SEQ ID NO: 382928 - DNA, 626 bp, Homo sapiens
  misc_feature: GZ8MTXP02GE5M3.22.77.G11.1.454.CMB.2.raw
  modified_base (204)..(204): a, c, t, g, unknown or other
  modified_base (292)..(292): a, c, t, g, unknown or other
  modified_base (300)..(300): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtcctccatccctcccggtctgcatctgttggaagaaanaatcaccatcacttgtcgggacaagtcagagctattgatattaccttttaaactggtatcatcagagaccgagggacgccctaagtcngactcatnatgcactccactctgcgagaggtggaccgtcccatccgtaggttcgaggtggcgtagggtcggggtcgtaggggactaggtacgttacacttcctaccaccaactacaacgtacgtctacgacgacgaccgaaggtaacgggttaaccgtttaacgggtaaaccttacgttaacgttaccggaacctaaacctaacgtaaccttaaccgtaacccccgtaccccccgtaacggtcccgggacgggacggaacccgatacggtacgaacgtacgtaaccgaaaacgtaccgtaaggttacggcgtacggaccacctactcgtttccg

SEQ ID NO: 382929 - DNA, 496 bp, Homo sapiens
  misc_feature: GZ8MTXP02FI3B8.22.77.G11.1.454.CMB.2.raw
  modified_base (197)..(197): a, c, t, g, unknown or other
  modified_base (475)..(475): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttgganaaagaatcaccatcacttgtcgggcaagtcagagcattgatatccttttaaactggtatcatcagagaccaggaaggcccctaagttcctgatccatgatgcatccactctgcagagtggactcccatccaggttcagtggcagtgggtctggggacagagttcactctcaccatcaacagtctgcagccagaggacttggacctatattgacaacagacttacacgtaccccccagttcgcggacgggaccacacgtacgagactacaaacgtaacngtacggctcgacaccatctcg

SEQ ID NO: 382930 - DNA, 569 bp, Homo sapiens
  misc_feature: GZ8MTXP02I4DY4.22.77.G11.1.454.CMB.2.raw
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagatcaccatcacttgtcgggcaagtcagagcattgatatccttttaaactggtatcatcagagaccagggacggcccctaagtcctgatccatgatgcatcccactctgcagagtggacgtcccatccgaggttcagtgcaggtgggtcgtggggacaggtagttcactctccacactacaactagtctgcacgccgagaacggtactttaggaaccttacgtacttacggacctaacgacgtaaccttaccgaacccgtaccccccgtaacggttaccgggaccggaacgggacccgaacgacggtacgaacgtacgtaacgaaaccgtaacgtcggtacggcttacggacctacctactacgttccg

SEQ ID NO: 382931 - DNA, 590 bp, Homo sapiens
  misc_feature: GZ8MTXP02FYNAL.22.77.G11.1.454.CMB.2.raw
  modified_base (233)..(233): a, c, t, g, unknown or other
  modified_base (302)..(302): a, c, t, g, unknown or other
  modified_base (423)..(423): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatccctcccggtctgcatctgttggaagaaagatcaccatcacttggcgggacaagtcaganctattgatattaccttttaaactggtatcatcagagaccagggaacgcccctaagtcctgatccatgangacactccactgtacgacgagtaggtacggtaccccgtacctactacgtaggttcgaggtcgcggtagggtcggtcggtacggacgtagttacgtctacctctaccacactacgaacgtancgtcacgacgacgaggtacgttacgttacggtaactatactaccgaactaacacgttaccaaccgtacccccgtaccccgtacggtccgggacggtaccggaaccacgacggtacgacgtactaaacgaacgtaacgtcggacgtcacggaccaactcctacgttcc

SEQ ID NO: 382932 - DNA, 707 bp, Homo sapiens
  misc_feature: GZ8MTXP02HABQ1.22.77.G11.1.454.CMB.2.raw
  modified_base (199)..(199): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtcctccatccctcccggtctgcatctgttgganaaagatcacatcacttgtcggcaagtcagagcattgatataccttttaaactggtatcatcagagaccagggaacgcccctaagttcctgatccatgatgcatcccactctgcaggagtggaccgtcccatccgaggttcaggtcggcgtagggtcggggtcgtagggggactaggtacgtttccaaccttcctaccctaacccacttaccaaaccgtacgttacctacgaccgacgaccccgaggtaaacgggtaccgttttacgggtaaaccccttacgttaagtttaccggaaccctaaaccgtaacgtaaacccgtttaacccgaaccccccggtttaacccccccccgtaaccggggtttacccggggaccccgggggttaaaccggggacccccgaaccggtaaccggttaccggaaacggtaccgttaaaccgaaaaccggtaaaccgttcgggttacggttaccgtacggacccgtaacccgtaccgttacgtttacccg

SEQ ID NO: 382933 - DNA, 579 bp, Homo sapiens
  misc_feature: GZ8MTXP02JEYOA.22.77.G11.1.454.CMB.2.raw
  modified_base (400)..(400): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtcctccatccctcccggtctgcatctgttggaagaaagaatcaccatcacttggtcgggcaagtcagagcattgatattaccttttaaactggtatcatcagagaccgagggaacggcccctaagttcctagatccatgatgacactccactctgcagaggtcggacgtcccatccgaggttcaggtcgcgtgggtggggtcgtgggactagtacgtcactctcaccatcaacngtctgacagccaagacggtacgttacggtaacctattattacgaccaactacgtaaccttaccgaacccctacccccgtacggtaccgggacggaccgggacacgacggtacgacgtactaacgaaaccgtaacgtaacggtaggaccgttacggacctaccgtaacttacggtttccc

SEQ ID NO: 382934 - DNA, 659 bp, Homo sapiens
  misc_feature: GZ8MTXP02J0GZH.22.77.G11.1.454.CMB.2.raw
  modified_base (198)..(198): a, c, t, g, unknown or other
  modified_base (252)..(252): a, c, t, g, unknown or other
  modified_base (288)..(288): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgaccccagtctccatcctcccggtctgcatctgttgganaaagatcaccatcacttgtcgggacaagtcagagcattgatattccttttaaangtatcatcagagacgagggaacgcccctaagttccngatccatgatgcactacccactcgtcgcgaaggagtgggaccccgtccctagtcccgtaaggttcaggttgggcgagggttcggggtctgggggaactaggtagttccgactcctacaccgattacaacgacgtctacgacgacgacccgaaggtacggtaccgtttaagggaaacccttacgttaacttaccggtaaccgaaactaaccggtaaaccttaaccccgtaacccgtttaaccccccccggacggttacccgggaccggggtaaccggggtaaccccaacgtacggtaccggtaacggaacttaaaccgtaaaccggaaacgttcggacggttctacggaccctaccgtaacgttactttccg

SEQ ID NO: 382935 - DNA, 681 bp, Homo sapiens
  misc_feature: GZ8MTXP02I99R9.22.77.G11.1.454.CMB.2.raw
  modified_base (256)..(256): a, c, t, g, unknown or other
tcagacatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatccctcccggtctgcatctgttaggaagaaagatccacatcacttggcgggacaagtcagagcattgattattaccttttaaangtatcatcagacgaccgaaggggaaccgtcccctaaggttccagactccatgatcgactactcccactctgacgaggtaggtcgacccgtacccacgtccgtacggttcaggtcggcggtagggttcggggtccgtagggactaggtacgttccacgttcctacctaccagtaccaagtacgtctagaccgtacgacgacggtaagttacgttaacggaaaccctttacgtaacttacggaacctaaacgtaacgttaacccgtaaccgtaacccccggttaccccccgtacgggttacccgggggacccgggtaaaccgggacccgtaacgtaaccggtaaacggaaccgtaacgtaaaacccggaaccggttaacggtaacggtacggtacccgtacggaccctaacgtcttaccgtttaccg

SEQ ID NO: 382936 - DNA, 533 bp, Homo sapiens
  misc_feature: GZ8MTXP02JSK6K.22.77.G11.1.454.CMB.2.raw
  modified_base (198)..(198): a, c, t, g, unknown or other
  modified_base (231)..(231): a, c, t, g, unknown or other
  modified_base (248)..(248): a, c, t, g, unknown or other
  modified_base (260)..(260): a, c, t, g, unknown or other
tcagacatacgcgtcacgaccggtgctcgatttagctagtcactcaaggggaaagggggagtcagtctcagtcaggacacagcatggacatgagggtccccgctcagctcctggggctcctgctactctggctccgaggtgccaggtgtgacatccagatgacccagtctccatcctcccggtctgcatctgttgganaaagaatcaccatcacttgcgggcaagtcagancattgatatctttaaangtatcatcaganaccgaggacgccctaagttccagatcatgatgcaatccactctgcagagtgaccgtccatccaggttcagtgcgagtggggtcaggggacaggtacgttcacgtctacacatacgaacagtcagcgagaccgagtaggactttacggaaccttatacttagacctaaacacgtaacttaccgaaccgtaccccccgagtccgggacgacggaccaacgacgtacgacgacgtactaaaacgacgtcgtacggctacgaccaccacttctaccg

SEQ ID NO: 382937 - DNA, 532 bp, Homo sapiens
  misc_feature: GZ8MTXP01DX3OD.51.71.G05.1.454.CMB.2.raw
  modified_base (435)..(435): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaacgatatgcttattgtacagcagaagccggcaggccctgtgttggtgatgtaataaagacactgagacggccctagagggactcccgtgacgcgtacttctcgtggctccgaagggtcaaggggacaaacgggtcactagttggcctatcgagtggagtccgaggcgaggaggacgagctgactattatggtacaatcaanagacacattaggtacttatgtcttcggaactgacgacgaagtccacgttccgttgggttccaacgggacccaacggcccaaccccgatcgcgtaacc

SEQ ID NO: 382938 - DNA, 539 bp, Homo sapiens
  misc_feature: GZ8MTXP01BA4KN.51.71.G05.1.454.CMB.2.raw
  modified_base (349)..(349): a, c, t, g, unknown or other
tcagcgatcgtatacacgaccggtgctcgatttagtgtcgtcgcaagagagagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttatggtacagcagaagccggcaggcccctgtgttggtgatgtaataaagacactgagacggcctcgagggactcccgtgacgcgtattctctggcctccgnggtcgaagggacaacgggtcacagttggactatcgagtggacgtccgaggcaggaggacgaggctagactattattgacaatacaacagacacctattcggtacttagtgtctttacggaactcgacgaaccgtaacggttccgaccgttccgtggggtcaacggcccgaacggcccaacccaacgttcg

SEQ ID NO: 382939 - DNA, 503 bp, Homo sapiens
  misc_feature: GZ8MTXP01CTHBS.51.71.G05.1.454.CMB.2.raw
  modified_base (238)..(238): a, c, t, g, unknown or other
  modified_base (312)..(312): a, c, t, g, unknown or other
  modified_base (349)..(349): a, c, t, g, unknown or other
  modified_base (468)..(468): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccgggccaggcccctgtgttggtgatgtataaagacactgagaggccctnagggatccctgagcgacttctctggctccaagggtcngggacaacgggtcacattggccatcagtggagtccaggcagaggacgagggctgactattattggtcaatcaaacagacacattgtactatgtcttgaactgcgacaggtcacgttcgngggttcaagcccaaggcccaacccgctcgctaacc

SEQ ID NO: 382940 - DNA, 495 bp, Homo sapiens
  misc_feature: GZ8MTXP01B2BXW.51.71.G05.1.454.CMB.2.raw
  modified_base (307)..(307): a, c, t, g, unknown or other
  modified_base (464)..(464): a, c, t, g, unknown or other
  modified_base (494)..(494): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtacagcagaagccgggcaggccctgtgttggtgatgtataaagacactgagaggccctnagggatcccgtgagcgtattctctggctccgaaggtcaagggacaacggtcacattggccatcagtggagtccaggcagaggacgaggctgactattatggtacaatcaacagacacattgtacttatgtcttcggaatgcgacaggtcacgttcgngggttcaagcccaagcccacccatcgttcnc

SEQ ID NO: 382941 - DNA, 646 bp, Homo sapiens
  misc_feature: GZ8MTXP01BNP5E.51.71.G05.1.454.CMB.2.raw
  modified_base (222)..(222): a, c, t, g, unknown or other
  modified_base (293)..(293): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtgganatgctattcgacccaaacgatatgactttagtcggtaccagcaagaacggccggcacggccctgtgtggtnatgtaataaagacacgtagagacgccctagagggtactcccgtgacgcgtacttctcgtcggcctccgaaggtacgaagggaacaaacgggtccactagttcggacctagtcaaggtggacgtccgaaggacaagggacggacgtacggctagaacttaagtttagttggtaactaaataccaaacgacgaaccaccgttaagtttacggttaactttaagttcgttccgttaacggaaacgttcgaccgtaaacccgttaaggtacccgtaacccgttccggttcgggttaccaacccgtaccccgaaacggtcccccaaaccccgttacgttccgttaacccgttaacccg

SEQ ID NO: 382942 - DNA, 520 bp, Homo sapiens
  misc_feature: GZ8MTXP01EOK6S.51.71.G05.1.454.CMB.2.raw
  modified_base (236)..(236): a, c, t, g, unknown or other
tcagcgatcgtatacacgaccggtgctcgatttagtgtcgtcgcaagagagagggggtgggtccaggaggtagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgctatggtacagcagaagccggcaggcccctgtgtggtgatgtataaagacactgagaggccctcagggatccctgagcgattcctctggctccaggtcagggcaacggtcacattggccatcagtgagtcaggcagaggacgaggctgactattattgtcaatcaacagacaccatgtactatatcttcgtaactaagcgacaaacggttacgtaccgtccgttcgggttcgacgaacccgaacggaaccgaaccccaccttacgtcgttaacgttcccg

SEQ ID NO: 382943 - DNA, 519 bp, Homo sapiens
  misc_feature: GZ8MTXP01ADWGE.51.71.G05.1.454.CMB.2.raw
  modified_base (237)..(237): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccgggcaggcccctgtgttggtgatgtataaagcactgagaggccctcgagggatcccgtgagcgacttctctggctccaaagggtcaagggacaacgggtcacattcggccatcagtggagtccaggcaggaggacgaggctgacttattatggtacaatcgaaactagacaccattaggtacttatgtcttcggaaactgcgaccaaggtccaaccgttcgttgggttcaacgccaaggcccaacccatcgctaacc

SEQ ID NO: 382944 - DNA, 464 bp, Homo sapiens
  misc_feature: GZ8MTXP01A1E7H.51.71.G05.1.454.CMB.2.raw
  modified_base (244)..(244): a, c, t, g, unknown or other
  modified_base (310)..(310): a, c, t, g, unknown or other
  modified_base (340)..(340): a, c, t, g, unknown or other
  modified_base (387)..(388): a, c, t, g, unknown or other
  modified_base (397)..(397): a, c, t, g, unknown or other
  modified_base (399)..(399): a, c, t, g, unknown or other
  modified_base (407)..(407): a, c, t, g, unknown or other
  modified_base (420)..(420): a, c, t, g, unknown or other
  modified_base (422)..(422): a, c, t, g, unknown or other
tcagcgatcgtatacacgaccggtgctcgatttagtgtcgtcgcaagagagagggggctgtgggtccaggaggcagaactctgggtgtctcaccatggcctggatccctctacttctccccctcctcactctctgcacaggcgtctggaggaccgtcctatgagctgacacagccaccctcggtgtcagtgtccccaggacagacggccaggatcacctgctctggagatgcattgccaaacgntatgcttatgtacagcagaagcggcaggcccctgtgtggtgatgtataaagacactgagaggcctnagggatccctgacgcgattctctggctccnggtcagggacaacggtcacatgcatcagtgatcaggcagagacgagnngatagtatntnatacacanacacatgtatatntntcgatgcgacacgcgcgcgtgtcgcgcacgacaaccaacgtc

SEQ ID NO: 382945 - DNA, 533 bp, Homo sapiens
  misc_feature: GZ8MTXP01DB5FE.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccggcaggccctgtgtggtgatgtataaagacactgagacggccctgagggactcccgtgagcgtacttctcgtggcctccgaagtcaagggacaacgggtcacattggcatcagtggagtcgaggcagaggacgaggctagactagttattggtacaatcaacagacactagttagtacttagtgtcttcggaaactcgacgaaccgttaaggtccaaccgttcgttggggttacaacggacccaacggcccaacccacttcgctaacc

SEQ ID NO: 382946 - DNA, 522 bp, Homo sapiens
  misc_feature: GZ8MTXP01BG6CR.51.71.G05.1.454.CMB.2.raw
  modified_base (240)..(240): a, c, t, g, unknown or other
  modified_base (431)..(431): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggcaggccctgtgtggtgatgtataaagacactgagaggccctgagggactccctgagcgattctctggctccgaaggtcaagggacaacgggtcactagttcgggacctatcgagtggagtccgaggcaggaggacgaggcagactattatggtacaatcaanagacactattagtacttatgtcttcggaactgaccacgaggtcaccgttcgttgggttcaacgcccgaacgcccacccactcgttctaacc

SEQ ID NO: 382947 - DNA, 496 bp, Homo sapiens
  misc_feature: GZ8MTXP01DOHTB.51.71.G05.1.454.CMB.2.raw
  modified_base (240)..(240): a, c, t, g, unknown or other
  modified_base (257)..(257): a, c, t, g, unknown or other
  modified_base (307)..(307): a, c, t, g, unknown or other
  modified_base (317)..(317): a, c, t, g, unknown or other
  modified_base (327)..(327): a, c, t, g, unknown or other
  modified_base (368)..(368): a, c, t, g, unknown or other
  modified_base (379)..(379): a, c, t, g, unknown or other
  modified_base (389)..(389): a, c, t, g, unknown or other
  modified_base (391)..(391): a, c, t, g, unknown or other
  modified_base (401)..(401): a, c, t, g, unknown or other
  modified_base (403)..(403): a, c, t, g, unknown or other
  modified_base (405)..(405): a, c, t, g, unknown or other
  modified_base (407)..(407): a, c, t, g, unknown or other
  modified_base (409)..(409): a, c, t, g, unknown or other
  modified_base (411)..(411): a, c, t, g, unknown or other
  modified_base (420)..(420): a, c, t, g, unknown or other
  modified_base (422)..(422): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaacgntatgcttatggtaccancagaagccggcagccctgtgtgtgatgtataaagacactgagaggccctnagggatcccngagcgattcntcggctcccaaggtcaagggacaacggtcacattggccatnagtgagcgagngagagagagngnatatatgtananananananacatatatntntcgtgtaactcgacgacgacgtacgtaccgttcgttcggcgaacgaccgaaccgacccacccacctcgttcgtc

SEQ ID NO: 382948 - DNA, 603 bp, Homo sapiens
  misc_feature: GZ8MTXP01CPOHD.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggcacggccctgtgttggtgatgtaataaagacactgagacggccctgagggtactccccgtgacgcgaactttctcgtggcctccgaagggtcaagggacaacgggtcactagttcggccatcgagtggaacgtcgagggacaaggacggacgaaggctagactattagttggtactaaatacaacagacacctagttagtacttaagtcgttacttcgggaaacttcggaccgtaaccgaaagggttacccaacccggttccccgttggggttacccaacggtacccccgaaacgggaccccctaaaccccaccgtttcggcccgttaaccccg

SEQ ID NO: 382949 - DNA, 481 bp, Homo sapiens
  misc_feature: GZ8MTXP01CJ9R5.51.71.G05.1.454.CMB.2.raw
  modified_base (241)..(241): a, c, t, g, unknown or other
  modified_base (408)..(408): a, c, t, g, unknown or other
  modified_base (411)..(411): a, c, t, g, unknown or other
  modified_base (413)..(413): a, c, t, g, unknown or other
  modified_base (418)..(418): a, c, t, g, unknown or other
  modified_base (431)..(431): a, c, t, g, unknown or other
  modified_base (433)..(433): a, c, t, g, unknown or other
tcagcgatcgtatacacgaccggtgctcgatttagtgtcgtcgcaagagagagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagcggcaggcccctgtgtgtgatgtataaagacactgagaggccctcagggatccctgacgcgattctctggctccaaggtcaggggacaacggtcacattggccatcagtggagtccaggcagaggacgagctgatatattgtanaananaacanacacatgtatatntntcgatgcgacgacgcgcgttcgtgtcgaacgcacgaccaacccaactg

SEQ ID NO: 382950 - DNA, 516 bp, Homo sapiens
  misc_feature: GZ8MTXP01D8VND.51.71.G05.1.454.CMB.2.raw
  modified_base (316)..(316): a, c, t, g, unknown or other
  modified_base (346)..(346): a, c, t, g, unknown or other
  modified_base (422)..(422): a, c, t, g, unknown or other
  modified_base (424)..(424): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggcaggcccctgtgttggtgatgtataaagacactgagaggccctnagggatccctgacgcgattctctggctccnggtcagggacaacggtcacattggccatcagtggagtccaggcagaggacgagctagactattatgtacaatcaananacacctattgtacttatgtcttcggaacttgcgaaccaagggttccaccgttccgtgggtcaacgacccgaggacccaaccccgcttaaccg

SEQ ID NO: 382951 - DNA, 505 bp, Homo sapiens
  misc_feature: GZ8MTXP01BAN32.51.71.G05.1.454.CMB.2.raw
  modified_base (242)..(242): a, c, t, g, unknown or other
  modified_base (347)..(347): a, c, t, g, unknown or other
  modified_base (424)..(424): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggcaggcccctgtgttggtgatgtaataaagacactgagaggccctgagggactccctgacgcgattctctggctccnggtcagggacacggtcacattggccatcagtggagtccgaggcagagacgagctagactagttatgtcaatcaaacngacacattggtacttatgtctggaactgacgaccaagttcgaccgttcgtggtcaacgccgacggcccaacccgttcgtcg

SEQ ID NO: 382952 - DNA, 521 bp, Homo sapiens
  misc_feature: GZ8MTXP01A9QVZ.51.71.G05.1.454.CMB.2.raw
  modified_base (238)..(238): a, c, t, g, unknown or other
  modified_base (333)..(333): a, c, t, g, unknown or other
  modified_base (520)..(520): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcagggatccctgagcgacttcnctggctccaaggtcgaagggacaacgggtcacagttggccatcagtggagtccaggcagaggacgaggctgactattatggtcaatcaaacagacacctattaggtacttatgtcttcggaacttgcgaccgaaggtccacgttccgttgggttcaacgcccaacggcccacccgactcgttaaccnc

SEQ ID NO: 382953 - DNA, 559 bp, Homo sapiens
  misc_feature: GZ8MTXP01EXBAX.51.71.G05.1.454.CMB.2.raw
  modified_base (312)..(312): a, c, t, g, unknown or other
tcagcgatcgtatacacgaccggtgctcgatttagtgtcgtcgcaagagagagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggcaggcccctgtgtggtgatgtataaagacactgagaggcctnagggactccctgacgcgattctctggcttccgaaggttcgaaggggaccaaacgggttcaaccaagtttcgggccctaatccgaaggtgggagttcccgaagggccaaggagggacgagggtctaggacttaggttatttgtacaatcaaacagacaacctattggtaacttatgtcttcggaactgacgaccgaaaggttcgaccgttcgtgggtcaacgcccaacggcccaaccccgcgtaaccg

SEQ ID NO: 382954 - DNA, 522 bp, Homo sapiens
  misc_feature: GZ8MTXP01DNJKB.51.71.G05.1.454.CMB.2.raw
  modified_base (352)..(352): a, c, t, g, unknown or other
  modified_base (430)..(430): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccgggcaggcccctgtgttggtgatgtataaagacactgagacggccctcgagggactccctgagcgacttctctggctccaagggtcngggacaacgggtcacagttcgggccaatcagtggagtccgaggcagaggacgaggctgactattatggtcaatcaaanagacaccattgtacttatgtcttcggaatcgacgacaaggtcaccgttcgttggcaacgcccgaaggcccaacccttactcgttccgtaacc

SEQ ID NO: 382955 - DNA, 510 bp, Homo sapiens
  misc_feature: GZ8MTXP01BFPGL.51.71.G05.1.454.CMB.2.raw
  modified_base (343)..(343): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggcaggcccctgtgttggtgatgtataaagacactgagaggcctcagggatccctgacgcgattctctggcctcgnggtcagggacacggtcacattgccatcagtgagtccaggcagagacgagctgactattattgtacaatcaacagacacctattggtaacttatgtcttggaactgacgtaccgaaggttccaccgttccgtgggtcaacgcccgaacggacccaaccccaacgtccg

SEQ ID NO: 382956 - DNA, 551 bp, Homo sapiens
  misc_feature: GZ8MTXP01D4Y6M.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtacagcagaagccggccaggccctgtgtggtgatgtataaagacactgagaggccctcgagggactcccgtgacgcgtacttcctcgtggctccgaaggtcgaagggactaacggtacacagttcggaccatcagtggagtccgaggcaggaggacgaggctagactatttatggtacaatacaacgagacacctagttaggtacttatcgttcttcggaaactgccgaacaacgggtcctaaccggttcgttggttccaacggaccccaacggccccaaacccttcgtcgttcgtaaccc

SEQ ID NO: 382957 - DNA, 568 bp, Homo sapiens
  misc_feature: GZ8MTXP01D7O0I.51.71.G05.1.454.CMB.2.raw
  modified_base (283)..(283): a, c, t, g, unknown or other
  modified_base (309)..(309): a, c, t, g, unknown or other
  modified_base (548)..(548): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggcaggccctgtgtgngatgtataaagcactgagacgccctnagggactccctgagcgtattctctggctccgaaggtcaagggacaacgggtcactagttcggccatcgagtggagtccgaggcaaggaggacgaggctagacttattagttggtacaaatacaacacgacacctagttacgtacttatcgttcgttcggaaacttggccgtaaaccgaaggtccgaacccgttcgttcggggttaccaaccggaccccgaaacgggaccccaaaccccncgtaacgttccgttaacccg

SEQ ID NO: 382958 - DNA, 574 bp, Homo sapiens
  misc_feature: GZ8MTXP01COMCZ.51.71.G05.1.454.CMB.2.raw
  modified_base (238)..(238): a, c, t, g, unknown or other
  modified_base (279)..(279): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccggcaggccctgtgtgnatgtataaagcactgagacggccctgagggactccctgagcgtacttctcgtggcctccgaaaggtcaacggggacaacgggtcacagttcggccatcagtggagtccaggcaggacggacgaggctagactagtttatggtacaatacaacgagtacaacctagtttacggtacttaagtgtccgtttacggaaacttcggaccgtaaccgaaacggtcccaaccggttcccgttggggttaccaacggacccccgaaacggacccaacccccgttacttccgttcgtaacccg

SEQ ID NO: 382959 - DNA, 521 bp, Homo sapiens
  misc_feature: GZ8MTXP01DRI96.51.71.G05.1.454.CMB.2.raw
  modified_base (347)..(347): a, c, t, g, unknown or other
  modified_base (512)..(512): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggccccctgtgttggtgatgtataaagacactgagaggccctcagggatccctgacgcgattctctggctcnggtcagggacaacggtcacattggccatcagtggatccaggcagaggacgagctagactagttattgtacaatcaaacagacaaccattggtaacttatgtcttcggaacttgcgaaccgaggttcgccgttacctggggtacaacgcccaacggcccaaccccncgttaaccg

SEQ ID NO: 382960 - DNA, 543 bp, Homo sapiens
  misc_feature: GZ8MTXP01CJLYX.51.71.G05.1.454.CMB.2.raw
  modified_base (239)..(239): a, c, t, g, unknown or other
  modified_base (280)..(280): a, c, t, g, unknown or other
  modified_base (519)..(519): a, c, t, g, unknown or other
  modified_base (534)..(534): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtacagcagaagccggcaggccctgtgttgngatgtataaagacactgagacggccctgagggactccccgtgagcgtactttcctgtgggtcctccgaagggttcgaaggggaccaaacgggttcactagtcgggccagtcaggtggacgtccgaggcgaggaggacgagggctagaacttagttattaggtactaaatccaaacagaaccactagtttagtacttagtgtcttcggaactgaccgtacagtcaccgttcgttggttcngacccaagcccaccnctcgctccg

SEQ ID NO: 382961 - DNA, 520 bp, Homo sapiens
  misc_feature: GZ8MTXP01BDWZJ.51.71.G05.1.454.CMB.2.raw
  modified_base (314)..(314): a, c, t, g, unknown or other
  modified_base (508)..(508): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccgggccaggcccctgtgttggtgatgtaataaagacactgagaggccctnagggatccctgagcgattctctggctccaagggtcaagggacaacgggtcacattggccatcagtggagtccaggcaagaggacgaggctgactattattgggtacaatcaacagacaccattggtacttatgtcttggaacttgacgacaaggtccaaccgttcgttgggttcaacgcccaaggcccaacccnctcgttctaacc

SEQ ID NO: 382962 - DNA, 528 bp, Homo sapiens
  misc_feature: GZ8MTXP01DE21M.51.71.G05.1.454.CMB.2.raw
  modified_base (314)..(314): a, c, t, g, unknown or other
  modified_base (518)..(518): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggcccctnagggatccctgagcgacttctctggctccgaagggtcaaggggacaacgggtcacattggccatcagtggagtcgaggcagaggacgaggctagactattattggtacaatacgaacagaccaccatttacggtacttatcgtcttcggaactgcgaccaaggtccaccgttcgttgggttcaacgacccaaggccccaacccnctcgctaacc

SEQ ID NO: 382963 - DNA, 533 bp, Homo sapiens
  misc_feature: GZ8MTXP01EC30C.51.71.G05.1.454.CMB.2.raw
  modified_base (240)..(240): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggccaggcccctgtgttggtgatgtataaagacactagagaggccctgaggggactcccgtgacgcgacttctcgtggctccaagggtcaaggggacaaacgggtcacattgggcatcagtggagtcaggcaagaggagaggctgactattattggtactaatcaaacagacaccagttagtacttatgtcttcggaactgcgtacccaagggtccaaccgttccgttgggttcaacgcccaaggcccaacccgactcgttcaacc

SEQ ID NO: 382964 - DNA, 595 bp, Homo sapiens
  misc_feature: GZ8MTXP01BA6RH.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgctattcgaccaaacgatatgcttattggtaccagcagacgccggccacggccctgtgtggtgatgtaataaagacacgtgagacggccctagacgggactcccgtgacgcgtacttcgtcgtcggctccgaagggtacgaagggaacaacgggtcactagttcggccatcgagtaggacgtcgaggcaagggaggaacggagggctaggtaacttagtttattggtactaatacaacgaagacaacctagttacggttacttaagtgtcgttacggaactggaccgaccgaaaggtcccaaccgttccgttggggttaccaacggaccccgaacggaccccaacccgttacgtcgttccgttaacccg

SEQ ID NO: 382965 - DNA, 535 bp, Homo sapiens
  misc_feature: GZ8MTXP01CNCCD.51.71.G05.1.454.CMB.2.raw
  modified_base (239)..(239): a, c, t, g, unknown or other
  modified_base (435)..(435): a, c, t, g, unknown or other
  modified_base (491)..(491): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccgggccaggcccctgtgttggtgatgtaataaagacactgagaggccctgagggactcccgtgagcgacttctcgtggctccgaagggtcaagggacaaacgggtcacagttggccatcagtggacgtccgaggcaggaggacgaggctgactattatggtacaatcaaanagacacagttgtacttatgtcttcggaactgacgaaccgaaggtccaccgttccgngggttccaagacccgaacggccccaacccactcgttcctaaccc

SEQ ID NO: 382966 - DNA, 540 bp, Homo sapiens
  misc_feature: GZ8MTXP01D3E3J.51.71.G05.1.454.CMB.2.raw
  modified_base (339)..(339): a, c, t, g, unknown or other
  modified_base (431)..(431): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccggccaggcccctgtgttggtgatgtaataaagacactgagacggcccctgagggactcccgtgagcgtattctntggctccgaaggtcaagggacaacgggtcacagttcggaccatcagtggagtccgaggcaaggaggacgaggcctgaacttattatcggtanaaatcaaacagacacattggtacttatgtcttcggaactgacgacgaagtccaaccgttccgttgggttaccaagaccccaagggccccaacccacgtcgttcctaacc

SEQ ID NO: 382967 - DNA, 742 bp, Homo sapiens
  misc_feature: GZ8MTXP01CZNTJ.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctggagatgcattcgaccaaacgatatgcttattggtaccagcagaagccggcaggccctgtgtggtgatgtaataaagacactgagacgccctcgagggactcccgtgacgcgtacttcctcgtcggcctccgaagggttcgaagggaactaaacgggttcaacgtaagttcgggaccctaatccgtaaggttacggacgttacccgaagggacgaaacgggaacgggaccggaagggtaccgttaggtaaaccttaagtttaacgtttaggggtaaacgtaaaacgttaaccaaaacggtaacgaaaccctaacccgttaagtttaacgggtttaacctttaagttacggttaccgtttaacgggtaaaccgtttcggaacccggtaaacccgttaaacgggtttacccgtaaaccccggttcccggtttacgggggttaccctaaacccgggtaacccccgtaaacggggtaccccccaaaacccccggttacctttaaccgggttaaccccgtttaaaccccg

SEQ ID NO: 382968 - DNA, 500 bp, Homo sapiens
  misc_feature: GZ8MTXP01C2AZP.51.71.G05.1.454.CMB.2.raw
  modified_base (144)..(144): a, c, t, g, unknown or other
  modified_base (238)..(238): a, c, t, g, unknown or other
  modified_base (349)..(349): a, c, t, g, unknown or other
  modified_base (455)..(455): a, c, t, g, unknown or other
  modified_base (472)..(472): a, c, t, g, unknown or other
  modified_base (494)..(494): a, c, t, g, unknown or other
tcagcgatcgtatacacgaccggtgctcgatttagtgtcgtcgcaagagagaggggcacgaccggtgctcgatttagtgtcgtcgcaagagaggagggggggagcctagctgtgctgtgggtccaggaggcagaactctgggtntctcaccatggcctggatccctctacttctccccctctcactctctgcacaggctctgaggcctcctatgagctgacacagcccaccctcggtntcagtcgtcccccaggacagacggccaggatcacctgctctggagatgcattgaccaaaccgatatgctttattgtaccagcagagccggcccacggcctgtcgttggtanatgtaataaagacactgagacgggccctacagggactcccgtgacgcgtaattctcgtggctcaggtcagggacaacggtcacagtgccatcagtgagtccatcgnagagacgagctgacttnttattgacaatacaacagaacncgtaag

SEQ ID NO: 382969 - DNA, 656 bp, Homo sapiens
  misc_feature: GZ8MTXP01CZ1F5.51.71.G05.1.454.CMB.2.raw
  modified_base (286)..(286): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgctattcgaccaaacgatatgtcttatggtaccagcagagccggcacgccctgtgtggtnatgaataaagcacgtgagcggcccctgagggtactcccgtagacgtcgtactttcctcgtggcctccgaagggtcaacggggaacaaacgggtcaactagttcggaccatcgaggtcggacgtccgaaggcaagggacgggacggaggtctaagtaacttagtttacgttaggtaactaaactaaccaaacgtaagtaaccctaaccgttaagtttacggttaactttaagtcgttaccgtttaaccggggaaacttcgggacccggtaaaccgttaacgggttacccctaacccgggttcccgttggggttacccgaacggaccccgaaacgggaccccctaaacccggaccttcggaaccctttcccg

SEQ ID NO: 382970 - DNA, 588 bp, Homo sapiens
  misc_feature: GZ8MTXP01BJDKG.51.71.G05.1.454.CMB.2.raw
  modified_base (241)..(241): a, c, t, g, unknown or other
  modified_base (281)..(281): a, c, t, g, unknown or other
  modified_base (413)..(413): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgcattgaccaaacgntatgcttatggtaccagcagaagccggcagccctgtgtgngatgtaataagacactgagacggcccctagagggactcccgtgacgcgtacttctcgtggctccgaagggtcaagggacaaacggtcactagttcggcatcaggtggacgtccaggacgaggaggacgaggntagactatttacgttagactaaatcaaacgagaccacctagtttacggtaacttaattgttcttaccgggtaaacttcggaccgtaaccgttaacggtcccgtaacccggttccgttacggggttccaacggccccgaaacgggcccccaaacccgacctcgttcccgtaacccg

SEQ ID NO: 382971 - DNA, 524 bp, Homo sapiens
  misc_feature: GZ8MTXP01DPE0V.51.71.G05.1.454.CMB.2.raw
  modified_base (317)..(317): a, c, t, g, unknown or other
  modified_base (347)..(347): a, c, t, g, unknown or other
tcagcgatcgtatacacgaccggtgctcgatttagtgtcgtcgcaagagagagggggctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaccgatatgcttattggtaccagcagaagccgggccaggcccctgtgttggtgatgtataaagacactgagaggccctnagggatccctgacgcgattctctggctccnggtcagggacaacggtcacattggccatcagtggagtccgaggcagaggacgaggctgactagttattgtacaatcaaacagacaccattggtacttatgtctttcgggaaacttgacgtaaccaaggttccgaccgttcccgtgggtcaacggccccaaggcccaacccaacttcg

SEQ ID NO: 382972 - DNA, 604 bp, Homo sapiens
  misc_feature: GZ8MTXP01CZQH1.51.71.G05.1.454.CMB.2.raw
  modified_base (282)..(282): a, c, t, g, unknown or other
  modified_base (325)..(325): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaacgatatgcttattggaccagcagaagccggcagccctgtgtggnatgtaataaagacactagagacggccctacgagggactcccgngacgtcgattctcgtggtcctcccgaaagggtccaaggggaaccaaacgggtcaaacgtagtttcggaccctaaagttccgtaaaggggtcggacgtaccgagggacgaagggacggacggtaggctagtaacttaagttagttacggtaacaaatacaaacgacgaactaacgtagtttacgtacttagtcgttacgtacgaactcgaccgtaacgacggtaccaccgttcgttcggacaaccgacccgaacgacccctaaccgactcgttccgtaac

SEQ ID NO: 382973 - DNA, 540 bp, Homo sapiens
  misc_feature: GZ8MTXP01DSIDK.51.71.G05.1.454.CMB.2.raw
  modified_base (283)..(283): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgaccaaacgatatgcttattggtaccagcagaagccggcagccctgtgtggngatgtataaagacactgagaggccctcgagggatccctgagcgtacttctctggctccgaagggtcaagggacaacggtcacattcggcatcagtggagtccaggcaggaggacgaggctagacttaattattggtacaatacaaacagaccactattaggtacttagtgtcttcgggaaactgacgtaccaaaggtcctaaccgttcgttcggggttaccaacggacccaacggcccaaccccatcgttctaaccg

SEQ ID NO: 382974 - DNA, 675 bp, Homo sapiens
  misc_feature: GZ8MTXP01AZNPK.51.71.G05.1.454.CMB.2.raw
  modified_base (242)..(242): a, c, t, g, unknown or other
  modified_base (259)..(259): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgaccaaacgntatgcttatggtaccancagaacgccgggccacggccctgtcgttggtgatgtaataaagacacgtgacggacggccctgacgggactcccgaggacgacgtacttctcgtcggcctccgaaggtacgaacgggaacctaaacgggtcaacgtacgttcgggacctaacgtccgtaagggttcggaacggttaccggaacgggaccgtaaggggaaccggggtaaacggtacgggacgttacggtaactttaatttagtttacgggttaacaaacgttaccaaacgaaggaccctaaaccttagtttacggttaacttacgttacgttaccgtttacgggaaacttcgacgtaaccgttaacggtccgtaaccgttccgttcggttccgaacgacccgaacggacccctaacccacgttcgttccttaacccg

SEQ ID NO: 382975 - DNA, 663 bp, Homo sapiens
  misc_feature: GZ8MTXP01BM0VM.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgcattcgaccaaacgatatgcttagtggtaccagcagaacgccggcacggccctgtgttggtgatgtaataaagacacgtgagacggtccctagagggactcccgtgacgcgtacttcgtcgtggcctaccgaagggtcgaacggggaccaaacgggtccacgtagttcgggacctagttcgagtggacgtccgaaggcgaaggacggacgaggtcctagaacttatttacgtggtactaaataccaaacgaagacctaaccgtagtttacggttaactttagtacgttacgtttacgggaaaccttcgggaaccgtaaaccgttaaggttacccctaacccgggttccggttacgggggttaccccaaccgggtaaacccccgtaaaccgggcccccctaaaacccccttagttaacccggttcccgttaaccccg

SEQ ID NO: 382976 - DNA, 539 bp, Homo sapiens
  misc_feature: GZ8MTXP01AKZKB.51.71.G05.1.454.CMB.2.raw
  modified_base (238)..(238): a, c, t, g, unknown or other
  modified_base (426)..(426): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtacagcagaagccgggccaggcccctgtgttggtgatgtaataaagacactagagacggccctacgagggactcccgtgacgcgtacttcctcgtggctccgaagggtcgaagggacaacgggtcacagttgggccatcagtggacgtcgaggcaggaggacgaggctgactattntggcaatcaaacgagacacattaggtacttagtgtcttcgggaactgacgaaccgagtccaccgttcgttgggttccaacgcccaacgggcccaaccccgacttcgctaaccc

SEQ ID NO: 382977 - DNA, 614 bp, Homo sapiens
  misc_feature: GZ8MTXP01C2RJY.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggattcctctacttctccccctcctcactctctgcacaggctctgaggcctcctatgagctgacacagccaccctcggtgtcagtgtccccaggacagacggccaggactcacctgctctggagatgcattcgaccaaacgatatgcttattggtaccagcagaacgccgggcaggccctgtgtgtgatgtataaagacacgtgagacggccctcgagggtactcccgtagagcgtacttctcgtggcctcgaagggtacaagggacaaacgggtcaacgtagttcggccagtccgaagtggacgtccgaagggaccgaaggaagggtacgaagggctaggaacttattagttcgggtacaaataccaaacgtagaaccaccgtatttacggtactttatgttaccgttcggaaacgttcgacggtaaaccgaacgggttccacccggttaccgttcgggttccgaaccggaccccgaacggaccccaacccttcgtaaccgttccgttaacccg

SEQ ID NO: 382978 - DNA, 713 bp, Homo sapiens
  misc_feature: GZ8MTXP01CCMJK.51.71.G05.1.454.CMB.2.raw
  modified_base (225)..(225): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagccaccctcggtgtcagtgtccccaggacaggacggccaggatcacctgctcgtgganatgctattcgaccaaaccgatatgcttattcggtaccagcagaagcccggcacggccctgtgtggtgatgtaataaagcacgtagagacggtccctagagggactcccgtgacgtcgtacttctcgtggccctccgaagggtaccgaaggggaacctaaaccgggtcaactagttcgggccctaatccgaaggtcggacgtcccgagggacgaagggacgggaacgagggtcctaggtaaccttaatttacgtttacggtacttaaaacgtaccaaacggaacgaacccgtaactaagtttacgggtaacctttaagttcggttcccggttaaccgggaaaccgttcgggacccggtaaacccggttaaacgggttaccccgtaacccgggttcccgggttacgggggttacccaaccggggtaccccccgtaaacggggaccccccctaaaacccccgttcgtaaccggtttaacccgtaacccccg

SEQ ID NO: 382979 - DNA, 519 bp, Homo sapiens
  misc_feature: GZ8MTXP01A2UV9.51.71.G05.1.454.CMB.2.raw
  modified_base (220)..(220): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatgcattgccaaacgatatgcttattggtaccagcagaagccggcaggccctgtgttggtgatgtataaagcactgagaggccctcgagggactcccgtgagcgattctctggctccgaagggtcaaggggacaaacgggtgacagttcgggccagtcagtggagtccgaggcaggaggacgagggctgaactattatggtcaatcaacagacacattaggtacttatgtcttcggaattcgcgaccaggtcaaccgttcgttgggttcaagcccgaaggcccacccatcgttctaacc

SEQ ID NO: 382980 - DNA, 489 bp, Homo sapiens
  misc_feature: GZ8MTXP01DA6DV.51.71.G05.1.454.CMB.2.raw
  modified_base (236)..(236): a, c, t, g, unknown or other
  modified_base (307)..(307): a, c, t, g, unknown or other
  modified_base (415)..(415): a, c, t, g, unknown or other
  modified_base (477)..(477): a, c, t, g, unknown or other
  modified_base (484)..(484): a, c, t, g, unknown or other
tcagcgatcgtatacacgaccggtgctcgatttagtgtcgtcgcaagagagagggggtgggtccaggaggtagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggccaggcccctgtgtggtgatgtataaagacactgagaggccctnagggatccctgagcgattcctctggctccaggtcagggaacaacgggtcaacattggccatcagtggagtccaggcagaggacgaggctgactattatgtcaatcaanagacacattgtactatgtctcggaatgcacaagttcacgtcttggttcagccagccaacccnttcgtcnctccg

SEQ ID NO: 382981 - DNA, 621 bp, Homo sapiens
  misc_feature: GZ8MTXP01D5H34.51.71.G05.1.454.CMB.2.raw
  modified_base (238)..(238): a, c, t, g, unknown or other
tcagcgatcgtatacacgaccggtgctcgatttagtgtcgtcgcaagagagaggggcacgaccggtgctcgatttagtgtcgtcgcaagagaggaggggggggagcctagctgtgctgtgggtccaggaggcagaactctgggtgtctcaccatggcctggatccctctacttctccccctctcactctctgcacaggctctgaggcctcctatgagctgacacagccaccctcggtntcagtcgtccccaggacagacggccaggatcacctgctctggagatgcattgaccaaaccgatatgcttattggtaccagcagaacgccggcccacggcctgtgttggtagatgtataaagacactgagagccctagagggactcccgtgagcgtattcctcgtcgggcctccgaggttacgaacggggaacgaaaccggggtcaacgtacgtttcgggacccctaagttccgaaacggttggggaaacttcccgaaagttcggaaccgaagggaacggggaaccggaagggtaccgttaagggttaaacccgtttaattttacgtttaagggttaacccaaagtttacccaaaacgaacggtaacccaacccgttttaaagg

SEQ ID NO: 382982 - DNA, 657 bp, Homo sapiens
  misc_feature: GZ8MTXP01CY0AJ.51.71.G05.1.454.CMB.2.raw
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattgtaccagcagaagccggcaggccctgtcgttggtgatgtaataaagacacgtagagacggccctgaacgggattccccgtagacgcgtacttccgtcgtggcctaccgaacgggttccgaaggggaaccctaaacgggtcccacgaacgtttcgggacctaacgtccgaaggttacggaacggttcccgaagggaccgaagggtaacggggacgaacgggccgttagaaccgttaagtttacgtttgggtacaaacgttacaaacacgaaaccacccgtagtttacgggtacttagttcgtaccgtttacggaacttcggaccgtaccaaaggtcctaccgttccgttcggggttaccaacggaccccgaacgggaccccaaaccccgacgttccgttccgttaacccg

SEQ ID NO: 382983 - DNA, 585 bp, Homo sapiens
  misc_feature: GZ8MTXP01ARSTZ.51.71.G05.1.454.CMB.2.raw
  modified_base (244)..(244): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgntatgcttatggtaccagcagaagccggcaggcccctgtgttggtgatgtaataaagacactgagacggcctgagggactcccgtgacgcgtattctcgtggcctccgaaggtcgaagggacaacgggtcaactagttcggacctatcgaggtggacgtccgaggcaggaggacgaggctagtaactatttagtgtacaactacaaacagacctaactagttaggtaactttatcggttcttacggaaatcggaccgtaaaccgtaagggttcccgttaaccgttccggtaacggggtaccaacgggacccccgaaggaccccaaacccgttaacttcccgg

SEQ ID NO: 382984 - DNA, 522 bp, Homo sapiens
  misc_feature: GZ8MTXP01DHXLY.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtaccagcagaagccggcaggcccctgtgtggtgatgtataaagcactgagaggccctgagggactcccgtgagcgtacttctctggctccgaaggtcaagggacaacggtcacattcggcatcagtggagtccgaggcaggaggacgaggctagactattatggtacaatcaacagacactattagtacttatgtctacggaactgcgacaaggtccaccgttccgttgggttaccaacgacccaacggcccaaccccactcgttctaaccc

SEQ ID NO: 382985 - DNA, 510 bp, Homo sapiens
  misc_feature: GZ8MTXP01AVO87.51.71.G05.1.454.CMB.2.raw
  modified_base (241)..(241): a, c, t, g, unknown or other
  modified_base (348)..(348): a, c, t, g, unknown or other
  modified_base (425)..(425): a, c, t, g, unknown or other
  modified_base (506)..(506): a, c, t, g, unknown or other
tcagcgatcgtatacacgaccggtgctcgatttagtgtcgtcgcaagagagagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggccccctgtgttggtgatgtaataaagacactgagaggccctcagggatcccgtgacgcgattctctggctccnggtcagggacaacgggtcacattggccatcagtggagtccaggcagaggacgagctgactagttattgtcaatcaanagaacaccaattggtactatgtcttggaactgacgactaacggttcaccgttctaagggtcaacgcccaaggcccaacccntccg

SEQ ID NO: 382986 - DNA, 565 bp, Homo sapiens
  misc_feature: GZ8MTXP01ANHB0.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggccctgtgttggtgatgtataaagcactgagaggccctgagggactccctgagcgattctcgtggctccaaggtcaagggacaacgggtcacattcggccatcgagtggagtccgaggcaggaggacgagggctgaacgttattattggtacaatcaaactagacacctagttcggtaacttagtcgttacgttacgggtaaactcgttaccgaaaccgaacggttccaacccggttccgttggggttccaacggacccaacgggaccccaaccccacgtcgttccgtaaccc

SEQ ID NO: 382987 - DNA, 626 bp, Homo sapiens
  misc_feature: GZ8MTXP01BSKZL.51.71.G05.1.454.CMB.2.raw
  modified_base (241)..(241): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgaccaaacgntatgcttatgtaccagcagaagccggcaggccctgtgtggtgatgtaataaagcactgagaggccctgagggactcccgtgagcgtacttctgtggctcgtaaggtcgaaggggactaaacgggtcactagttcggacctatcgagtggacgtccgagggcaaggaggacgagggctagaacttatttattaggtacaaattacaaacagaaccaccgtaagtttacgggttacttagttagttccgttacggtaaacgttcggaccgtaaaccggttaacgggtacccgtaaccccggttacccggttcgggggttaccaaccgggaccccgaaaacgggacccccgaaaccccttacgttaaccggttaacccgttaaccccg

SEQ ID NO: 382988 - DNA, 537 bp, Homo sapiens
  misc_feature: GZ8MTXP01EKDYM.51.71.G05.1.454.CMB.2.raw
  modified_base (224)..(224): a, c, t, g, unknown or other
  modified_base (284)..(284): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgcattgaccaaacgatatgcttatggtaccagcagaagccggccaggccctgtgtggngatgtataaagcactgagacggccctgagggactcccgtgagcgtattctcgtggctccgaaggtcgaaggggacaaacgggtcactagttcggccatcagtggagtcgaggcaggaggacgaggctgacttattattggtacaatacaaacagacacctattacggtattatgttcttcggaactgcgaaccgaaggtccaccgttccgttgggttacaacgacccaacggcccaacccactcgttctaacc

SEQ ID NO: 382989 - DNA, 523 bp, Homo sapiens
  misc_feature: GZ8MTXP01C63L0.51.71.G05.1.454.CMB.2.raw
  modified_base (281)..(281): a, c, t, g, unknown or other
  modified_base (487)..(487): a, c, t, g, unknown or other
  modified_base (494)..(494): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtaccagcagaagccggcagccctgtgttggngatgtataagacactgagaggccctgagggactcccgtgagcgtattcctcgtggctccgaagggtcaaggggacaaacgggtcactagttcggccatcagtggagtccaggcaggaggacgaggctgaactatttactggtacaatacaacacgacacagtttacgtacttatgtcttcggaactgccgacaaggtcacgttcgngggttcncgaccaaggcccacccgactcgctaaccg

SEQ ID NO: 382990 - DNA, 642 bp, Homo sapiens
  misc_feature: GZ8MTXP01C59DP.51.71.G05.1.454.CMB.2.raw
  modified_base (240)..(240): a, c, t, g, unknown or other
  modified_base (334)..(334): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgntatgcttatggtacagcagaagccggcaggccctgtgttggtgatgtataaagacatgagacggccctagagggactcccgtgagcgtacttcncgtggcctccgaagggtcgaacggggaacaaacgggtcaacgtagttcggaccatcgaggtgggacgtcgaggacgaaggagggacgaggctacgaacttagttaacttgggtactaaatacgaaacacgaacctacctaagtttacggttaactttagtcgttacgttaaccggtaactcggaccggtaaccgttaaacggggttacctaaccccgggttccgtttacgggggaccctaaccgggtaccccgtaaaaccggggaccccctaaacccccttaccgtttccggttaacccttaaccccg

SEQ ID NO: 382991 - DNA, 806 bp, Homo sapiens
  misc_feature: GZ8MTXP01CINXO.51.71.G05.1.454.CMB.2.raw
  modified_base (223)..(223): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtgganatgcattcgaccaaacgatatgcttattggtaccagcagaacgccggccacggccctgtgttggtgatgtaataaagacacgtagagacggccctagagggtactcccgtaggacgtacgtactttccgtcgtcgggtacccttcccggaaacggggttacgaacgggggaacctaaacccggggtctaaaccgtaacggtttccggggacccctaaagtttacccggaagggtttacggggaaccggttaccccggaaaggggacccggaaggggaaacgggggaaccggacggggtacccgttagggttaaacctttaaagttttaaccgtttagggtaacgtaaaacgtttacccaaaacgaaacggtaaacccctaaacccgttaaggttttaacggggttaaacccttttaagtaccggttttaccgtttaaccgggtaaaaccgttcggttaaccccggtaaacccggttaaacgggttaaccccgtacccgggttaccccggttgggttaccccgaacggacccccgaaacgggtacccccaaaccccgttacgttccggttaaccgttaaccccg

SEQ ID NO: 382992 - DNA, 581 bp, Homo sapiens
  misc_feature: GZ8MTXP01D74TP.51.71.G05.1.454.CMB.2.raw
  modified_base (223)..(223): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattcgaccaaaccgatatgcttatggtaccagcagaagccggcaggccctgtgtggtgatgtaataaagacactagagacggccctagagggactccctggagcgtattcctcgtcggctccgaagggtcgaagggacaacgggtcactagttcgggacctatcgaggtgacgtccgaggcaaggaggacgaggctagaacttatttattggtaacaatcaaacagacacctagtttaggtacttagttagtcgttacggaacttcgacgaccttaaaggtccgtaaccgttccgttgggaccaaccggaccccgaacggacccctaaccccacttaacggttcccttaacccg

SEQ ID NO: 382993 - DNA, 525 bp, Homo sapiens
  misc_feature: GZ8MTXP01C6GRH.51.71.G05.1.454.CMB.2.raw
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttattggtaccagcagaagccgggcaggcccctgtgttggtgatgtaataaagacactgagaggccctgagggatcccgtgagcgtattcgtctggcctccgaaggtcaaggggacaacgggtcacattggccatcagtggagtccgaggcaggaggacgaggctagacttattattggtacaatcaacagacactattaggtacttatgtcttcggaaactgacgacaaggtcacgttccgttgggttcaacgacccaaggcccacccgactcgttctaacc

SEQ ID NO: 382994 - DNA, 575 bp, Homo sapiens
  misc_feature: GZ8MTXP01C1VDK.51.71.G05.1.454.CMB.2.raw
  modified_base (404)..(404): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtaccagcagaagccgggccaggcccctgtgttggtgatgtataaagcactgagacggccctgagggactcctagagcgtacttctctggctcgaaggtcaagggacaacgggtcactagttgccatcagtggatccgaggcagaggacgaggacngaactattattggtacaaatacaaacgagaacacctaattacggtacttaattcgctttaacgggaaactggcccgtaaaccgaaagggttcccaaccgttccgttacggggaccaacgggacccctaaacgggacccccaaaccccgttaccgtcgttcccgtaaccccg

SEQ ID NO: 382995 - DNA, 726 bp, Homo sapiens
  misc_feature: GZ8MTXP01DCBIB.51.71.G05.1.454.CMB.2.raw
  modified_base (343)..(343): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacacgcccaccctcggtgtcagtcgtccccaggacaggacggccaggatcacctgctcgtggagatgctattcgaacccaaacgtatatgtacttagttcggtaccagacagaacgccggcacggccctgtgtgtgatagtaataagacacgtagagacgccctacgagggtactccgngacgcgtacttcgtcgtcggtcctaccggaacgggtaccgaacggggaaaccgtaaaccgggtacaacgtagttcggacactacgaggtaggacgtacggacggacgaagggtacgggacggtacgggcttaacgtaacttaacgtttagttacggggtaaactaaaacttaccaaaacgtaacgaaacctaacccgttaagtttaacgggttaactttagtacgtttaaccggtttaaccgggtaaaccttacggaaccggtaaaccgttaacggggttaccccgtaaacccgggttccgttacgggggaccctaaccgggtaaccccgtaaacccggtacccccaaaacccgttaccgttccggttaaccccttaaccccg

SEQ ID NO: 382996 - DNA, 620 bp, Homo sapiens
  misc_feature: GZ8MTXP01AS4B3.51.71.G05.1.454.CMB.2.raw
  modified_base (223)..(223): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtgganatgctattcgacccaaacgtatatgtctttagttacggtaccagacaaggaacggcccgggccgacggcccctggttggttggtagtagtagtaaataaagacacgtaggaggacggccctacggagggtactcccgtagacgcgtacttcgtcgtcggtcctaccgtaagggtcgaacggggacctaaacgggtccaacgtagttcgggcatcgaggtggacgtcgaggcgaagggaggacggaggtcgtagtaacttagtttattcgggtactaatacaacgagaccaactattaggtacttatcgttacgttcgaaactggaccgaacgacgtaccgtacccgttcgttcggttccaacgacccgaacgaccccacccacgtcgttctaacccg

SEQ ID NO: 382997 - DNA, 753 bp, Homo sapiens
  misc_feature: GZ8MTXP01CSDL3.51.71.G05.1.454.CMB.2.raw
  modified_base (240)..(240): a, c, t, g, unknown or other
  modified_base (280)..(280): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttatggtaccagcagaagccggcagccctgtgtgnatgtataaagcactgagacgccctcgagggactcccgtgacgcgtactttcgtacgtggcctacccgaaagggttacgaacgggggaacctaaaccggggttacaacgtacgtttacgggaccctaagttaccgaagggttacgggaacggttaccccgaaaggggacccgaaaggggtaacggggaaccgaaaggggtcctaacgggtaaactttaaagttttaaagtttacggggtaacctaaaacgttaacccaaaaccgtaacggtaaacccaacccgttaaagtttttaggggtttaaaccctttacgttagttacccgtttaaccggggtaacttcggaaccccgtaaacccgaaacggggttcccctaaacccgggttcccggtttgggggaccctaaccgggaccccccgtaaaccggggaccccccaaaccccgttaacccttcggttaaccccgttaaccccg

SEQ ID NO: 382998 - DNA, 538 bp, Homo sapiens
  misc_feature: GZ8MTXP01B9PE0.51.71.G05.1.454.CMB.2.raw
  modified_base (241)..(241): a, c, t, g, unknown or other
  modified_base (451)..(451): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgcattgaccaaacgntatgcttatgtacagcagaagcggccaggccctgtgttggtgatgtaataaagacactgagacggccctcgagggactccctggagtcgtacttctcgtggcctccgaaggtcgaaggggacaaacgggtcatagttgggaccatcgagtggagtccgaggcaaggacggacgagggactgacttattagttggtacaataccaaacganaacacctagttacgtacttatgtctcggaactgacgacaggtccacgttcgttggttcaacggcccaagcccaacccgctcgcgtcc

SEQ ID NO: 382999 - DNA, 616 bp, Homo sapiens
  misc_feature: GZ8MTXP01EVJTC.51.71.G05.1.454.CMB.2.raw
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgatatgcttattggtaccagcagaagccgggcaggccctgtgtggtgatgtaataaagacactgagacggccctcgagggactcccgtggacgcgtacttcctcgtcgggcctccgaagggtcgaaggggacaaaccgggtcacgtagtttcgggccatcgaggttggacgtccgagggcaaggagggacggaggctgaacttattacttagggtactaaagtaccaaacgacgaacacctaagtttacggttaacttagttcgttaccgttacggaacttcgaccgaaccgttaaacggtcctaacccgttccgttcgggttaccaaccggtaccccgaacgaccccgaaaccccacgttccgttcctaaccccg

SEQ ID NO: 383000 - DNA, 553 bp, Homo sapiens
  misc_feature: GZ8MTXP01CNVNQ.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccgggccaggcccctgtgttggtgatgtataaagacactgagaggccctcgagggactcccgtgagcggtactttcctcgtggcctccgaagggttccgaaggggaccaacgggttcacagttcggccagtcagtggagtccaggcaaggagggacgaggctagactattacttggtcaagtcaaacgagacacctattggtacttagtgtcttcggaactgcgtaccgaggtccacgttccgttgggttccaacgccccgaaggcccctaaccccgactcgcctaaccg

SEQ ID NO: 383001 - DNA, 579 bp, Homo sapiens
  misc_feature: GZ8MTXP01DCVWP.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggcaggccctgtgtggtgatgtataaagacactgagaggccctgagggatccctgagcgtattctctggcctccgaaggtcaagggacaaacgggtcacattcggccatcagtggagtccgaggccgaggacggacgagggctagacttattattggtacaatacaacgagaaccacctagtttacggtacttagttcgttacgttcgggaaacttcggaccgtaacccgaaaggttcccacccggttaccgttggggttaccaacggaccccgaacgggaccccaaccccgacttccgttccgttaaccccg

SEQ ID NO: 383002 - DNA, 535 bp, Homo sapiens
  misc_feature: GZ8MTXP01BGD5O.51.71.G05.1.454.CMB.2.raw
  modified_base (294)..(294): a, c, t, g, unknown or other
  modified_base (347)..(347): a, c, t, g, unknown or other
  modified_base (433)..(433): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggcaggcccctgtgttggtgatgtanaaagacactgagaggccctgagggactcccgtgacgcgattctctggcttcgnggtcagggacaacggtcacgagttcggccatcagtggagtccgagggcaggaggacgagctagacttagttattgacaatcaaacngacactagttggtaacttatgtaacttcggaaacttgaccgtaaccgaggttccgacccgttcgtcggggtcaacgccccaaggccccaaacccgcgttccg

SEQ ID NO: 383003 - DNA, 623 bp, Homo sapiens
  misc_feature: GZ8MTXP01CBCKN.51.71.G05.1.454.CMB.2.raw
tcagcgatcgtatacacgaccggtgctcgatttagtgtcgtcgcaagagagaggggcacgaccggtgctcgatttagtgtcgtcgcaagagaggagggggggggagcctagctgtgctgtgggtccaggaggcagaactctgggtgtctcaccatggcctggatccctctacttcctccccctctcactctctgccacaggctctgacggcctcctatgagctgacacagcccacccgtggtgtcagtcgtccccgaggacagacggccaggactcacctgctctggagatgctattcgacccaaaccgtatatcgtactttaagttcggtaccagacgaagaacgcccgggacccccacgggtcctggttggttggtaagatgtaaataaagacacgtgacgacgccctagacggtctcccgtgacgtcgtattccgtcgtcgccttaccgaggtacgaacggggaacctaacgggttcaacgtagttcggaccctaagtcgaaggtcgtacgtaccagtcggaacgaacggacggtaccggttaggtaccgttagttaacgttactttagtttcggtaaacctaagtaccaaacgttacggtaaccttaaacccgtttaag

SEQ ID NO: 383004 - DNA, 508 bp, Homo sapiens
  misc_feature: GZ8MTXP01BH82I.51.71.G05.1.454.CMB.2.raw
  modified_base (314)..(314): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggaggtgcattgccaaaccgatatgcttattggtaccagcagaagccgggccaggcccctgtgttggtgatgtataaagacactgagacggccctnagggatccctgagcgattcctctggctccaggtccagggcaacggtcacattggccatcagtggagtccaggcagaggacgaggctgactattattgtacaatcaacagacaccattggtacttatgtcttcgatgcgacaggttcaccgtcttgggttcacgcccaaggcccaacccacttcgtcaacgttcc

SEQ ID NO: 383005 - DNA, 676 bp, Homo sapiens
  misc_feature: GZ8MTXP01DTPI8.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctggagatgcattcgaccaaaccgatatgcttatggtaccagcagaagccgggcacggccctgtgttggtgatgtaataaagacactgagacggccctgagggactcccgtagacgcgtacttctcgtggctccgaaaggttcgaaggggaccaaacgggtcaacgtagttcgggacctatccgaggttagggaggtcccgaagggacgaagggaacgggaccggaaggggccttaggtaactttaagttagtttacggggtaacctaaattaccaaaacgtaacggaaccctaacccgtaagtttacgggttaacctttaagttcgttccgtttacgggaaacttcgggaccgtaaaccggttaaacggtacccgtaaccggttcccgttcgggggttacccaacggaaccccgaacgggaccccaaccccttacgtccggttaaccttaacccgg

SEQ ID NO: 383006 - DNA, 538 bp, Homo sapiens
  misc_feature: GZ8MTXP01EWSIU.51.71.G05.1.454.CMB.2.raw
  modified_base (312)..(312): a, c, t, g, unknown or other
  modified_base (334)..(334): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgtctctggagatgcattgaccaaacgatatgcttatggtaccagcagaagccgggccaggcccctgtgttggtgatgtataaagcactgagaggccctnagggatccctgagcgacttctntggctccgaaggtcaagggacaaacgggtcactattcggcatcagtggacgtccgaggcagaggacgaggctgactattattggtacaatcaacagaaccacctattaggtacttatgttcttcggaacttgacgtaccaaggtcctaaccggttccgttggggttccaaggccccaaggcccaaccccgatcgttctaacccg

SEQ ID NO: 383007 - DNA, 571 bp, Homo sapiens
  misc_feature: GZ8MTXP01D3AIG.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgcattgaccaaacgatatgcttattggtaccagcagaagccggcacggccctgtgttggtgatgtataaagacactgagaggccctcgagggactccgtgacgcgtacttctcgtggctaccgaaggtcaagggacaacgggtcacgtattcggcctagtcgagtggacgtccgaggcaaggaggacgagggctagactattacgttggtaacaatcaaacagaaccacgtattacggttacttaagtgttacgttcggaaacttgaccgtacgaaacggtctaacccggttccgttgggttaccaacgacccgaacggccccaaccccatccgttcctaacccg

SEQ ID NO: 383008 - DNA, 629 bp, Homo sapiens
  misc_feature: GZ8MTXP01BSXJ9.51.71.G05.1.454.CMB.2.raw
  modified_base (105)..(105): a, c, t, g, unknown or other
  modified_base (238)..(238): a, c, t, g, unknown or other
  modified_base (562)..(562): a, c, t, g, unknown or other
tcagcgatcgtatacacgaccggtgctcgatttagtgtcgtcgcaagagagaggggcacgaccggtgctcgatttagtgtcgtcgcaagagaggaggggggggancctagctgtgctgtgggtccaggaggcagaactctgggtgtctcaccatggcctggatccctctacttctccccctctcactctctgcacaggctctgaggcctcctatgagctgacacagcccaccgtggtntcagtcgtccccaggacagacggccaggactcacctgctcgtggagatgctattcgaccaaaccgtatatgtactttagttggtaaccagtcgaaggaacggcccgggcccaccggcctggtgttcggtagagttgtaaagtaaaacgacacgtagacggacgtccctacgagggactcccgtgacgcgtaactttcgtacgtcggacctaccgtaacggtacgaacggggaaacgtaaccggttaccgaacgttacgttaccgggacctacgtccgtaaaggtcgggtaacgttccgaagtcgaaccgtaaggacggaccggngtaccgtgttaactttagtttacgttcgtactaaacgtaccaacgacgtaaccttaaccgtttaacg

SEQ ID NO: 383009 - DNA, 595 bp, Homo sapiens
  misc_feature: GZ8MTXP01DGPZ0.51.71.G05.1.454.CMB.2.raw
  modified_base (222)..(222): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattcgaccaaacgatatgcttatggtaccagcagaagccggccaggccctgtgttgtgatgtataaagcatgagagccctgagggactcccgtgagcgtacttctctggctcgaagggttcaagggacaaacggtcaactagttcggcatcgagtggagtccgaggcgaaggagggacgaggacgtgaacttattattggtacaaagtacaaacgacgaacctactagttacggttaacttacgttagttccgttacggaaacgttcggacggtaaacccgaaaggttccctaaccggttccgttcgggttaccgaaccgaaccccgaaccgggaccccaaccccttacgttaacgttccgtaaccccg

SEQ ID NO: 383010 - DNA, 596 bp, Homo sapiens
  misc_feature: GZ8MTXP01DU2V1.51.71.G05.1.454.CMB.2.raw
  modified_base (241)..(241): a, c, t, g, unknown or other
  modified_base (254)..(255): a, c, t, g, unknown or other
  modified_base (274)..(274): a, c, t, g, unknown or other
  modified_base (312)..(312): a, c, t, g, unknown or other
  modified_base (325)..(325): a, c, t, g, unknown or other
  modified_base (581)..(581): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacgccaggatcacctgctctggagatgcattcgaccaaacgntatgcttatgacnncagagcgcagcctgtgtgnatgtaataaagcacgtgagacgccctagaggctcccgngacgcgtacttcncgtggcctccgaagtcgaacgggacgaacggtcaactagttcggaccaatcgagtggactccgaggacgaaggtaggacgaaggtcctagtaaacttagttaactttcggaactaaacgtaaccgaaactaaccggaaacctaccgtaatttaaccggttactttagtacgtttacgttacgggaaacttggaccgaaacttaacgggtcctaaccgttcgttcgggacaacgaccccgaacggaccccaaacccnctcgttccctaaccg

SEQ ID NO: 383011 - DNA, 568 bp, Homo sapiens
  misc_feature: GZ8MTXP01BQQ7G.51.71.G05.1.454.CMB.2.raw
  modified_base (349)..(349): a, c, t, g, unknown or other
  modified_base (559)..(559): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgctattcgaccaaaccgatatgcttatggtacagcagaagccggccaggcccctgtgtggtgatgtataaagacacgtgagaggccctgagggatcccgtgacgcgtattctcgtgctccgnggtcgaacggggacaacgggtcacgtagttcgggcctatcgaggtggacgtccgaggcaggaggacgagctagtactattagttgtacaattacaaactagaaccacctagttcggtacttaatgttaacgttcggaaacttcggaccgaaaccgtaacggttccgcccgttcccgtgggtaccaacgaccccgaaggcccccaaacccncgttaaccg

SEQ ID NO: 383012 - DNA, 609 bp, Homo sapiens
  misc_feature: GZ8MTXP01BJYZK.51.71.G05.1.454.CMB.2.raw
  modified_base (283)..(283): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacgccaggatcactgctctggagatgcattgaccaaaccgatatgcttattgtacagcagaagccggcagcccctgtgtgngatgtataaagacacgtgagacggccctgaggactccctgacgtcgattcgtctcggccttccgaagggtcgaaagggaccaaaccgggttcaacgtagttcgggaccctagttaccgaaggtgggacgtccgaaggcgaggaggacggagtctagacttagttattgtacaatacaaacgagaaccaactagttggtaacctttagtggttaactttacggaaacttcggacgtaaaccgtaacggttacccgttaccggttccgtaacgggttccgaacggaccccgaaccgggacccctaaaccccggttaaccgttaacccg

SEQ ID NO: 383013 - DNA, 688 bp, Homo sapiens
  misc_feature: GZ8MTXP01EOVPN.51.71.G05.1.454.CMB.2.raw
  modified_base (243)..(243): a, c, t, g, unknown or other
  modified_base (282)..(282): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtggagatgcattcgaccaaacgntatgcttatggacagcagagccggcaggccctgtgtggnatgtaataaagcactgagacgccctagagggatcccgtgacgcgtacttcgtcgtcggcctacccgaagggtacgaaggggtaaccaaacgggttccaactagttcgggaccctaatccgtaaggtgggacgtacccgaaggaccgaagggaagggaccggaggtccgttagtaaacttaagtttagtttggtaaactaaattaaccaaaacgtacgtaaacctaacccgttaagtttacgggttaaacctttaagttcggttaccgtttaaccggggaaaccgttcggaaacccggtaaacccgttaaacgggttccccgtaaacccggttcccggttcggggacccaaccggaccccgtaaccgggacccccaaaccccttacgttaaccgttccctaaccccg

SEQ ID NO: 383014 - DNA, 683 bp, Homo sapiens
  misc_feature: GZ8MTXP01BJU1W.51.71.G05.1.454.CMB.2.raw
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcactgctctggagatgcattgaccaaaccgatatgcttattggtaccagcagaacgccggccacggcccctgtgttggtgatgtaataaagacactgagacggcctacgagggactcccgtagacgcgtattctcgtcggacctccgaaggtcgaaggggaccaacgggttcaaccgtagttcgggaccctaagtccgaggtcggacgtacccgaagggccgaaggacgggaaccgaggcgtagtaaccgttaagtttaagtttggtaacctaaagttaccgaaacaaggaaccaaacccgttagtttacgggttaaccttttaagttcggttaaccgtttacgggttaaaccgtttcggaacccggtaaacccgtaacgggttaccccgaacccggtttccgttaacgggggtacccaaccgggtaaccccgaaacgggaccccctaaaaccccgttaaccgttcccgg

SEQ ID NO: 383015 - DNA, 563 bp, Homo sapiens
  misc_feature: GZ8MTXP01DL0D3.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaaccgatatgcttattggtaccagcagaagccggcaggccctgtgttggtgatgtataaagacatgagaggccctgagggatccctgagcgattctctggcctccgaagggtcaagggacaacgggtcacattggccatcagtggagtccgaggcaaggaggacgaagggctgaacttattacgttggtacaagttcaaactagaaccacctaagtttggttaacttattgtccgttcggaaacttggaccgaaccaagggtccacccggttccgttggggttccaacggacccaacgggaccccaaccccacgtcgttcctaacccg

SEQ ID NO: 383016 - DNA, 558 bp, Homo sapiens
  misc_feature: GZ8MTXP01A9PKI.51.71.G05.1.454.CMB.2.raw
  modified_base (351)..(351): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggcaggcccctgtgttggtgatgtataaagacactgagacggccctgagggactcccgtgacgcgattcctctggctccgnggtcgaggggaaccaacgggtcacagtttcggccatcgaaggtggacgtcgaggcaaggaggacgaggctgacttagttattgtacaatacaactagactacctattggttaacttatgtctttacggaaccttggccgaacgaaggttcccgttaccgttccgtgggcaacgaccccgaacggaccccaaccccgttaacgttccg

SEQ ID NO: 383017 - DNA, 529 bp, Homo sapiens
  misc_feature: GZ8MTXP01CI9LE.51.71.G05.1.454.CMB.2.raw
  modified_base (221)..(221): a, c, t, g, unknown or other
  modified_base (238)..(238): a, c, t, g, unknown or other
  modified_base (480)..(480): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgcttatgtacagcagagccggcacgccctgtgtggtgatgtaataaagcactgagaggccctgagggactccctgagcgtacttctcgtggcctccgaagggtcgaagggacaacgggtcactagttcggccaagtcagtggaacgtccgaggcaggaggacgaggctagactattagttggtacaatcaacagacactagttacgtacttatgtcttggaactgaccgacaggtaccncgttcgttcgggttcaacgcccgaaggtcccacccatcgttcctaaccg

SEQ ID NO: 383018 - DNA, 509 bp, Homo sapiens
  misc_feature: GZ8MTXP01B1235.51.71.G05.1.454.CMB.2.raw
  modified_base (238)..(238): a, c, t, g, unknown or other
  modified_base (307)..(307): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggccctgtgtggtgatgtataaagacactgagaggccctnagggatcccgtgagcgtacttctctggctccgaaggtcaagggacaaacggtcacattggccatcagtggagtccgaggcagaggacgaggctgacttagttattggtacaatcaaacagacacctattggtacttatgtcttgaactgcgacagtcacgttcgttgggttcaacgcccaaggcccacccgactcgctaacc

SEQ ID NO: 383019 - DNA, 685 bp, Homo sapiens
  misc_feature: GZ8MTXP01CD5K4.51.71.G05.1.454.CMB.2.raw
  modified_base (240)..(240): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctggagatgcattcgaccaaacgntatgcttatggtaccagcagaagccggcacgccctgtgtggtgatgtaataagcactgagacgccctgaggactccgtagacgcgtacttctcgtggcctcgaaggtcgaagggaccaacgggtcacgtagttcggactatcgaggtcggacgtccgaagggcaagggacggaccggagggtactacggtaacttagtttaacgttacgggtaactaaacgttaccaaacgtacggaaaccctaacccgttaagtttaccggggttaatttaacgttaccggtttaccgtttaacggggaaaaccttcgggttaaacccggtaaacccgttaaacgggttccccgtaacccggttacccggttcgggggttacccctaaccgggaaccccgtaaaccggggaccccctaaaccccgttaacgttcccggttcccgtttaaccccg

SEQ ID NO: 383020 - DNA, 758 bp, Homo sapiens
  misc_feature: GZ8MTXP01CP67G.51.71.G05.1.454.CMB.2.raw
  modified_base (285)..(285): a, c, t, g, unknown or other
tcagcgatcgtatacacgaccggtgctcgatttagtgtcgtcgcaagagagagggggggtgggtccaggaggcagaactctgggtgtctcaacatggcctggatccctctacttctccccctcctcactctcttcacaggctctgaggcctcctatgagctgacacagccaccctcggtgtcagtgtccccaggacagacggccaggatcactgctctggagatgcattgaccaaaccgatatgtcttattgtacagcagaacgccggccaggccctgtgttggngatgtaataaagacactgagacggccctcgagggactccctgagcgtatttccctcgtggcctcccgaggtaccgaacgggaacgtaaaccgggtcaaacgtacgttcggggacccagtaccgtaggttcggggaacgttaccccgaaggggacccgaaagggtaacgggggaaccgggtaagggtcccgtagggtaaaccgtttaactttaaagtttacggttaacgaaaactttaccaaaaaccgtaggaaacccctaaacccgttagttttacgggttaaaccctttagttacggttacccgtttaacgggtaaaccgtaaggtaaccccgggaaacccgtaaaaggggttccccgtaaaccccggggttcccgttacggggggttacccaaacccggtcccccgaaaaaccggggccccctaaaacccccgggtactttacccgggtaacccttaacccgtttcccccg

SEQ ID NO: 383021 - DNA, 591 bp, Homo sapiens
  misc_feature: GZ8MTXP01CNHLK.51.71.G05.1.454.CMB.2.raw
  modified_base (222)..(222): a, c, t, g, unknown or other
  modified_base (240)..(240): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattcgaccaaacgntatgcttattgtaccagcagaacgccgggcacggccctgtgttggtgatgtaataaagacactgaggacggccctagacgggactccccgtagagcgtactttcctcgtggcctcgaacgggtcaaggggacaaacgggtcactagttcggacctatacgaggtggacgtccgaggcgaaggaggacgaggtctagaacttattagttggtacaaagttaccaaagtacgaacctaacctagtttaccggttatttaacgttcgttacgtacggaacttcggaccgtaacgaacggtccaaccggttcgcgggttacaacggacccaacgcccacccacgtcttcgtaacc

SEQ ID NO: 383022 - DNA, 661 bp, Homo sapiens
  misc_feature: GZ8MTXP01D3M46.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccggcacggccctgtgttggtgatagtataaagacactgagacggccctacgagggtactcccgtagacgacgtactttcgtctggcctccgaagggtcgaaggggacaaaccgggttacaacgtagttcgggaccctaagtaccgaggtagggtaacgtcccgaaggaccgaagggaacggggaccggagggaccttagaaactttaatttaacgtttagggtactaaaagttccaaaacacgtaaccgaccttaagtttacggttaacctttaatcggttaccgttaacgggtaactcggaccgtaaaccgttaaacgggtacctaacccggttccgttcggggttaccaaccgacccgaaccggaccccaaaccccgacttcgttccttaacccg

SEQ ID NO: 383023 - DNA, 699 bp, Homo sapiens
  misc_feature: GZ8MTXP01BOL3S.51.71.G05.1.454.CMB.2.raw
  modified_base (242)..(242): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgcattcgaccaaacgntatgcttatggtaccagcagagccggcacgccctgtgtgtgatgtaataaagacacgtgagacggcccctagagggtactccgtgacgcgtacttctcgtggcctccgaagggtcaaggggaccaaacgggtccaacgtagttcgggacctagtacgtaggtacgggacgtcccgaaggacgaagggacgggaaccggagggtactacggtaacttagtttagtttagggtaactaaagttaccaaacgtaacggtaacctaaaccgttaagttttacgggtttaactttaacgttacggttaccgtttaacgggtaaaccgtcggttacccgtaaacccgttaacgggttacccgtaaccccgggtttacccggttcggggttacccgaaaccggtacccccgtaaacgggacccccctaaaccccgttaaccgttccggttaacccctaaccccg

SEQ ID NO: 383024 - DNA, 488 bp, Homo sapiens
  misc_feature: GZ8MTXP01C7Q0D.51.71.G05.1.454.CMB.2.raw
  modified_base (364)..(364): a, c, t, g, unknown or other
  modified_base (464)..(464): a, c, t, g, unknown or other
tcagcgatcgtatacacgaccggtgctcgatttagtgtcgtcgcaagagagaggggcacgaccggtgctcgatttagtgtcgtcgcaagagaggaggggggggagcctagctgtgctgtgggtccaggaggcagaactctgggtgtctcaccatggcctggatccctctacttctccccctctcactctctgcacaggctctgaggcctctatgagctgacacagcccaccctggtgtcagtgtccccaggacagacggccaggatcacctgctctggagatgcattgaccaaaccgataatgacttattggtaccagcagaagccggcccaggcctgtgtgtagatgtaataaagacatgagngccctcagggactccgtgagcgattctctggctccaggtcagggacaaacggtcactatgccatcagtgtagcatgcagaggagagctgagttattattntacaatacaacacgtaacaactaa

SEQ ID NO: 383025 - DNA, 614 bp, Homo sapiens
  misc_feature: GZ8MTXP01A38I7.51.71.G05.1.454.CMB.2.raw
  modified_base (239)..(239): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccggcaggccctgtgttggtgatgtaataaagacactgagacggccctgagggactcccgtgacgcgtacttctcgtggcctccgaaggttcgaaggggacctaaacgggtccaacgagttcgggcctatacgagtaggacgtccgaagggcaaggaggaccggaggtaccgtagaacttaagtttattacggtacaaagttaccaaacagtaaccaacctagtttacggtaacttagtacgttccttacgggaaactcggaccgtaaccttaacgggtcctaacccggttcgttcggggttaccaaccggaccccgaacggaccccaaccccactccgttcgtaaccccg

SEQ ID NO: 383026 - DNA, 599 bp, Homo sapiens
  misc_feature: GZ8MTXP01BNKS9.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccaaaccgatatgcttattggtacagcagaagccggcaggccctgtgtggtgatgtaataaagacactgagaggccctgagggactccctgagcgattctcgtggctccgaaggtcaagggacaacgggtcactagttcggaccatcaggtggacgtccaggcaaggagggacgagggctagacttattattgggtacaatcaaacagaaccacagtttaggtacttagtcgttcgttcgggaaacttggaccgtaacccgttaaaggggtccctaacccggttccgttcgggggttacccaaccgggacccccgaaacggggtacccccaaacccccgttaccgttaaccggttcccgttaaccccg

SEQ ID NO: 383027 - DNA, 591 bp, Homo sapiens
  misc_feature: GZ8MTXP01BG3RW.51.71.G05.1.454.CMB.2.raw
  modified_base (397)..(397): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtaccagcagaagccggccaggcccctgtgttggtgatgtaataaagacactgagacggccctcgagggactccctgagcgtacttctctggctccgaagggtcaagggacaaacgggtcactattggctatcagtggacgtccgaggngacggagggaccgaggctagaacttattacgttgggtactaacttacaaacgaagaccaacctagtttacggttaacttaagttcgttccgtttacgggaaacttcggaccgtaaccgttaaaggtccgtaacccggttcgttcgggttaccaacggcccgaacggaccccaacccacgtcgttccgtaacccg

SEQ ID NO: 383028 - DNA, 602 bp, Homo sapiens
  misc_feature: GZ8MTXP01B4IYY.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctggagatgcattcgaccaaacgatatgcttatggtaccagcagaagccggcacggccctgtgtggtgatgtaataagacacgtgagacggccctgagggactcccgtgacgcgtacttcctcgtggcctccgaagggttcgaacgggaacaaccgggtcactagttcgggacctatcgagtggacgtccgagggcaaggaggacgagctagtacttagttagttggtaactaatacaaacgtagaaccaccgtagttacggttacttagttcgttacgttcgggaacttcggaccgaaccgttaacggtacctaacccggttcggttcgggttaccaaccggacccgaacggaccccaacccgttactcgttccgtaacccg

SEQ ID NO: 383029 - DNA, 650 bp, Homo sapiens
  misc_feature: GZ8MTXP01BWH3S.51.71.G05.1.454.CMB.2.raw
  modified_base (335)..(335): a, c, t, g, unknown or other
tcagcgatcgtatacacgaccggtgctcgatttagtgtcgtcgcaagagagaggggcgtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgcattgaccaaaccgatatgtcttattggtaccagcagaacgccgggccacggcccctgtgttggtgatagtaataaagacactgagacggccctagagggactcccgngacgcgtattctcgtcggctaccgagggtcgaaggggaaccaacgggtccaactacgttcgggacctaatcgaaggttgggacggtacccgaagggaccaaggtacgtaggaaccgggaaggtacctaagtaactttaagtttaatttcggtaaccaaattaccaaacgaacgaactaaccctaagtttacggtaaactttaagttcgttaacgttaacgggttaactacggaccgaaacccgtaaacggttcccgaccgttacccgtgggtacccaaccggaccccgaacggaccccaaaccccttcgtaaccc

SEQ ID NO: 383030 - DNA, 576 bp, Homo sapiens
  misc_feature: GZ8MTXP01AYYWS.51.71.G05.1.454.CMB.2.raw
  modified_base (241)..(241): a, c, t, g, unknown or other
  modified_base (286)..(286): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgntatgcttatggtaccagcagaagccgggcacggccctgtgttggnatgtaataagacacgtgagacggccctgagggactccctgacgcgacttctcgtggctccgaagggtcaagggactaaaccgggtcacgtagttcgggcatcgagtggagtccgaggacgaaggacggacggagggtcctaggtaacttatttacgttagggtactaaacgtaccaaacacgacctacctaagtttacggtactttagtcgttactcggaacttgacggtacagggtccacgttccgttgggaccaacgacccgaagcccacccgttatcgttcctaacc

SEQ ID NO: 383031 - DNA, 529 bp, Homo sapiens
  misc_feature: GZ8MTXP01COD54.51.71.G05.1.454.CMB.2.raw
  modified_base (241)..(241): a, c, t, g, unknown or other
  modified_base (430)..(430): a, c, t, g, unknown or other
tcagcgatcgtatacacgaccggtgctcgatttagtgtcgtcgcaagagagagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggccaggcccctgtgttggtgatgtataaagacactgagacggccctgagggactcccgtgacgcgtattctctggcctccgaaggtcaaggggaccaacgggtcacagttcggaccctatccgagtggacgtccgaggcaggaggacgaggctgactagttnttgctaatacaacacgacacctattggtacttgtcgtcttacgactgcgaaccaggttccacgttccgtgggcaacgccccaggccccaacccgcgtcg

SEQ ID NO: 383032 - DNA, 642 bp, Homo sapiens
  misc_feature: GZ8MTXP01A9J1J.51.71.G05.1.454.CMB.2.raw
  modified_base (225)..(225): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctgganatgctattcgaccaaacgatatgcttattggtaccagcagaacgccggccacggccctgtgttggtgatgtaataaagacacgtgagacggccctcgagggtactcccgtgagctacttctcgtgcctccgaagggtcgaacgggtaacaacggtcactagttcggctagtcgagtcgggacgtaccgaggacgaaggacggacggagggctagtaacttagtttaagttgggtaactaaataccaaacgaacgaaccaaccgtagtttacggttacctttaagttcgttaccgtttacggaacgttcggaaccgtaaccgttaaacggtccgtaacccggttccgttcggggttaccaaccggtaccccgaaaccgggaccccaaaccccggttaccttcggttaaccttaacccg

SEQ ID NO: 383033 - DNA, 632 bp, Homo sapiens
  misc_feature: GZ8MTXP01DDVP9.51.71.G05.1.454.CMB.2.raw
  modified_base (354)..(354): a, c, t, g, unknown or other
  modified_base (484)..(484): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgatatgtcttattggtaccagcagaacgccggcacgccctgtgtggtgatagtaataagacataggagacggtccctagagggtactcccgtgagtcgtacttcgtcgtggccncgaaggtcgaaggacaacggtcactagtcggacctagtcgaggtacggacgtacgacggagaggaacgggacgtacgggacttaggtaacctttagtttacgttacggtaactaaagtacaaaccgtaanaacctaacgtagtttacggttacttagtcgttactaacggtaactacggccgtaaaccgttaacggtccgtaacccgttcggttcgggaccaaccgggaccccaaacgggtacccccaaacccttcggttccgttaacccttaacccg

SEQ ID NO: 383034 - DNA, 732 bp, Homo sapiens
  misc_feature: GZ8MTXP01ET9RF.51.71.G05.1.454.CMB.2.raw
  modified_base (241)..(241): a, c, t, g, unknown or other
  modified_base (310)..(310): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccagatcacctgctctggagatgcattcgaccaaaccgntatgtcttattggtaccagcagaacggcccgggccacggcccgtgtggttggtgatagtaataaagacntgagacggccctacgacgggtactcccgtagacgtcgtacttcgtcgtcggtccctaccgaacgggttacgaacggggtaaccgaaaccgggtcaacgtgtttacggggaccagttacgtaggtcgggacggtaccggaagggacgaacgggacgggacggtaacgggtcgttacggtaactttagttagtttacgggacttaacgtaaccaaacgaacgtaaccctaacccgttaagtttacgggttaactttaacgttcgttaccgtttaacgggtaaaccgttcggaacccggtaaaccggttaaccggttaaccccgggttctttccccgggttaccggttacccgggtaacccgacccgtaacccccggtaaccggtacccccgttaaccccgttaaccggtttcccgttaaccccg

SEQ ID NO: 383035 - DNA, 596 bp, Homo sapiens
  misc_feature: GZ8MTXP01BLK16.51.71.G05.1.454.CMB.2.raw
  modified_base (221)..(221): a, c, t, g, unknown or other
  modified_base (238)..(238): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatgcattgaccaaacgntatgcttatggtaccagcagaagccggcaggcccctgtgtgtgatgtataaagacactgagaggccctgagggatcccgtgagcgtacttctcgtggctccgaaggtcaaggggacaacgggtcacgtagttcgggacctatccgagtagggagtcccgaaggcgaaggagggacgaggggctagacttaatttaagttggtactaattaccgaaacagaacacctagtttaggtactttaagttcgtcgtttacggaacttggttaccgaaccgttaaacggtcccaaccggttccgttggggttaccaacgaccccgaaaggccccaaaccccacgttcgttaacccgttaacccg

SEQ ID NO: 383036 - DNA, 737 bp, Homo sapiens
  misc_feature: GZ8MTXP01EMFXT.51.71.G05.1.454.CMB.2.raw
  modified_base (225)..(225): a, c, t, g, unknown or other
  modified_base (244)..(244): a, c, t, g, unknown or other
  modified_base (259)..(259): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctgganatgctattcgaccaaacgntatgcttatgtacancagaagccggcacggccctgtgttggtgatgtaataaagacactgagacggcccctagacgggactcccgtgacgcgtacttcgtacgtgggtcctacccgaaagggtaccgaagggggtaacctaaaccggggttacaaccgtaacggtttcggggacccctaagtttaccgaacgggttagggtacgtaccccgaaggggacccgtaaaggggaacgggaaccgggaaggggtaccttagggtaaaccttaaagttttactttagggggtaactaaaacgtttaaccgaaaacctaaacggaaacctaaacccgttaaagttttacggggtttaaccttttaaaggttcgttaccgtttaaccgggaaacgttacggacccggtaaaccgttaaacgggttcctaacccggttcggttcgggttacccgaacgtaccccgaacggaccccaacccggactcggttcccttaacccg

SEQ ID NO: 383037 - DNA, 712 bp, Homo sapiens
  misc_feature: GZ8MTXP01DK5G7.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctcccctcctcactctctgcacaggctctgaggcctcctatgagctgacacagccaccctcggtgtcagtcgtccccaggacagaccggccaggactcacctgctctggagatgcattcgacccaaaccgatatgcttatggtaccagcagaagccggccaggcccctgtgtggtgatgtataaagcactgagacggcccctgagggacttccccgtgacgcgtacttcctcgtggcctcccgaagggtccgaacggggaacctaaaccggggtaccacgtaagtttcggggaccctagttccgaaggttcgggaacgttcccgaaggggacgaaacgggaacgggaaccgggagggtaccttagggaaacctttatttaacgtttaggggttaacctaaagttaccaaaacgtacggaacctacccgttaagtttacgggttaacttttaagttcgttccgtttacgggaaacgtttgacccggtaaccgttaaacggtccgtaaccccggttccgggttacgggttacccgaaccggtacccccgtaaacggggccccctaaacccccgaacgtttccggttaaccccttaaccccg

SEQ ID NO: 383038 - DNA, 606 bp, Homo sapiens
  misc_feature: GZ8MTXP01EIVDG.51.71.G05.1.454.CMB.2.raw
  modified_base (239)..(239): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctctatgagctgacacagccaccctcggtgtcagtcgtccccaggacagacggccaggatcacctgctctggagatgcattgaccaaacgntatgcttattggtaccagcagaacgccggcacggccctgtgttggtgatagtaataaagacactagagacggccctagagggactcccgtagacgcgtacttctcgtcggctccgaaggtcgaacgggacaacggtcactagttcggacctatcgaagtggacgtcgaaggcgaaggacggacgagggctagtaacttaattacgtggtactaaatcaaacagacaccgtagtttagtaactttagtagtccgtttcgggaactcggttaccgaaccgttaacgggtccctaacccggttcgttcggggttacccaaccggacccgaaaccggaccccaaaacccgttctcgttaacccgtaacccg

SEQ ID NO: 383039 - DNA, 633 bp, Homo sapiens
  misc_feature: GZ8MTXP01CO8LZ.51.71.G05.1.454.CMB.2.raw
  modified_base (245)..(245): a, c, t, g, unknown or other
  modified_base (290)..(290): a, c, t, g, unknown or other
  modified_base (620)..(620): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtggagatgactattcgaccaaacgntatgtacttagtggtacagcagaacgccggcacgccctgtgtgtnatgtaataagacacgtagaggacggccctgagggtctcccgagacgcgtacttctcgtcggtcctaccggaaggtacgaacgggtaaccaacgggtccaacgtagttcggactagtacgtaggtcggtacgtccgaaggacgaagggacgggaacggtacgggtaccttaggtaactttaagtttacgtttggggtaaaccctaaagttaaccaaacgaacgtaacctaacgttagtttaacggttactttagtcgttacgtacggtaactgaaccgtaccgacgtccgtaccggttcgttgggaccaacggacccaacggccccaaccncgttcgctaaccc

SEQ ID NO: 383040 - DNA, 594 bp, Homo sapiens
  misc_feature: GZ8MTXP01D7BXW.51.71.G05.1.454.CMB.2.raw
  modified_base (240)..(240): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccggccaggccctgtgttggtgatgtaataaagcactgagacggccctgagggactcccgtgagcgtacttctcgtggcctccgaagggtccgaaggggacctaaacgggtcacgtagttcgggaccctatcgaggttggacgtccgaaggcgaaggacgggacgagggctagtaacttatttattgggtaactaatacaacgagaacctacctagttacggttacttagtcgttacgttcggaactgaccgaaccgttaaggtcctaacccgttcgttcggccaacggaccccgaaacggcccctaaacccttcgtcgttcccgtaaccg

SEQ ID NO: 383041 - DNA, 631 bp, Homo sapiens
  misc_feature: GZ8MTXP01COMYV.51.71.G05.1.454.CMB.2.raw
  modified_base (302)..(302): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgctattcgaccaaaaccgatatgcttattggtaccagcagaacggccggacaggcccctgtgttggtgatgtaanaaagacactgagacggccctcgagggactcccgtgagcgtacttctcgtggctaccgaaggtcaagggacaacgggtcacgtagttcggaccatcgagtaggacgtcgaggacgaggaacgggacgagggctagaacttatttacgtttagggtactaaatacaaacgaacgtaaccaaccgttagtttacggttaacctttaagttcgttaccgttacgggaacttcggaccgaaaccttaacgggttacccgaacccggttccgttggggttacccaaccgaccccgaacgggaccccaaacccttccgttaacgttcgtaaccccg

SEQ ID NO: 383042 - DNA, 598 bp, Homo sapiens
  misc_feature: GZ8MTXP01C0VD8.51.71.G05.1.454.CMB.2.raw
  modified_base (282)..(282): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgatatgcttatggtaccagcagaagccggcaggccctgtgttgngatgtataagcacgtgagacggccctgagggactcccgtgacgcgtacttctcgtggcctccgaacgggtcgaacggggaccaacgggtcaacgtagttcgggactatcgaggtggacgtccgaggcgaaggacggacgaggctagacttattagttacggtactaagtacaacgagaaccacgtagttacggtacttagtcgttacttacggaactcggttacgaaccgttaacggtccgtaacccggttccggttgggttaccaaccggaccccgaacgggaccccaaccccgttacgtcgttcccttaacccg

SEQ ID NO: 383043 - DNA, 611 bp, Homo sapiens
  misc_feature: GZ8MTXP01CIJEW.51.71.G05.1.454.CMB.2.raw
  modified_base (183)..(183): a, c, t, g, unknown or other
  modified_base (223)..(223): a, c, t, g, unknown or other
  modified_base (246)..(246): a, c, t, g, unknown or other
  modified_base (356)..(356): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttcctccccctcctcactctctgcacaggctctgaggcctcctatgagctgacacagccaccctcggtntcagtcgtccccaggacagacggccaggatcacctgctcnggagatgcattgaccaaaacgtntatgtctagttgtaccagcagaacgccggcacggcccctgtgtggtgatgtaataagacagtagagacggcctgaggactccgtgacgcgtattcgtctcggcctaccgngtacgaacgggaactaacgggtcaacgtagttacggactagtccgaaggttggacgtccgaaggacgaggaggacgagctagtaacttagttattagtacaactaacaacgaacgaacctaacctaagttacggttaactttacgttcgttaaccgtttaacggaaacttcggaccgtaaacgtaacggttccttaccgttccgtaagggtaccaacggaccccgacggacccctaaccccgttaacgttaaccg

SEQ ID NO: 383044 - DNA, 569 bp, Homo sapiens
  misc_feature: GZ8MTXP01AN3TK.51.71.G05.1.454.CMB.2.raw
tcagcgatcgtatacacgaccggtgctcgatttagtgtcgtcgcaagagagaggggggctgtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctggagatgctattgaccaaaccgatatgcttatggtaccagcagaacgccggccacggcccctgtgttggtgatgtaataagacacgtggagacggccctagagggactcccgtgacgcgtattctcgtcggcctccgaaggtcgaaggggacctaacgggtcacgtagttcggaccctatcgaggtggacgtccgaagggcaggaggacgaggctgaacttagttattgtacaatcaacagacacctattggtacttagtgtctcggaactgaccgaaccgtaggttaccgccgttccgttggggaccaacggccccgaacggacccctaaaccccgcgtaaccg

SEQ ID NO: 383045 - DNA, 530 bp, Homo sapiens
  misc_feature: GZ8MTXP01DZL48.51.71.G05.1.454.CMB.2.raw
  modified_base (521)..(521): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgatatgcttatggtaccagcagagccggcagccctgtgtgtgatgtataagacatgagagccctgagggatccctgagcgtacttctcgtggcctcccgaaagggtcgaaggggacaaaccgggtcacgtattcgggaccagtcgaggtggacgtccgaggacgaaggaggacgaggctagacttattagttggtacaatacaaacagacactattaggtacttagtgtctacggaactgaccgacaaggtcaccgttcgttggcaagaccaacgcccaccntcgctaacc

SEQ ID NO: 383046 - DNA, 588 bp, Homo sapiens
  misc_feature: GZ8MTXP01AX9RU.51.71.G05.1.454.CMB.2.raw
  modified_base (224)..(224): a, c, t, g, unknown or other
  modified_base (291)..(291): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgcattcgacccaaacgatatgcttattggtaccagcaggaagccgggcacggccctgtgttggtnatgtaataaagcactagaggacggccctgagggactcccgtgacgcgtattcctgtgggcctccgaaggtcgaagggactaacgggtcactagttcgggacctagtcgaggtggacgtcccgaggcgaaggagggacgagggactagaacttagtttactgggtacaatacaaacgagaccactagttacggtactttagtgttccgttacggaactggaccgtacgaacggtccaacccgttcgttgggttaccaacgtcccgaacggcccaaccccttagtcgttccgtaacccg

SEQ ID NO: 383047 - DNA, 574 bp, Homo sapiens
  misc_feature: GZ8MTXP01CQVP4.51.71.G05.1.454.CMB.2.raw
  modified_base (290)..(290): a, c, t, g, unknown or other
  modified_base (316)..(316): a, c, t, g, unknown or other
  modified_base (566)..(566): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccacctcggtgtcagtcgtccccaggacagacgccaggatcacctgctcgtggagatgctattcgaccaaacgatatgcttattggaccagcaagaacgccggcaggcccctgtgttggngatgtaataaagacatgagcgacctnaggactcccgtgaacgtcgtattctcgtcgccttaccgaaggtcgaagggaaccgaacgggtacacgtaattcggacctaatcgaaggtgagtccgaggcaggaggacgaggtctagtattattagttcgttaacaattacaaacgacgactaacctagttacggtacttagtgtcgttaacgactagttccgaaacctaagggttcccttacggttccgtcggtcaacgacccgacggacccaaccccngttaaccc

SEQ ID NO: 383048 - DNA, 638 bp, Homo sapiens
  misc_feature: GZ8MTXP01D2O3K.51.71.G05.1.454.CMB.2.raw
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgctattgaccaaaccgatatgtcttatggtacagcagaagccggcacggcccctgtgttggtgatgtaataaagacactgagaggccctagagggtactccgtagacgcggtattcctcgtcggtcctcccgaagggtcgaacgggaacccgtaacgggtcaactacgtttacgggaccctagttaccgtaagggtcgggtacgtacccgaagggaccgaggaacggggaccggaaggtcgtaggtacctttaaggtttagttacggtactaaattaccaaacagaacctaacctagtttacggttacttagttcgttaacgtttacggaactcggttaccgaaccgtaacggttccgttccgttaccggtcggtacaacgacccgacggacccaacccttcgtaaccg

SEQ ID NO: 383049 - DNA, 651 bp, Homo sapiens
  misc_feature: GZ8MTXP01EBI22.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctggagatgctattcgaccaaacgatatgcttattggtaccagcagaacgccgggcacggcccctgtgttggtgatgtaataaagcacgtgagacggccctagagggacttccctgacgcgtacttcctcgtcggctccgaagggttaccgaaggggaacctaaacgggtcactaagttcgggacctagtccgaggtacggacgtcccgaagggaccaagggaacggggaaccgggagggacgttacggtaactttaatttaagtttcggggtaactaaattaccgaaacacgaaccaacctagttttaacgggtactttaagtgttaccgtcggtaaacgttcgaccgaaccgttaaggtaccgtacccgttcggttcggttacgaaccgacccgaacggtaccccaaccccgacttccgttcctaacccg

SEQ ID NO: 383050 - DNA, 685 bp, Homo sapiens
  misc_feature: GZ8MTXP01BB2CB.51.71.G05.1.454.CMB.2.raw
  modified_base (227)..(227): a, c, t, g, unknown or other
  modified_base (360)..(360): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgctattcgaccaaacgatatgcttatggtaccagcagaagccggccacggcccctgtgttggtgatgtaataaagacacgtgagacggccctagacggactccgtgacgcggtattctcgtggacctccgnggtctaaggggaccaacggggttaccacgtaagtttcgggaccctagtccgaggttggacgtcccgaagggcaggagggacgaggaccgtaggtaaccttaatttagttacggttactaaacgttacaaaccgtacggaaccctaacccgttaagttacgggttaactttacgttggtttaaccgttacgggttaaaccgttacggaccgtaaaccccggtaaaagggttccccgaaccccggttaccggttaaccggggttaccgtaaaccgaccccggtaaaccggggaccccccaaaacccccgttaacgtttaacccccgg

SEQ ID NO: 383051 - DNA, 593 bp, Homo sapiens
  misc_feature: GZ8MTXP01AHSMY.51.71.G05.1.454.CMB.2.raw
  modified_base (224)..(224): a, c, t, g, unknown or other
  modified_base (242)..(242): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgcattcgaccaaacgntatgcttattggtaccagcagaagccgggcacggcccctgtgttggtgatgtaataaagacacgtagagacggccctacgagggactcccgtgacgcgtacttctcgtcggcctccgaagggtcgaacgggacgtaacgggtcactagttcgcctatcgaggtggacgtccgaggcaaggaggacgaggctagacttattatggtacaatacaacagaccactagtttagtacttagtcgttcgttacggaacttcgaccgaaccgttaacggtcccgtaaccgttccgttcgggttaccaaccggaccccgaaccggaccccaaccccttacgtccgttaacctaacccg

SEQ ID NO: 383052 - DNA, 696 bp, Homo sapiens
  misc_feature: GZ8MTXP01EIEIK.51.71.G05.1.454.CMB.2.raw
  modified_base (240)..(240): a, c, t, g, unknown or other
  modified_base (287)..(287): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcactgctctggagatgcattgaccaaacgntatgctttatggtaccagcaggaacgccggccaggccctgtggttgnatagtaataaagcactgacgacggcccctgagggtactcccgtagacgtcgtacttccgtcgtggccttaccggaaagggttccaacgggggtacctaaaccggggtacaacgtaaggttcgggaccttaaagttccggagtagggtacgtaccgagggacgaagggagggacgtagggacctagtaacgttaatttagttacgggtaacctaaagttactaaaccgaaaggtaacctaccgtttagtttaacgggttaacctttaagttcgttaccgttaacggtaaacgttacggaccgtaaaccgttaacggtacccgtaacccggttccggttacgggacccaacccggtaaccccgtaaccgggaccccctaaccccttaacggttccgttccccgtttaaccc

SEQ ID NO: 383053 - DNA, 585 bp, Homo sapiens
  misc_feature: GZ8MTXP01D867G.51.71.G05.1.454.CMB.2.raw
  modified_base (239)..(239): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatgtacagcagagccggcaggccctgtgtgtgatgtaataagacactgagacggccctgagggactcccgtgacgcgtacttctcgtggcctccgaaggtcgaagggacaacgggtcactagttcggcatcagtggagtccgaggcaaggaggacgagggctagaacttagttattggtacaatacaacacgaacacctagttacggtacttagtgtcttacgggaaacttcggaccgaaccgttaacggtccctaacccggttccgttcggggttaccaaccggacccccgaaacgggacccccaaacccccgttacttcggttaacccgttaacccg

SEQ ID NO: 383054 - DNA, 640 bp, Homo sapiens
  misc_feature: GZ8MTXP01B4VCF.51.71.G05.1.454.CMB.2.raw
  modified_base (242)..(242): a, c, t, g, unknown or other
  modified_base (293)..(293): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgaccaaacgntatgtcttatggtaccagcagaagccggcacggccctgtgtgtgatgtaanaagacactgagacggccctagagggtactcccgtggacgtcgtactttcgtcgtcggtcctaccgaagggttacgaacggggaacctaaaccgggtcaacgtagtttcggaccagtacgaggtggacgtccgaaggacgaaggacgggacggaggctagtacttattagttgggtaacaataccaaacgaacgtacctaaccgtagtttacggttactttagtacgtttaccgttacggtaacgttacgaccgtaaaccgttaacggttacccgtaaccggttccgttcgggacctaaccggacccgaaccggaccccaacccgttacgtccgttaacctaaccccg

SEQ ID NO: 383055 - DNA, 564 bp, Homo sapiens
  misc_feature: GZ8MTXP01DOD8E.51.71.G05.1.454.CMB.2.raw
  modified_base (413)..(413): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgctattcgaccaaacgatatgcttattgtaccagcgagacgccggcacggccctgtgtgtgatgtataaagacatgagcgccctgagggatcccgtgagcgtacttctgtcggcctcgaagggtacgaagggacctaacggtcactagttcggacctatcgagtggacgtcgaggacgagaggacgnggctagtatatttattaggtacatacaacgagacctactagtagttacttagtcgttcgttagaactcgacgtaaccgttacggtccgtaccggttcgttcgggttaccaacggaccccgaacggaccctacccacgttcgttcctaaccg

SEQ ID NO: 383056 - DNA, 660 bp, Homo sapiens
  misc_feature: GZ8MTXP01C9PY0.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctctcactctctgcacaggctctgaggcctcctatgagctgacacagcccaccctcggtgtcagtcgtccccaggacagacggccaggatcacctgctctggagatgcattcgaccaaacgatatgcttattggtaccagcagaacgccggcacggccctgtgtggtgatgtaataaagacactgagacggtcccctagagggtactcccgtagagcgtacttcgtcgtggtcctccgaagggtacgaaggggaccaacgggtacacgagttcggacctatcgaggtggacgtaccgaggacaaggacgggacgtaggaccgtagtaacgttaatttacgtttgggtaactaaacgttaacaaaacgacgtaaaccaccgtaagttttacggtaactttagttacgttaccgtttaccggaaacttcggaaccgtaaccgttaacgggttaccctacccggttaccggttcgggaccaacccggtacccccgaacgggtaccccccaaacccttaccgttccggttaacccgttaaccccg

SEQ ID NO: 383057 - DNA, 509 bp, Homo sapiens
  misc_feature: GZ8MTXP01D81MW.51.71.G05.1.454.CMB.2.raw
  modified_base (346)..(346): a, c, t, g, unknown or other
  modified_base (396)..(396): a, c, t, g, unknown or other
  modified_base (424)..(424): a, c, t, g, unknown or other
  modified_base (432)..(432): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaaccgatatgcttattggtaccagcagaagccggcaggcccctgtgtggtgatgtataaagacactgagaggcctcagggactccgtgacgcgattctctggctccnggtcagggacaacggtcacattgcatcagtgagtcaggcagagacgagcngactagttatgtcaatcaacagacaacntgtactangtcttcggaaactgcgaccgaaggttcaccgttccgtgggtccaacgaccccgaaggaccctaacccccaagttccg

SEQ ID NO: 383058 - DNA, 628 bp, Homo sapiens
  misc_feature: GZ8MTXP01CFTVM.51.71.G05.1.454.CMB.2.raw
  modified_base (224)..(224): a, c, t, g, unknown or other
  modified_base (243)..(243): a, c, t, g, unknown or other
  modified_base (282)..(282): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtgganatgctattcgaccaaacgntatgcttagtggtacagcagacgccggcagcctgtgtgngatgtaataaagcacgtgacgacggccctagagggactccgtgacgcgtacttccgtcgtggcctcgaaaggtcgaaggggacaaacgggtcaacgtagtcggcctaagtcgagtggacgtccgaggacgaaggtacgggaacgagggactagtaacttatttacgttacggtactaaataccaaacgtaacgaacctacgtaagtttacggtactttaagtcgttacgttacggaaacttcgaccgtaaaccgaacggttaccgacccgttccggttacggggttacccaacggtaccccgaaaccggtaccccaaaccccgttacgttcgttaaccttaacccg

SEQ ID NO: 383059 - DNA, 582 bp, Homo sapiens
  misc_feature: GZ8MTXP01DNJ5X.51.71.G05.1.454.CMB.2.raw
  modified_base (237)..(237): a, c, t, g, unknown or other
  modified_base (573)..(573): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctcccctcctcactctctgcacaggctctgaggcctcctatgagctgacacagccacctggtgtcagtgtcccaggacagacggccaggatcactgctctggagatgcattgaccaaacgntatgcttatggtaccagcagaacgccggcaggcccctgtgttggtgatgtaataaagacacgtgagacggccctgagggactccctgacggctattctcgtggccttcccgaagggtcaaggggaacctaacgggtcaactagttcggacctataccgaggtggacgtccgaggcgagaggacgagctagtaacttagtttattagactaaatcaaacagaaccaacctagtttcggtaccttagtcgttaaccgttacgggaaactcggaccgtaacgtaaggttacccgaccgttccgtcgggtaccaacgtaccccgaacggaccccaacccncgttaaccg

SEQ ID NO: 383060 - DNA, 746 bp, Homo sapiens
  misc_feature: GZ8MTXP01COE1O.51.71.G05.1.454.CMB.2.raw
  modified_base (224)..(224): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtgganatgctattcgaccaaacgattactgcttagttcggtaccagcaagaacggcccgggccgacggcccctggtcggttggtagagtgtaaataaacgacacgtagaggacggccctacgagggtactcccgtggaacgcgtaccgtttccgtacgtcggtacctccggtaaacgggttaccggaacggggaaacctaaaccggggtaccacgtaagttcgggacctacgtacgacggttacggacgtaccgacgggaccgaaaggtacggggaacggacgggtaccgtaaggtaacttaagtttacgttaggggtaaactaaacttacgaaacgtaacgaactaacccttagtttacgggtaacctttagtacgttaccgttacggtaacttcggaccgtaaacccgttaagggttaccccgaacccggttcccggttacggggttacccgaacccggtaccccgaaacccggggtaacccccaaaccccgttaccggttaaccgttaacccgtttaacccccg

SEQ ID NO: 383061 - DNA, 560 bp, Homo sapiens
  misc_feature: GZ8MTXP01BHSEZ.51.71.G05.1.454.CMB.2.raw
  modified_base (333)..(333): a, c, t, g, unknown or other
  modified_base (347)..(347): a, c, t, g, unknown or other
  modified_base (360)..(360): a, c, t, g, unknown or other
  modified_base (429)..(429): a, c, t, g, unknown or other
  modified_base (543)..(543): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccgggccaggcccctgtgttggtgatgtataaagcactgagagccctgagggactcctgagcgtattctntggctccaaggtcngggacaacgggtnactattcgggacctagtcagtggacgtccgaagggcaggaggacgagggctgaacttattagtcggtanaatcaaactagaccaccgtattcggttacttagtcgtcgttcggaaacttggaccgtaaacgacggtccgtaacccgttcgttcgggttccaacgccccgaaggccccaacccnctaacgttcctaacccg

SEQ ID NO: 383062 - DNA, 532 bp, Homo sapiens
  misc_feature: GZ8MTXP01ED6FU.51.71.G05.1.454.CMB.2.raw
  modified_base (500)..(500): a, c, t, g, unknown or other
  modified_base (506)..(506): a, c, t, g, unknown or other
  modified_base (524)..(524): a, c, t, g, unknown or other
  modified_base (529)..(529): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtcccccaggacagacggccaggatcacctgctctggagatgcattgaccaaacgatatgcttatggtaccagcagagccggcaggccctgtgtgtgatgtataaagacactgagaggcccctgagggactcccgtgagtcgtacttctcgtggcctccgaagggtacaaggggacaaacgggtcacagttggcctatcgagtggagtccgaaggcgaagaggacgagggctagaacttattattaggtacaaatacaaacagacaactattacggtattatgtcttcggaactgcgacaaggtccacgttcgnggttcngacccaatcgacccaccncgttntcc

SEQ ID NO: 383063 - DNA, 710 bp, Homo sapiens
  misc_feature: GZ8MTXP01EZ32D.51.71.G05.1.454.CMB.2.raw
  modified_base (292)..(292): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgatatgtcttatcggtacagcagacgccggcacgccctgtgtggtgatgtaanaagacacgtagagacggtccctagacgggactcccgtaggacgtcgtactttccgtcgtcggtcctacccgaaagggttaccgaacggggaaaccgtaaaccgggtccaacgtaagtttcgggacctagtccgaggttcgggaacgtaccgaggacgaagggacgggaacggacgggacttacgtaactttaagtttacgtttacggggtaactaaacgttaaccaaaccgaacgtaaccctaaccgttaaggtttacggtttaaacctttagttacgttaccgttaacgggtaaaccttcgggacccgtaaaccgttaaacgggtaccgtaaccccggttccggttcggggttacccgaaccggaccccgaaccgggaccccaaaccccgttacgttccgttaacccgttaaccccg

SEQ ID NO: 383064 - DNA, 590 bp, Homo sapiens
  misc_feature: GZ8MTXP01ESU09.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgatatgcttattggtaccagcagaagccgggccaggcccctgtgttggtgatgtataaagacactgagaggccctacgagggactcccgtgacgcgtacttctctggctccgaaggtcaagggacaacggtcactagttggccatcgagtggagtccaggcagaggacgaggctgaactattatggtacaatcaacagaacacctaagtttacggtactttaagtcgttcttacggaacttcggaccgaaccgttaaacgggtcctaacccggttccgttcgggttacccaacggtaccccgaaacgggccccctaaaccccgttacgttccggttaacccttaaccccg

SEQ ID NO: 383065 - DNA, 616 bp, Homo sapiens
  misc_feature: GZ8MTXP01ANEBY.51.71.G05.1.454.CMB.2.raw
  modified_base (239)..(239): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctggagatgcattcgaccaaacgntatgcttattggtaccagcagaacgccggccgacggccctggtgttggtagattgtaataaagacacgtagagacggccctacgacggggtactcccgtaggacgtcgtacttcctgtcggtcctccgaagggttacgaacgggaaccaacgggtcaacgtacgttcgggacctagtcgaggtaggacgtccgaaggcgaagggagggacgagcgtagtaacttagttattcggtacaatacaacgagacctaacgtagtttacggtacttagtcgttacgttacggaaacttggaccaacgttaacgtccgtaaccgttccgttggttacccgaacgacccgaacggcccaaccccgttatccttccgttaacccg

SEQ ID NO: 383066 - DNA, 587 bp, Homo sapiens
  misc_feature: GZ8MTXP01D6G70.51.71.G05.1.454.CMB.2.raw
  modified_base (284)..(284): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgatatgcttatggtaccagcagaagccggcacggccctgtgtgngatgtaataaagacactgagacgccctgagggactcccgtagagccgtattcctcgtggcctccgaagggtcaagggactaacggtcactagttcggctatcgaggtggacgtccgaggcgaaggaggacggagctagacttattacttggtacaatacaacagactacgtattaggttacttagtcgttcgttcggaaacttcggaccgtaaccgttaacgggtaccgtaacccggttccgttgggttacccaaccggacccgaaccggaccccaaccccgttacttccgttccttaacccg

SEQ ID NO: 383067 - DNA, 584 bp, Homo sapiens
  misc_feature: GZ8MTXP01CFSSH.51.71.G05.1.454.CMB.2.raw
  modified_base (239)..(239): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggccacggcccctgtgttggtgatgtataaagcactgagacggccctgagggactccctgacgcgtacttctcgtggcctccgaagggtcaaggggacaacgggtcactagttcgggaccatcgaggtcggacgtccgagggcaggaggacgaggctgacttagttattggtactaaagtccaaacgagaccacctagtttacggtactttaagtcgttcgttacggaacttggaccgaaccgttaaggtccctaccggttccgttggggcctaacggccccgaacggccccaaccccgacttcgttcccgtaacccg

SEQ ID NO: 383068 - DNA, 519 bp, Homo sapiens
  misc_feature: GZ8MTXP01AEOU1.51.71.G05.1.454.CMB.2.raw
  modified_base (225)..(225): a, c, t, g, unknown or other
  modified_base (243)..(243): a, c, t, g, unknown or other
  modified_base (280)..(280): a, c, t, g, unknown or other
  modified_base (289)..(289): a, c, t, g, unknown or other
  modified_base (310)..(310): a, c, t, g, unknown or other
  modified_base (321)..(321): a, c, t, g, unknown or other
  modified_base (328)..(328): a, c, t, g, unknown or other
  modified_base (387)..(387): a, c, t, g, unknown or other
  modified_base (403)..(403): a, c, t, g, unknown or other
  modified_base (411)..(411): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggcaggatcacctgctctgganatgctattgaccaaacgntatgcttatgtacagcagagccggcagccctgtgtgnatgtataanacatgagcgcctgaggctccngcgctatctcngcctcgnggtcgacgggacacgtcactagttcgcctatcgagtggacgtcgaggcaggacggacgngctgactagttatgtnaagtcaanacgacacctagttacggtactactatcgtcgttacggtaacttcggacgtaaccgacggttccacccggtcgtcggtaacaccgacccgacggccccaacccgtaacg

SEQ ID NO: 383069 - DNA, 568 bp, Homo sapiens
  misc_feature: GZ8MTXP01BLNNN.51.71.G05.1.454.CMB.2.raw
  modified_base (240)..(240): a, c, t, g, unknown or other
  modified_base (277)..(277): a, c, t, g, unknown or other
  modified_base (468)..(468): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatgtacagcagagccggcagccctgtgtgnatgtataagacactgagaggccctgagggactcccgtgagcgtattctcgtggctcccgaaggtcaaggggacaacgggtcaacagttcggacctaatcgagtggacgtccgagggacaaggagggacgaggctagacttaagttacttgggtacaaagtacaaacgagaaccactaagttggttaacttntagttcttcggaaactcggacgtaaccgaaaggtccgtaaccggttccgttacgggttcaacggccccgaacggacccaaccccacttcgttcctaaccg

SEQ ID NO: 383070 - DNA, 718 bp, Homo sapiens
  misc_feature: GZ8MTXP01BIKZG.51.71.G05.1.454.CMB.2.raw
  modified_base (242)..(242): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcattcgaccaaacgntatgtcttattggacagcagacgccggcacgccctgtgttggtgatgtaataaagacactagagacggccctcgaagggactcccgtaggacgcgtactttcctcgtcggcctaccgaacggtacgaaggggaacctaaaccgggtcaacgtacgtttcgggactaacgtacgaggtacggacgtccgacggacgaagggagggaaccgagggtccgtaaggtactttaagtttagttacggggtaactaaacgttaccaaaacgaaacgaacccgtaaccgtttaaggtttaacgttaaacgttttaacgttaccggtttaaccgtttaccgggtaaaccgttcgttaaaccgggtaaacccgttaaacggttacccgtacccggttaccggttcggggttacccgaacccgggtaaccccgtaaaccgggtacccccaaaccccgttacgttaacccgttcccgtttaaccccg

SEQ ID NO: 383071 - DNA, 641 bp, Homo sapiens
  misc_feature: GZ8MTXP01EQIQE.51.71.G05.1.454.CMB.2.raw
  modified_base (228)..(228): a, c, t, g, unknown or other
  modified_base (289)..(289): a, c, t, g, unknown or other
  modified_base (297)..(297): a, c, t, g, unknown or other
tcagcgatcgtatacacgaccggtgctcgattttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatccacctgctcgtgganatgcattcgaccaaacgatatgacttatggtacagcagacgccggcacggccctgtgtggngatagtanaaagacactagacgacggcccagaggtactccctagacgacgtacttcgtgtcggcctccgaagggtcgaacgggtacaacgggtccactagttacggactatcgtaggtcggacgtcgaggacgaaggacgggacggaggctagtaacttaagttagttagggtaactaagtaacaaacgaacgaacctaaccgtagtttacggttaacttacgttacgttaccgttacggtaaactcggttaaccgtaaaccgttaacggttaccgtacccggttccgttcgggttaccgaacccgacccggaaaccgaccccgtaacccttacgtccgttcccttaacccg

SEQ ID NO: 383072 - DNA, 585 bp, Homo sapiens
  misc_feature: GZ8MTXP01EWQP3.51.71.G05.1.454.CMB.2.raw
  modified_base (105)..(105): a, c, t, g, unknown or other
  modified_base (242)..(242): a, c, t, g, unknown or other
  modified_base (249)..(249): a, c, t, g, unknown or other
  modified_base (371)..(371): a, c, t, g, unknown or other
tcagcgatcgtatacacgaccggtgctcgatttagtgtcgtcgcaagagagaggggcacgaccggtgctcgatttagtgtcgtcgcaagagaggaggggggggancctagctgtgctgtgggtccaggaggcagaactctgggtgtctcaccatggcctggatccctctacttcctcccccctctcactctctgcacgaggctctgacgcctctatgagctgacacacgcccacccgtggtntcagtcncccgagacagacgccaggatcacctgctcgtggagatgacattcgaccaaaccgatatgtactttagttcgtaccagacagaacgccggccccacggtccctgtcgttggtagtatgtaaanaaagactacgtagagacgccctagacggtactcccgagacgcgtacttcgtcgtcgtcctaccgaaggttacgaagggtaaccggtaacggtacaacgtagttacggacctatacgaggttacggacgtcctaagtggaacgaacggagggaacgacgtcgtagttaacgttatttactaagtacaacttacaacgataaccttaacgtttaag

SEQ ID NO: 383073 - DNA, 678 bp, Homo sapiens
  misc_feature: GZ8MTXP01CQOE0.51.71.G05.1.454.CMB.2.raw
  modified_base (417)..(417): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgacccaaacgtatatgcttagttggaccagcaagaacggcccggaccacggtcccctggtggttggtgaattagtaaataaaacgcacgtggaaggacggtccccctagaacggggtactcccgtaggacgtccgtatttccgtcgtggtcctaccgaaagggtcaacgggggactaaacccggggtnacgtcgttcgggacccattcgaaggtcgggacgtaccgagggcgaaagggacgggtaaccgagggccttaggaaactttagtttaaacgttgtaacctaaactaccaaaccgaacgaacctacgttagttacggttaacttagttacgttaccgtacggaactcggttacccgtaaaccgaacggtcccgtaccgttccggttcggaccgaacccgtaccccggaaccggacccctaacccgttcgtaacgttcccgtccg

SEQ ID NO: 383074 - DNA, 670 bp, Homo sapiens
  misc_feature: GZ8MTXP01ATDQH.51.71.G05.1.454.CMB.2.raw
  modified_base (224)..(224): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgctattcgaccaaacgatatgtacttattggtaccagcgaggaacggcccgggccacggtcccctggtggttggtgatagtaataaagacagtgagacggccctgagggactccgtagacgtcgtacttcgtcgtcggcctccgaagggtcgaacgggacgaacgggtcacgtagttcggactatcgaggtaggacgtccgaggcgaagggacgggacgaggtactagtaacttagtttagttacggtactaaacttaccgaaacgtaacgtaacctaaccgttagttttacgggttaaactttacgttacggtttaccggtttacggaaacgtcggaaccggtaaccgttacggtacccgtacccggttaccggttcggggttaccaaccggaccccgaaaccgggtaccccaaaccccgttacgtaacgttcccttaacccg

SEQ ID NO: 383075 - DNA, 520 bp, Homo sapiens
  misc_feature: GZ8MTXP01AFTMU.51.71.G05.1.454.CMB.2.raw
  modified_base (279)..(279): a, c, t, g, unknown or other
  modified_base (286)..(286): a, c, t, g, unknown or other
  modified_base (311)..(311): a, c, t, g, unknown or other
  modified_base (335)..(335): a, c, t, g, unknown or other
  modified_base (430)..(430): a, c, t, g, unknown or other
  modified_base (451)..(451): a, c, t, g, unknown or other
  modified_base (516)..(516): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttatggtaccagcagaagccggccaggccctgngttggtnatgtataaagcactgagaggccctnaggggatccctgagcgtattctcnggcctccgaaggtccaagggacaacgggtcacattggccatcagtggagtccaggcaggaggacgaggctgaactattattggtacaaatcaaanacgacaccattaggtattagntcttcggaatcgcacgaaggtacacgttccgttgggttccaagaccaacggcccacccatcgttnaacc

SEQ ID NO: 383076 - DNA, 608 bp, Homo sapiens
  misc_feature: GZ8MTXP01BYBPP.51.71.G05.1.454.CMB.2.raw
  modified_base (294)..(294): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgacccaaaccgatatgcttattcggtaccagcagaagccggcacggccctgtgtgtgatgtaanaaagacactgagacggcccctagagggtactcccgtgacgcgtacttcctcgtggcctccgaagggtacgaagggaccaacgggtcactagttcggacctatcgagtggacgtccgaggacgaggtaagggacgaggctagacttagtttacttgggtactaatacaacgagaaccacgtagtttacggtacttattgttaccttcggtaaactggaccgaccgttaacgggtccctaacccggttccgttcggggttaccaaccgggcccctaaccggacccctaacccccgttacgttcgttccctaacccg

SEQ ID NO: 383077 - DNA, 615 bp, Homo sapiens
  misc_feature: GZ8MTXP01DW6A5.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgctattcgaccaaacgatatgcttattggtaccagcagaacgccggcacggccctgtgtgtgatgtaataagacactagagacggccctgagggactcccgtgacgcgtacttcctcgtcggctaccgaacgggtcgaacggggaaccaacgggtacacgtagttcgggacctagtcgaggttggacgtccgaggcgaaggagggacgagggctagtaacttagttattcgggtaactaacgtacaacgagaacctacgttagtttaaggttaccttagttacgttacgttacggaaacttcggaccgtaccgttaaacgtccgtaacccgttcgttcgggttaccaacggtacccaaccggtcccaacccgttactcgttccttaaccg

SEQ ID NO: 383078 - DNA, 633 bp, Homo sapiens
  misc_feature: GZ8MTXP01A352U.51.71.G05.1.454.CMB.2.raw
  modified_base (223)..(223): a, c, t, g, unknown or other
  modified_base (294)..(294): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattcgaccaaaccgatatgcttagtcggtaccagcaaggaacgcccggccacggccctgtggttggngatgtaataagacagtgaggacggcccgtgagggactccgagacgcgtacttctcgtacggcctacccgaagggtccgaagggactaacgggtcactagttcggacctagtcgaggtcgggagtaccgaggcgaaggacgggacggaggcgttagaactttaagtttagttaggggtacaaacttacgaaacgacgaacctactagtttaacgggtaactttagttacgttccgttacgggtaaactcggaaccgtaaccgttacggtacctacccggttcggttcggaccgaaccgacccgaaccggtccccaacccttacgtcgttaacctaacccg

SEQ ID NO: 383079 - DNA, 599 bp, Homo sapiens
  misc_feature: GZ8MTXP01DFVM9.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattcgaccaaaccgatatgcttatggtaccagcagaagccgggccaggcccctgtgttggtgatgtaataaagacactgagacggcccctgagggactcccgtgagcgtattcctcgtggcctccgaacgggtcaaggggaccaaacgggtcacgtagttcggcatcgaggtggacgtccgaggcgaagagggacgaggctagacttattattaggtactaaatacaaacgacgaaccactagtttacggtactttagtcgtacgttcggaaacgtgaccggaacccttagggtaccctccggttaccgttcgggttaccgaaccgaccccgaacggtaccccaaccccttacgtcgttaaccgttaacccc

SEQ ID NO: 383080 - DNA, 675 bp, Homo sapiens
  misc_feature: GZ8MTXP01BVN71.51.71.G05.1.454.CMB.2.raw
  modified_base (239)..(239): a, c, t, g, unknown or other
  modified_base (285)..(285): a, c, t, g, unknown or other
  modified_base (339)..(339): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccacctcggtgtcagtcgtccccaggacagacggccaggatcactgctctggagatgcattgaccaaacgntatgcttatgtaccagcagaacgccgggccaggcccctgtgttggngatgtaataaagacatagagacggccctgagggtactcccgtgagcgtacttcncgtggcctcgaagggtacaaggggacaaacgggtccaagtagttcggacctatcgaggtggacgtcccgagggcgaaggacgggaacgagggctagtacttaagtttacgtaggtaaccaaattaccgaaaacctagtaaaccgtacctaagttttacgggttaacctttagtacggtttaccgttaaccggggtaaacctttacggacccggaaacccgttaacggggtaaccctaaccccgggttcccgtttacgggggttaccccaaccgggtacccccgtaaacgggtaccccccgaaccccgttaacttaaccgggttcccgttaaccccg

SEQ ID NO: 383081 - DNA, 630 bp, Homo sapiens
  misc_feature: GZ8MTXP01A1Y62.51.71.G05.1.454.CMB.2.raw
tcagcgatcgtatacacgaccggtgctcgatttagtgtcgtcgcaagagagaggggcacgaccggtgctcgatttagtgtcgtcgcaagagaggaggggggggagcctagctgtgctgtgggtccaggaggcagaactctgggtgtctcaccatggcctggatccctctacttctccccctctcactctctgcacaggctctgaggcctcctatgagctgacacagcccaccctggtgtcagtcgtccccaggacagacggcaggatcactgctcgtggagatgcattcgacccaaaccgatatgtactttagttacggtaccagaccgaaggaaccggcccgggaccccgtaccggtcccgttaggtcggttcggtaagtagttgtaaagtaaacgacgtacgtaggacgacggacccgtacggacgggtacctcccgtaggacggtacgtacgttcctcgtcggccgtaccgagggtacgacgggaaccggaacggtacgacgtacggtcggaccagtacgtaggtcgacgtaccgtagtcggaacgaggacgggacggacggtacgtacgttacgttgtttaacgttcgtaaccaataccgaaacgactaacccgaacgtttaacgg

SEQ ID NO: 383082 - DNA, 604 bp, Homo sapiens
  misc_feature: GZ8MTXP01DFEHS.51.71.G05.1.454.CMB.2.raw
  modified_base (221)..(221): a, c, t, g, unknown or other
  modified_base (490)..(490): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagcccaccctcggtgtcagtcgccccaggacagacggccaggatcactgctcnggagatgctattgaaccaaaccgatatgtacttagttcggtaccagcgaagaacggcccgggccaacggtcccccgtggtggtttggtagtatagtaaagtaaacgacacgtaggaaggacggaccctcgaagggtactcccgtagacgcgtattcctcgtaggcctccgaagggtcgaaaggggaccaaacggtcaacgtagttcgacctatccgaaggtggacgtcgaaggacaggaggacgagtctagaacttattattgacaatnaaaccagacaacctgttacgttacttagtgttaactcggaaactgaaccgtaacgaacggttcgaccgttcgtaagggtaccaacgcccgaacggaccctaaccccgaagtccg

SEQ ID NO: 383083 - DNA, 660 bp, Homo sapiens
  misc_feature: GZ8MTXP01ASP2V.51.71.G05.1.454.CMB.2.raw
  modified_base (224)..(224): a, c, t, g, unknown or other
  modified_base (243)..(243): a, c, t, g, unknown or other
  modified_base (286)..(286): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagcccaccctggtgtcagtcgtccccaggacagacggccaggatcacctgctctgganatgctattcgaccaaacgntatgtcttagtgacagcagacgccggcacggccctgtgtggtnatagtaataaagcatgagacggccctacgagggtacttcccgagacgcgtacttcctacgtcggcctccgtaaagggtccgaaggggacctaaaccgggtcaacgtagttcgggaccctaagtacgtaggttacgggacgtaccggaaggacgaagggacgggaacggagggtacctaggtaacttaagtttaacgttacggggtaactaaacgttaaccaaacgtaacgtaacctaaccgtagtttacggtaactttagttcgttaccgttacggtaactcgaccgtaacgaacggtccgtaccggttccgttcgggttacccgaaccgacccgaaccggaccccaacccttacgtccgttaaccttaacccg

SEQ ID NO: 383084 - DNA, 674 bp, Homo sapiens
  misc_feature: GZ8MTXP01AYJE7.51.71.G05.1.454.CMB.2.raw
  modified_base (222)..(222): a, c, t, g, unknown or other
  modified_base (239)..(239): a, c, t, g, unknown or other
  modified_base (286)..(286): a, c, t, g, unknown or other
  modified_base (639)..(639): a, c, t, g, unknown or other
  modified_base (659)..(659): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgggctgacacagccaccctcggtgtcagtgtccccaggacagacggccaggatcacctgctctgganatgcattgaccaaacgntatgtcttatggtaccagcagagccggcagccctgtgtgtgatgtanaaagacacgtgagacggccctacgagggactcccgtagacggtcgtatttccccgtcgtcggggtcctcccggtaagggttaaccgaacgggggaacctaaaccggggtcctaaaccgtacgtttacggggacccctaagttcccgaaggtttcggggaacgttcccggaagggtaccgaaaggggaacggggaacggacgggtccgttaggtaacctttaaggtttagtttacggtaacctaaagttacccgtaaacacgtaaacccaacctaagtttacggttaacctttagtcgttacgtttacgggaacttgaccgacgtaacgttccgaacccgtcgttcgggttacncggaacccacgccccaaccncttcgtccttcgtcc

SEQ ID NO: 383085 - DNA, 632 bp, Homo sapiens
  misc_feature: GZ8MTXP01BHI78.51.71.G05.1.454.CMB.2.raw
  modified_base (360)..(360): a, c, t, g, unknown or other
tcagcgatcgtatacacgaccggtgctcgatttagtgtcgtcgcaagagagaggggggtgggtccaggaggcagaactctgggtgtctcaccatagcctggatccctctacttcctccccctcctcactctctgcacaggctctgaggcctcctatgagctgacacagcccaccctcggtgtcagtcgtccccaggacagacggccaggatcacctgctcgtggagatgcattcgaccaaacgatatgcttatggtaccagcagaagccgggccacggcccctgtgttggtgatgtataaagacactgagaggccctgagggactcccgtgagcgacttctcgtggctccgaagggtcgnggggaacaaacgggtcaacgtagttcgggacctatccgagtacgggagtaccgaggccgaaggacgggaaccggaggcctagaacttaagttagttcggggtactaaataccaaacgagaaccaccgtatttacgggtactttagtacgttcgtttcggaaactcggacggtaaacccgttaaggtaccctacccggttaccggttggggttcccaaccggaccccgtaacggacccccaacccccgttacgtccggttaaccctaaccccg

SEQ ID NO: 383086 - DNA, 593 bp, Homo sapiens
  misc_feature: GZ8MTXP01A242Q.51.71.G05.1.454.CMB.2.raw
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtaccagcagaagccggcaggcccctgtgttggtgatgtataaagacactgagacggcctcgagggactcccgtgacgcgtattctcgtcggcctccgaaggtacgaggggaccgaacggtcaactagtttcgggccctagttaccgaggttcggacgtaccgaagggccaaggacgggacgagtacgtagacttagttattgtacaattacaaacgagactaacctagttcggttaacctttatcggttcttacggaactgaccgtaacccgtaaggttccgttaccggttccgtgggtccaaccgccccgaacggacccctaaccccgaacgttaaccg

SEQ ID NO: 383087 - DNA, 615 bp, Homo sapiens
  misc_feature: GZ8MTXP01CGMX3.51.71.G05.1.454.CMB.2.raw
  modified_base (223)..(223): a, c, t, g, unknown or other
  modified_base (241)..(241): a, c, t, g, unknown or other
  modified_base (280)..(280): a, c, t, g, unknown or other
  modified_base (283)..(283): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctctcactctctgcacaggctctgaggcctcctatgagctgacacagccaccctggtgtcagtcgtccccaggacaggacggccaggatcacctgctctgganatgcattcgaccaaacgntatgcttatcgtacagcagacgccggcagccctgtgtgnatntataagacatgagacgccctagaggactccgtgacgcgtacttcgtcgtcggcctaccgaacgggtacgaacgggactaaaccgggtacaacgtagttacgggactagtcgaggtacggacgtccgaaggacgaagggacgggacgacgggtctaggtaacttagtttacgttacgggtaactaaataaccgaaacgaacgtaacccgtacgttaagtttacggttaacttacgttacgttacgttacggaaacttcggaccgtaacgaacggtcaccgttcgttcggttacaacgacccgtaacggcccaaccgttctaacgccgtaaccg

SEQ ID NO: 383088 - DNA, 649 bp, Homo sapiens
  misc_feature: GZ8MTXP01DZ77P.51.71.G05.1.454.CMB.2.raw
  modified_base (183)..(183): a, c, t, g, unknown or other
  modified_base (226)..(226): a, c, t, g, unknown or other
  modified_base (244)..(244): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagcccaccctcggtntcagtcgtcccaggacagacggccaggatcacctgctctgganatgcattcgaccaaacgntatgcttatgtacagcagagccggcacgccctgtgttggtgatgtataaagacacgtgagacgcctagaggactccgtgacgcgtattcgtctcggtcctacgtaaggtcgaacgggaaccgtaacgggtacacgtagtttcgggaccctaagtccgaggttacggacgttacccgaagggaccgaagggaagggacggaagggtccttaaggtaactttaaggtttaagtttacggtaactaaacgtacaaaccgagaacctaaaccgtagtttacggttactttaagttcgttaacgttaccggaacgttcggaccgtaaaccgtacgggttcccgttcccgttaccggttcgggtacctccggaacccgaaccggttacccctaaccccgttcgttaacccg

SEQ ID NO: 383089 - DNA, 736 bp, Homo sapiens
  misc_feature: GZ8MTXP01DYW1W.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgatatgcttatggtaccagcagagccggcaggccctgtgtgtgatgtataagacactgagcggccctgagggactcccgtgagcgtacttctcgtggcctaccgaacgggttcgaacgggggtaacctaaaccggggttaccaaacgtacgtttcgggaccctaaagttaccgtaggttacgggaacggttacccgaaggggaccgaaagggaacgggaacggacggggtacctaaggtaacctttaaagtttacgtttacgggttaactaaaacgttaccaaaaccgtacgaaaccctaccgttaagtttaacgggtttaacctttagttacgtttaccgttacgggtaaaacttcggaaccggtaaacccgttaaacggggttaccctaaccccgggtttacccggttcgggggttaaccctaaccggtaacccccggaaaccgggttaaccccccaaacccccgttaacctttccggttaaccccgttaaccccg

SEQ ID NO: 383090 - DNA, 801 bp, Homo sapiens
  misc_feature: GZ8MTXP01DF2ZB.51.71.G05.1.454.CMB.2.raw
  modified_base (242)..(242): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctctggagatgcattgacccaaacgntatgtcttattggtaccagcagaacgccggcacggccctgtgttggtgatagtaataaagcactgagacggccctacgagggtactcccgtggaacgtcgtactttccgtcgttcggcctccggtaaaggttccgaacgggggaaccaaacggggttaccaaccgtagtttacggggacccctaagtaccgtaaggttacggggaacgtcccggaaagggacccgaaaggggaacggggaaccggaagggtaccgttagggtaaacctttaagttttaaaccgtttaggggtaacccgttaaaaagttacccctaaaaccgtaaacggaaacccctaacccgttaagttttaaccggggttaaaccttttagttaaccggttacctttaaccgggggaacttacgggaacccgggtaaaccccgttaaaacggggtttccccgaaaccccggtttaccccgggttcgggggttaacccaacccgggtaaacccccgaaaccggggttacccccccaaaaaccccggttcccttaacccggttaacccgtttaaccccgg

SEQ ID NO: 383091 - DNA, 700 bp, Homo sapiens
  misc_feature: GZ8MTXP01EZ0G9.51.71.G05.1.454.CMB.2.raw
  modified_base (105)..(105): a, c, t, g, unknown or other
  modified_base (241)..(241): a, c, t, g, unknown or other
  modified_base (268)..(268): a, c, t, g, unknown or other
tcagcgatcgtatacacgaccggtgctcgatttagtgtcgtcgcaagagagaggggcacgaccggtgctcgatttagtgtcgtcgcaagagagagggggggggancctagctgtgctgtgggtccaggaggcagaactctgggtgtctcaccatggcctggatccctctacttcctcccccctctcactctctgcacaggctctgaggccctcctatgagctgacacagcccaccctggtntcagtcgtccccaggacagacgcaggntcactgctctggagatgcattcgacccaaacgatatgtctttatggtaccagcagaacgccgggcccacggcctgtcgtggtagtatgtaaataaagacactagggacgacggccctacgacgggtactccccgtagacgtacgtactttccgtcgtcgggtcccttaccgaacgggttaccgaaacggggaccgtaaaccggggtcctaaaccgtaacgtttccggacccgtacgttacggtaacgggttcgggtaaccggtacccgtaaggttcggaacccggtaaagggggaaacggggaaacccgggttacgggggtaccccgtttagggttaaaacccgttttatttaaacgttttcgggtaaaactaaaaccgtttaaccaaaaacccgttaacgggtaaaccccttaaaccccggttttaaaggg

SEQ ID NO: 383092 - DNA, 624 bp, Homo sapiens
  misc_feature: GZ8MTXP01EEIHK.51.71.G05.1.454.CMB.2.raw
  modified_base (242)..(242): a, c, t, g, unknown or other
  modified_base (288)..(288): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgcattcgaccaaacgntatgcttattggtaccagcagaacgccggcaggccctgtgttggtnatgtataaagacacgtgagacggccctagacgggactcccgtgacgcgtacttctcgtggcctccgaagggtcaaggggacaacgggtcactagttcggctatcaggtggacgcgaggacgaggacggagaggctaggaacttattagttacggtacaatacaaacagaaaccctactagttacggttaacttagtcgttcgttacggaacttcggaccgtaaaccgttaaggttacccgtaacccggtttccggttcggggttacccgaaccggaacccccgtaaacgggtaccccccaaaccccgttaccgtttccggttaacccgtttccccg

SEQ ID NO: 383093 - DNA, 623 bp, Homo sapiens
  misc_feature: GZ8MTXP01DOZNK.51.71.G05.1.454.CMB.2.raw
  modified_base (284)..(284): a, c, t, g, unknown or other
  modified_base (583)..(583): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgatatgcttatggtaccagcagaagccggcaggccctgtgtggnatgtaataaagcactgagacggcccctagagggtactcccgtagacgcgtacttcctcgtggcctaccgaacgggttacgaagggaacctaaaccgggtcaaacgtacgttcgggaccctaaagtccgaaggttacgggacgtcccgagggaccgaagggacgggacgaagggcttaggaacttaagttagtaggtacaaatacaaacgagaaccacctagttaggttacttagttacgttccgttacggtaaactggttaccgaaccgttaagtccgtaaccgttcgttgggttaccncggacccaacggaccccaaaccccttctccgttaacctcc

SEQ ID NO: 383094 - DNA, 641 bp, Homo sapiens
  misc_feature: GZ8MTXP01EBDU5.51.71.G05.1.454.CMB.2.raw
  modified_base (221)..(221): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatgcattcgaccaaacgatatgcttatggtacagcagagccggcagccctgtgtgtgatgtataaagacactgagaggccctagagggacttccgtgagcgtattctcgtggcctccgaaacgggtcaacgggggactaaacccggggtcaacgtacgtttcgggaccctaagttaccgtaggtacgggacgttacccgagggaccgaagggacgggaacgaagggtcttacggaactttagttaacgtttacgggtaactaaacgttaccaaacgtacgaacctaccgtatttacgggttaaccttagttacgttccgttacgggaaacttggaccgtaacccgttaaggtaccgacccggttaccgttgggttaccaacgtacccgaacggcccaaccccgcttaacgttcctaaccg

SEQ ID NO: 383095 - DNA, 581 bp, Homo sapiens
  misc_feature: GZ8MTXP01AP54N.51.71.G05.1.454.CMB.2.raw
  modified_base (222)..(222): a, c, t, g, unknown or other
  modified_base (283)..(283): a, c, t, g, unknown or other
  modified_base (337)..(337): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgatatgacttatggtacagcagaaggccggcaggccctgtgttggnatgtataaagcactagagacggccctagagggactcccgtagacgcgtacttcngtcggctccgaagggtcaagggacaacgggtcacgtagttcggaccctaagtcgaggtcggagtaccgagggacaacgggaggacgtacggctgacttaagttagtaggtacaatcaaacgagaaccacgtagttcggttaacttagtcgttacgtttcgggaacttcgacgtaccttaacgggtcctaaccgttcgttcggttcaacggaccccaaggtacccacccttcgtcgttctaaccg

SEQ ID NO: 383096 - DNA, 599 bp, Homo sapiens
  misc_feature: GZ8MTXP01D94MC.51.71.G05.1.454.CMB.2.raw
  modified_base (183)..(183): a, c, t, g, unknown or other
  modified_base (361)..(361): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagcccaccctcggtntcagtcgtcccaggacagacggccaggatcactgctctggagatgctattgaccaaacgtatatgcttattgtaccagcagaacgccggcgacgccctgtgtgtagatagtaataaagacacgtgacgacggcctagagggactcccgtgaacgcgtattcgtcgtcggtcctaccgngggtcaacggggaccaacggtacactagtttcggaccattcgaggtgaacgtccgaaggcaaggacggacgagcgtagtacttaatttagtgtacaactacaaacgacgaactaacctagtttacggtaactttagtcgttaaccgttacggaacttcggaccgaaacgtaacggttcccgttaccggttccgtcgggtacaacggacccgaacggacccctaacccgttaactcccg

SEQ ID NO: 383097 - DNA, 760 bp, Homo sapiens
  misc_feature: GZ8MTXP01APC80.51.71.G05.1.454.CMB.2.raw
  modified_base (240)..(240): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaacgntatgcttattgtaccagcagacgccggcacgccctgtgttggtgatagtaataaagacacgtagaggacgccctcgacgggactcccgtgacgacgtacttcctcgtcggccgtccgaagggttaccgaacggggaaaccgtaaaccgggtccaaacgtaagtttcgggaccctaaacgtccgtaagggtcgggtaacgttaccccggaagggaccggaaggggaaacggggtaacccgggaagggtacccgttagggtaaaccgtttaaattttaagtttacggggttaacaaaacgttaccaaaacgaaacgtaaccctaaccgttaagttttacgggttaacctttagttacgttacccgtttaccgggtaaaacttccggaaccggtaaaccccggaaacgggttacccgtaaccccgggttacccggttcggggttaaccccgaaccggtaacccccggtaaaccgggtaccccccaaaccccgggttactccccggttaacccgttaacccccg

SEQ ID NO: 383098 - DNA, 639 bp, Homo sapiens
  misc_feature: GZ8MTXP01DUGUN.51.71.G05.1.454.CMB.2.raw
  modified_base (237)..(237): a, c, t, g, unknown or other
  modified_base (277)..(277): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgagatgcattgccaaacgntatgcttatggaccagcagaagccggcaggccctgtgtgngatgtaataagcactgagacgccctgagggactccctgacgcgtacttctgtcggctaccgaagggtacaaggggactaaacgggtcaacgtagttcgggaccctaagtacctaggttggaacgtcccgaagggccaaagggacgggaacgaacggggtcttaacggaacttaatttaagttacggggttaacaaattacccgaaaacacggaacctacctaaggtttacggttaacttaagttcgttaccgtttacggaaacttggaccgaaaccgttaaacggtccctaaccggttacgttcggggaccaacggaccccgaaacgggccccaaaccccttacgtccgttaactaaccccg

SEQ ID NO: 383099 - DNA, 651 bp, Homo sapiens
  misc_feature: GZ8MTXP01BIGR7.51.71.G05.1.454.CMB.2.raw
  modified_base (225)..(225): a, c, t, g, unknown or other
  modified_base (243)..(243): a, c, t, g, unknown or other
  modified_base (286)..(286): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggatcacctgctctgganatgcattcgaccaaacgntatgcttatcggtacagcagaacgccggcacggccctgtgtgnatagtaataagctacgtagacgacgcccgtagacgggctcccgtagacgacgtacttccgtcgtggtccctaccggaaagggttaccgaacggggaactaaccgggtacacgtagttcggacctagtcgtaggtcggacgtacgagacggaacggagggacgtacgggtctagtaagttaatttacgtagggtaactaaataccaaacgtaacgtaacctaccgtagtttacggttaacttagttcgttacgttagggtaaaccttggaaccggtaaaccgttaagggtcccgtaaccggttacggcggttaccgaaccgaccccggaacgtaccccaaccgttacgtcgttaaccgttaacccg

SEQ ID NO: 383100 - DNA, 639 bp, Homo sapiens
  misc_feature: GZ8MTXP01CERIR.51.71.G05.1.454.CMB.2.raw
  modified_base (238)..(238): a, c, t, g, unknown or other
  modified_base (278)..(278): a, c, t, g, unknown or other
  modified_base (284)..(284): a, c, t, g, unknown or other
  modified_base (334)..(334): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacgccaggatcacctgctctggagatgcattgaccaaacgntatgcttatggtaccagcagagccggcaggccctgtgtgnatgtanaagcactgagacgccctagagggtactccgtgacgcgtaactttcctcgnggtccttacccgaaagggttccaacgggggaacctaaaaccggggttcaaccgtaagttcggggccctaaagttccgaggttaggacgtcccgaaggcgaaggtacgggaccgagggacctggaacttagtttattcgggtacaaatacaaacgagtaaccaacctagtttacggtaatttattcggtcctttcgggaaacttcggaccgtaaacccgttaagggtaccgtaacccggttcccgttggggttaccaaccggaccccaaacgggccccaaaccccttcgtaacgttccctaacccg

SEQ ID NO: 383101 - DNA, 643 bp, Homo sapiens
  misc_feature: GZ8MTXP01AKBDG.51.71.G05.1.454.CMB.2.raw
  modified_base (104)..(104): a, c, t, g, unknown or other
  modified_base (234)..(234): a, c, t, g, unknown or other
  modified_base (260)..(260): a, c, t, g, unknown or other
  modified_base (274)..(274): a, c, t, g, unknown or other
tcagcgatcgtatacacgaccggtgctcgatttagtgtcgtcgcaagagagaggggcacgaccggtgctcgatttagtgtcgtcgcaagagagaggggggggancctagctgtgctgtgggtccaggaggcagaactctgggtgtctcaccatggcctggatccctctacttcctccccctctcactctctgcacaggctctgagcctctatgagctgacacagccacctggtntcagtctccccaggacagacgcaggntcactgctctgganatgactattcgacccaaacgattatcgtactttagttcggtaaccagaccgaagaacggcccgggaccccacgggtcccttggtggttggtagtaacgttgtaaataaaacggactacgtaggacggaacggtccccgttagaacgggtaccttcccgtaggtacgtcgtaactttccgtacgtcgggccttaccgtaacgggtccgtaaacggggaaccgtaaacggttaccgaaccgtaggttccggaaccctgtaccggtaaggtcgggtaccgtcctaagtcggaacgaacggacgggacggaggtccgtaggttaaccttattacgttgtacaacttacacgaacgtaaccttaaccgtttaag

SEQ ID NO: 383102 - DNA, 667 bp, Homo sapiens
  misc_feature: GZ8MTXP01EXHU8.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgcttattggtaccagcagaagccggcaggccctgtgtggtgatgtaataaagacactgagacggccctgagggacttccctgacgcgtacttcctgtcggctaccgaagggttcaaggggtaaccaaacgggttcaacgtagtttcgggcctaagtcgtaggtaggaacgtccgaagggcaagggacgggaacggaggccgtagaacttaagtttattaggggtaactaaataccgaaacaacggaacccaaccgttaagtttagggttaacctttaagtcgttacgtttacgggaaacttggttacccggtaaccttaaacgggttccctaccgggttccccggttaggggttacccaaccgggtacccccgaaaccggggaccccctaaccccggaccttaacgggttccctttaaccccgg

SEQ ID NO: 383103 - DNA, 641 bp, Homo sapiens
  misc_feature: GZ8MTXP01AEQB8.51.71.G05.1.454.CMB.2.raw
  modified_base (224)..(224): a, c, t, g, unknown or other
  modified_base (241)..(241): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgcattgaccaaacgntatgcttattggtaccagcaggaacgccggcacggccctgtggttggtgatagtaataaagacactagaggacggccctagagggtactcccgtgacgcgtacttctcgtcggctacgaacggtcgaacgggacaacggtcactagttcgcctatcgagtaggacgtaccgaggcgaaggacgggacgacgggtctaacggtaacttagtttacgttacggtaactaaagttaaccgaaacctaagtaaccctaacgtaagttttacgggttaactttaagtcgttacgttaccgggtaaactcgttaaccgaaccgttaaccggtacgtcccggttacgttcggggttacaaccggccccgaaacggacccccaaccgttacgttccgccttaaccccg

SEQ ID NO: 383104 - DNA, 697 bp, Homo sapiens
  misc_feature: GZ8MTXP01EBQUB.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctctatgagctgacacagccacctcggtgtcagtcgtccccaggacagacggccaggactcacctgctctggagatgctattcgacccaaacgatatgtacttagttcggtaccagcgaaggaacggcccgggaccgacggtccccgttggttggtttggtagtaataggttaaataaaagacctaacgtaggaaggacggcccccttagaacggggtacttccccgtaggacgcgttactttccgtcgtcgggtccctcccggaaacgggttcgaagggggtaacctaaccgggtacacgtagttcgggactatacgaggtcggacgtaccgaggacgaaggacggacgaggctagtaacttaatttagttggtaactaaattaccaaacgtaacgaacctaaccgttagtttacggtttaacttagttcgttaccgttacggaaacttcggaccgtaaaccgttacggttaccctacccggttcgttcgggttaccaaccgaccccgaacggacccccaaccccgttactccgttaaccctaacccg

SEQ ID NO: 383105 - DNA, 688 bp, Homo sapiens
  misc_feature: GZ8MTXP01AVA7K.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgctattcgaccaaacgatatgtcttattgtaccagcaggaacgccgggaccacggccccgtggtggttggtgattagtaataaagacacgtagagacggtccctagacgggactcccgtaggacgcgtacttcgtcgtcggtcctaccgaacgggttacgaacggggtaaaccgaaaccgggtcctacgtacgtttaccgggaccctaagttacgaagggttcgggaacggtacccgaacgggacgaaacgggacgggacggtaacggtaccgtagtaacgttaatttaagttcgggtaaactaagtaccaaacgtacgaactaacctagttacggttacttacgtcgttaccgtacgtaacgtgacccgtaaccgacggtaccgtaaccgttccgttgggacccaaccggaccccgtaacgggaccccctaaccccggacttccgttaaccgttaaccccg

SEQ ID NO: 383106 - DNA, 776 bp, Homo sapiens
  misc_feature: GZ8MTXP01D50D8.51.71.G05.1.454.CMB.2.raw
  modified_base (237)..(237): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtcccaggacagacggccaggatcacctgctctggagatgcattgccaaacgntatgcttatggtaccagcagaagccggcaggccctgtgtggtgatgtaataagacacgtgagacggccctcgacgggactccctgacgcgtacttctcgtggcctaccgaacgggttacaacgggggaactaaaccggggttccaacgtaacgtttcggggacctaaagttcccgaagggtttacgggacggttacccgaaggggacccgtaaagggacggggaaaccgagggaccgttaggtaaccgtttaatttacgtttcgggggttaactaaaacgtttaccaaaaccggaacggtaaacccgtaaacccctaaggtttttaacggggtttaaacccttttaaagttccggttttacccgttttacgggggaaaacccttcgggttaaccccggaaaccccggttaaacggggttacccccgtaaaaccccgggtttcccggtttcggggggttaccctaacccgggacccccgtaaaaccggggcccccctaaaaccccgggttaacccttccgggttaacccgttaacccccg

SEQ ID NO: 383107 - DNA, 627 bp, Homo sapiens
  misc_feature: GZ8MTXP01CPYQZ.51.71.G05.1.454.CMB.2.raw
  modified_base (182)..(182): a, c, t, g, unknown or other
  modified_base (230)..(230): a, c, t, g, unknown or other
  modified_base (307)..(307): a, c, t, g, unknown or other
  modified_base (378)..(378): a, c, t, g, unknown or other
  modified_base (618)..(618): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctcccccctcctcactctctgcacaggctctgaggcctcctatgagctgacacagcccacctggtntcagtcgtccccgagacagaccggccaggactccacctgctcgtgganatgctattcgaccaaaccgttatgtacttagtcggtaccagcagacggccggcacggccctgtgtgtgagtagtaanaaacgacacgtgaagacggccctagaggcctccgaggacccgtcgtacttcgtccgtcggcccttaccggnggtcggaaccgggaacgacggtcaacgtagtcggacctagtaccgagtcggacgtccgaggacgaggacggtacgagtctagtaacttagttacgtagacaacgtacaacgacgtaacctaccgttagttccggtaacttcgttacgttcgttaaccggacgttcggaccgtaaccgtacggttacccgttccgttcggttaacgaccgtaaccgaccctaaccggacccctaaccccgngttaacccg

SEQ ID NO: 383108 - DNA, 617 bp, Homo sapiens
  misc_feature: GZ8MTXP01AVQ1C.51.71.G05.1.454.CMB.2.raw
  modified_base (105)..(105): a, c, t, g, unknown or other
  modified_base (242)..(242): a, c, t, g, unknown or other
  modified_base (285)..(285): a, c, t, g, unknown or other
  modified_base (437)..(437): a, c, t, g, unknown or other
tcagcgatcgtatacacgaccggtgctcgatttagtgtcgtcgcaagagagaggggcacgaccggtgctcgatttagtgtcgtcgcaagagagagggggggggancctagctgtgctgtgggtccaggaggcagaactctgggtgtctcaccatggcctggactccctctacttcctccccctctcactctctgcacaggctctgacggcctctatgagctgacacacgcccacccgtggtntcagtcgaccccaggacagacgcaggactcactgctcgtgganatgctattcgaccaaaccgtatatgtactttagttacggtaaccagaccgaaggaacggcccgggacccccacgggtcccgttggttcggttggtaacgtagttaagtaaataaagacacgtagacggacgtccctacgagggtactaccgngacgtcgtacgttctcgtcggtctaccgtaggtacgaacgggacgtaaccgggtctacgtacgttcggccctagtccgtaggtcgtacgtaccgagggacgaagggacggacggtacggttacgtaggtaacttattagttacgaataacaacaacgacgactaaccgttaagtttaacg

SEQ ID NO: 383109 - DNA, 625 bp, Homo sapiens
  misc_feature: GZ8MTXP01A4O1G.51.71.G05.1.454.CMB.2.raw
  modified_base (223)..(223): a, c, t, g, unknown or other
  modified_base (242)..(242): a, c, t, g, unknown or other
  modified_base (296)..(296): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcaattcgaccaaacgnttatgctttattggtacagcgagaacggcccggccaggccccgtggtcgttggnagtagtaataaagacacgtgagacgccctgagggctcccgtgagcgtacttctcgtcgctccgaagggtcgaacggacaacgggtcacgtacgttcggacctatcgaggtggacgtaccgaggacgaaggtacgggacgacggcgtagaacgttattagttacgggtactaaactacaaacgaaccgtaacaacccgttagttacggttaaccttgttcgttacgttacggaacttcggaccgtaaccgaaggtccgtaacccggttccgttcggggacccaacggtccccgaacgggtaccccacccgaccgttccgttctaaccccg

SEQ ID NO: 383110 - DNA, 679 bp, Homo sapiens
  misc_feature: GZ8MTXP01EUSJJ.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccacctcggtgtcagtgtccccaggacagacggccaggatcacctgctctggagatgcattcgaccaaacgatatgcttatgtacagcagaagccggcacgccctgtgtgtgatagtataaagcagtagagacgccctacgaggactcctggacgcgtacttctcgtcggtctaccgaagggttcgaacgggtacgaaacgggttccacgtacgttacggaccctagtacgtaggttcgggacgtaccgaggcgaagggacggacgacgggctagaacttatttagttggtaactaaacgtacaaacgtacaaccctaaccgtagtttaacgggttaactttaacgtcggtttaccgtttaacgggtaaaccgtttcggaacccggtaaacccgttaaacgggtccccggttaaaccccgttccggggttacgggttaccccgaaccgggaaccccgtaaaaccggggaccccaaaacccccttaaacgggttccgttaaccccttaacccg

SEQ ID NO: 383111 - DNA, 669 bp, Homo sapiens
  misc_feature: GZ8MTXP01AE8LF.51.71.G05.1.454.CMB.2.raw
  modified_base (225)..(225): a, c, t, g, unknown or other
  modified_base (297)..(297): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtgganatgcattcgaccaaacgatatgcttattggtacagacagaacggcccgggaccacggtccctgtggttggtnatgtaataaagacacgtgacggacggtccctggacgggtactcccgtagacgtacgtacttcgtcgtcggtccctccgaaacgggttccgaacggggacctaaacgggttaccaacgttaacgttcgggaccctaagtcgaggtacgggacgtaccgagggacgaggaacgggtacgaggtctagtacttatttacgtggtaacaataccgaaacgtaacgacctaacgtaagtttacgttaacttagttcgttaccgttcgggtaaatcggttaccgaaaccgttaacgggtccctaacggttccggttcggttaccgaaccggaccccgaaccggccccaaaccccgttcgttcgttaaccgttaacccg

SEQ ID NO: 383112 - DNA, 695 bp, Homo sapiens
  misc_feature: GZ8MTXP01A2BYU.51.71.G05.1.454.CMB.2.raw
  modified_base (634)..(634): a, c, t, g, unknown or other
  modified_base (659)..(659): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttcctccccctcctcactctctgcacaggctctgaggcctcctatgagctgacacagcccacccgtcggtgtcagtcgtccccgaggacagaccgtcgacgagtactccacgtcgtcgtcgtaggagtagtcgtacttacgtaccgaaacccgtaaacgtattacgtacgtttacgtttaggttaccggaaccgagacggaaacgggacccgggcccggaccgaccccggtcccgttggtttggttaggtagtagttagtaaagtaacgacgtacgaggaacggccgtaccgtaggacggtcctccgtagcggtacttacgttcgtcggtaccgtccgtaacggtacgggacggaacggaaccgtacgtacacgttgtaccgatacgtacggagggtacgacgaccggaggacgaagggacgtacgcgtacttaaggtacttttaaggttcgttaacgaactaaactaaccgacgactaaccctagttgtttaacgttacttggtaacttacgttaccgngttaccgacgtaacggttcgttccncggtcggtcgccacccgaccgaccctaaccgcctcg

SEQ ID NO: 383113 - DNA, 643 bp, Homo sapiens
  misc_feature: GZ8MTXP01DDP24.51.71.G05.1.454.CMB.2.raw
  modified_base (386)..(386): a, c, t, g, unknown or other
  modified_base (459)..(459): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgggctgacacagccaccctcggtgtcagtcgtccccaggacagacggccaggatcacctgctctggagatgcattcgacccaaacgattatgtacttattcggtacagcaagacggccggcacggccctgtgtggtgatagtaataaagacacgtgacgacggccctacgagggactcccgtagacgtcgtacttcctcgtgctcgaggtaacgagggaacgaacgtcacngttcgacatcgagtgacgtcgaggacgaggaggacggaggcgtagacttaattagttagtacgaaatacaaanaacgacctaacgtagtttaggttaacttagttcgttaccgttacggaacgtcggtaaccgttaaaccggtaaacgggttcccgtaaaccggttccggttacggggttccaacccggaaccccggaaacccggtaacccccaaaccccggtaccgttaccggtaacccttaacccgttttccccg

SEQ ID NO: 383114 - DNA, 769 bp, Homo sapiens
  misc_feature: GZ8MTXP01CV7GT.51.71.G05.1.454.CMB.2.raw
  modified_base (276)..(276): a, c, t, g, unknown or other
  modified_base (281)..(281): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgaccaaacgatatgcttattggtacagcagaagcggcagccctgngtgtnatgtaataaagacactagagtacggcccctacgagggtactccccgtagacggtacgaactttcctcgtcgggaccttacccggaaagggttacccgaagggggaaaccaaaaccggggttaccaaccgtaagtttcgggacccctaattaccgaagggttcgggaacggttaccccgaaggggcccgaaagggaggggtaaccggtaaggggaccttaggtaaacctttaaatttaaggtttacggtttaacaaaacgttaaccaaaaccaacggtaaaccaacccgttaaagtttaagggtttaaccttttaaacttggtttaaccgttttccggggtaaaaaccgtcggttaaccggtaaacccgttaaaacgggttacccgtaacccggttacccggttacggggttaacccgtaaacccggtaaaccccggaaaccggtaaccccctaaaaccccgttaccgttaacgttaaccccgtaaccg

SEQ ID NO: 383115 - DNA, 691 bp, Homo sapiens
  misc_feature: GZ8MTXP01CDWEH.51.71.G05.1.454.CMB.2.raw
  modified_base (222)..(222): a, c, t, g, unknown or other
  modified_base (239)..(239): a, c, t, g, unknown or other
  modified_base (278)..(278): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgcttatggtacagcagagccggcaggccctgtgtgnatgtaataagcactgagcgccctgaggtactcctagacgcgtacttcctgtgcctaccgaagggtcgaagggacaacgggtcactagttcggaccatcgagtggaacgtcgaaggagtaacggagggacgagggtctacgtaaagttatttaacgttcggtaaacctaaagttaccaaaacgtaacgaaacctaccgttaagtttacgggttaacctttaaaggttcgttacccgtttaacgggtaaacgttaccggaaccggtaaacccgttaaacgggttaccccgtaacccgggtttcccggttaaccgggggttaacccaaccccggggtaaaccccgtaaaaccccggggaaccccctttaaaaccccccgggacctttaacccgggttaaccccgtttaaccccccg

SEQ ID NO: 383116 - DNA, 682 bp, Homo sapiens
  misc_feature: GZ8MTXP01B32F5.51.71.G05.1.454.CMB.2.raw
  modified_base (241)..(241): a, c, t, g, unknown or other
tcagcgatcgtatacacgaccggtgctcgatttagtgtcgtcgcaagagagaggggcacgaccggtgctcgatttagtgtcgtcgcaagagaggagggggggggagcctagctgtgctgtgggtccaggaggcagaactctgggtgtctcaccatggcctggatccctctacttcctccccctctcactctctgcacaggctctgaggcctcctatgagctgacacacgccacccgtggtntcagtcgtaccccgaggacagacggccaggactcacctgctcgtggagatgactatacgaccaaaccgtattatcgtactttagttacggtaaccagacgaaggacggcccgggaccccaccggtccgtggtcggttggtaagacttaagtaaataaaacgacgacgtaggacggtaccggacccgtacgagggtacctcccgtaggacgtcgtaacgttccgtcgtcggtaccgaccgtagggtacgaacggggtaaccgtaacggggttacaaccgttacggttaccggaacccctagtccggtaaaggttcggtaaccggtaccctaagtcgggaaccggaaggggaaaccggggtacggacgggtacctaggttaaacgtttaattagtttaacgaactaaaacgtacaaacgactaacccgttaaccgtttaacgg

SEQ ID NO: 383117 - DNA, 596 bp, Homo sapiens
  misc_feature: GZ8MTXP01AI5JQ.51.71.G05.1.454.CMB.2.raw
  modified_base (179)..(179): a, c, t, g, unknown or other
  modified_base (226)..(226): a, c, t, g, unknown or other
  modified_base (245)..(245): a, c, t, g, unknown or other
  modified_base (262)..(262): a, c, t, g, unknown or other
  modified_base (264)..(264): a, c, t, g, unknown or other
  modified_base (286)..(286): a, c, t, g, unknown or other
  modified_base (485)..(485): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccacctcggtntcagtcgtccccaggacagacggccaggactcaccgtgctcgtgganatgctattcgaccaaacgntatgacttagtcgtacngnagacgccgcacgcctgtgtgtnatgtaataagactagtagacgacgccctagacgggtactccgtagacgtcgtacttcgtcgtcgccgtaccgtaagggacgaacgggaacctaacgggtctaacgtacgttacggactagtaccgagggttcgacgaccgaggacgagggtacggacgagtcctagtacttaattagtacgtacaaacgtacaaacganaaccacgttagttacgttatagtcgtcgtacggtaactacgcggaacgttacgtccgtaaccgttcgcggttacaacgacccgaacgcccaaccttcgtcgccgttaaccc

SEQ ID NO: 383118 - DNA, 689 bp, Homo sapiens
  misc_feature: GZ8MTXP01BZ5A7.51.71.G05.1.454.CMB.2.raw
  modified_base (182)..(182): a, c, t, g, unknown or other
  modified_base (227)..(227): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagcccacctcggtntcagtcgtccccaggacagacggccaggactcacctgctctgganatgctattcgaccaaacgtatatgtacttagttcggtaccagacgagaacggcccggaccacggtccccgtggttcgttggtagtactagtaataaacgactacgtagacggacggcccgtagacgggtactcccgtgacgtcgtacttctacgtcggtaccctacgaacggtcgaacgggactaaccgggtacaacgtacgttacggacctagtaccgtagggtacggtacgttacgaacgggtaccgaagggtaacggggaaccgagggtacgttaacggtaaaccgtttaagtttaacgtttaccggtaaactaaaccgttaaccgtaaaccgacgtaaaccctaaccgttagtttccggtaaacctttgtcgttaacgttacgaacgtcgaccgtaacgtacgttaccgttccgttcgttgggacaacgacccgacgttaccccaaccttcgtaaccc

SEQ ID NO: 383119 - DNA, 629 bp, Homo sapiens
  misc_feature: GZ8MTXP01A6S02.51.71.G05.1.454.CMB.2.raw
  modified_base (223)..(223): a, c, t, g, unknown or other
  modified_base (329)..(329): a, c, t, g, unknown or other
  modified_base (413)..(413): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattcgaccaaacgatatgcttattgtacagcagaacggccggacacggccctagtggtggtgatagtaataagacagtagagacggccctgaggtactccgngacgcgtattcgtcgtcggcctcgaagggtcaacggggacaacgggtcaccgtagttcggacctagtcgagtggacgtcgaggnaagggacggagagacgtagtaacttatttagtacggtataaactcaaacgtagaccaaccgttagttacggtttaactgttacgttctacgggaaactttcggacccgtaaacgttaccgggtaccctaaccccggttcggttccgggaccgaacccggaccccggtaaacccgaacccccgaaccctttacccgtaaggttccccgttaaccccg

SEQ ID NO: 383120 - DNA, 611 bp, Homo sapiens
  misc_feature: GZ8MTXP01EQTRM.51.71.G05.1.454.CMB.2.raw
  modified_base (220)..(220): a, c, t, g, unknown or other
  modified_base (242)..(242): a, c, t, g, unknown or other
  modified_base (286)..(286): a, c, t, g, unknown or other
  modified_base (307)..(307): a, c, t, g, unknown or other
  modified_base (376)..(376): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctntggagatgcattgaccaaacgntatgcttatggtacagcagaagccggccaggcccctgtgttggngatgtaataaagacactgagnggcctgaggatccctagacgcgtattctctcggacctcgaagggtcgaaaggggacaaacggtcaacgngttcggccatcgaagtcggagtccgaaggcgaggaggacggtagctagacttagttattgtacaatacaaagacgactaacctagtacggttacttgtaacgttcttaccgggttaaacttcggaccgtaaaccgtaacggggttaacccgaccccgggtttaccgtttcgggggtacctaaccgggtccccgaaaacggggttcccccaaaacccccggttaacgttaaccccg

SEQ ID NO: 383121 - DNA, 612 bp, Homo sapiens
  misc_feature: GZ8MTXP01EL6EE.51.71.G05.1.454.CMB.2.raw
  modified_base (182)..(182): a, c, t, g, unknown or other
  modified_base (242)..(242): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagcccacctcggtntcagtcgtcccaggacagacgccaggatcactgctctggagatgctattcgaccaaacgntatgcttatggtaccagcagaacgccggcacggcccctgtgttggtgatgtataaagacactgagaggcctacgagggactcccgtagacgcgtattctcgtggacctccgaaggtcaacgggacctaacgggtcaacgtagttcggaccctagtccgaaggttggacgtccgaaggacgaaggacggagacgggctagtacttaagggttacttggtactaatacaaacaacgactaacctagtttacggttactttagttcgttcgtttacggaacgttcgaccggtaaccgtaaaggttcccgttaacccggttcctcggggttaccaaccggtacccaacgggaccccaaccccgttaacttcccg

SEQ ID NO: 383122 - DNA, 493 bp, Homo sapiens
  misc_feature: GZ8MTXP02HU3XD.51.71.G05.1.454.CMB.2.raw
  modified_base (312)..(312): a, c, t, g, unknown or other
  modified_base (332)..(332): a, c, t, g, unknown or other
  modified_base (345)..(345): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctnagggatccctgagcgattcnctggctcaggtcnggggacaacggtcacattggccatcagtgagtcaggcagaggacgaggctgactattatgtcaatcaacagacacattggtacttatgtcttggaactgcaccaaggtcacgtcctggcaagcccaacggccaacccactcgtactac

SEQ ID NO: 383123 - DNA, 536 bp, Homo sapiens
  misc_feature: GZ8MTXP02FW1KD.51.71.G05.1.454.CMB.2.raw
  modified_base (236)..(236): a, c, t, g, unknown or other
  modified_base (279)..(279): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggcccctgtgtggngatgtataaagacactgagacggccctgagggactcccgtgacgcgattctctggctccgaggtcaggggacaacggtcacattggccatcagtggagtccgaggcagaggacgaggctagacttattattgtacaatacaacagaccactattggtacttatgttcgttacggaactcgaccgtaaccgtaaaggttccaccggttccgtgggtaccaacgacccgaacggacccaaaccccgtactcgtctaccg

SEQ ID NO: 383124 - DNA, 481 bp, Homo sapiens
  misc_feature: GZ8MTXP02IDPSK.51.71.G05.1.454.CMB.2.raw
  modified_base (236)..(236): a, c, t, g, unknown or other
  modified_base (307)..(307): a, c, t, g, unknown or other
  modified_base (474)..(474): a, c, t, g, unknown or other
  modified_base (478)..(478): a, c, t, g, unknown or other
  modified_base (480)..(480): a, c, t, g, unknown or other
tcagcgatcgtatacacgaccggtgctcgatttagtgtcgtcgcaagagagaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtacagcagaagccgggcaggcccctgtgtggtgatgtataaagacactgagaggccctnagggatccctgagcgattctctggctcaggtcaggggacaaggtcacattggcatcagtgagtcaggcagaggacgaggctgactattattgtacaatcaacagacacattgtacttatgtctcggaactgcgacaaggtcacgtctggcaagccaaggccaacccnctcncnc

SEQ ID NO: 383125 - DNA, 535 bp, Homo sapiens
  misc_feature: GZ8MTXP02HOGF8.51.71.G05.1.454.CMB.2.raw
  modified_base (315)..(315): a, c, t, g, unknown or other
  modified_base (345)..(345): a, c, t, g, unknown or other
tcagcgatcgtatacacgaccggtgctcgatttagtgtcgtcgcaagagagagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtgttggtgatgtataaaagacactgagaggccctnaggggatccctgacgcgattctctggctcnggtcagggacaacggtcaaagttggcccatcagtggagtccaggcagaggacgagggctagactagttattgtacaatacaacagacaccattaggtacttatgtactttcggaacttggaccgacgtaaacggtccaaccgttcctggggtaaccacgacccgaaacggcccaaaccccactactaccc

SEQ ID NO: 383126 - DNA, 494 bp, Homo sapiens
  misc_feature: GZ8MTXP02FYJUK.51.71.G05.1.454.CMB.2.raw
  modified_base (312)..(312): a, c, t, g, unknown or other
  modified_base (418)..(418): a, c, t, g, unknown or other
  modified_base (467)..(467): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctnagggatccctgagcgattctctggctccaggtcaggggacaacggtcacattggccatcagtggagtccaggcagaggacgaggctagactattatgtcaatcaanagacaccattggtacttatgtcttcggaactgcgacaaggtcaccgtcnggtcaagccaggccaccgactcgctac

SEQ ID NO: 383127 - DNA, 499 bp, Homo sapiens
  misc_feature: GZ8MTXP02IKEE7.51.71.G05.1.454.CMB.2.raw
  modified_base (342)..(342): a, c, t, g, unknown or other
tcagcgatcgtatacacgaccggtgctcgatttagtgtcgtcgcaagagagagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggcaggcccctgtgttggtgatgtataaagacactgagaggccctgagggatccctgacgcgattctctggctccnggtcagggacaacgtcacattggccatcagtggagtccgaggcagaggacgaggctagactagttattgtcaatcaacagacacattggtacttatgtcttaggactgacgaacaaggtccacgtctaagggtcacgcccaaggcccaacccactcg

SEQ ID NO: 383128 - DNA, 519 bp, Homo sapiens
  misc_feature: GZ8MTXP02HTZFN.51.71.G05.1.454.CMB.2.raw
  modified_base (238)..(238): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggccaggcccctgtgttggtgatgtataaagacactgagaggccctgaggggactccctggagcgacttctctggcttcaggttcaggggacaaacggtcacattcggccatcagtggagtccaggcagaggacgaggctgactattattgtacaatcaacggacacattaggtacttatgtcttacggaactcgacgaccaacgtcaccgtccgtgggtccagcccgaaggacccaacccgatacgtcactccg

SEQ ID NO: 383129 - DNA, 504 bp, Homo sapiens
  misc_feature: GZ8MTXP02FYHW4.51.71.G05.1.454.CMB.2.raw
  modified_base (398)..(398): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctcaggtcaggggacaacggtcacattggccatcagtggagtccaggcagaggacgaggcngactagttatgtacaatcaaacagacacattgtacttatgtctcggaactgacgacaaggtcaccgtcctgggtacaacgcccaaggcccaacccactcgactacc

SEQ ID NO: 383130 - DNA, 543 bp, Homo sapiens
  misc_feature: GZ8MTXP02IRAZI.51.71.G05.1.454.CMB.2.raw
  modified_base (286)..(286): a, c, t, g, unknown or other
  modified_base (434)..(434): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccacggcccctgtgttggngatgtaataaagacactgagacggccctgagggactcccgtgacgcgtacttctctggctcgaggtcaggggacaacggtcactagttggacatcgagtggacgtccgaggcaggaggacgaggctgacttattattgtacaatcaanagacactagttagtacttagtgtacgttacgtaacgtgacgaccaaacggtcctaccgtccgttcggtcgaacgacccgaaacggacccaacccactacgtacctaccg

SEQ ID NO: 383131 - DNA, 510 bp, Homo sapiens
  misc_feature: GZ8MTXP02G196L.51.71.G05.1.454.CMB.2.raw
  modified_base (334)..(334): a, c, t, g, unknown or other
  modified_base (502)..(502): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtgttggtgatgtataaagacactgagaggccctgagggactcccgtgagcgattcnctggctccaggtcaggggacaacggtcacattggccatcagtggagtccaggcagaggacgaggctgactattatgacaatcaaacagaccacctagttggtacttatgtcttcggaactgacgacaaggtcaccgtcgtggcaacgacccaacggccctaacccacncgtctacc

SEQ ID NO: 383132 - DNA, 539 bp, Homo sapiens
  misc_feature: GZ8MTXP02JAI58.51.71.G05.1.454.CMB.2.raw
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgcttattggtaccagcagaagccgggcacggcccctgtgttggtgatgtaataaagacactgagacggccctcgagggactcccgtgacgcgtattctcgtggcctccgaggtcaggggacaacggtcacgattcggccatcgagtggacgtccgaggcaggaggacgaggctagacttattattgtacaatcaacagacacctattcggtaacttatgtacttacggaactgacgacgaaaggtccaccgtaccgtgggtacaacgacccaacggcccaacccgactcgtactacc

SEQ ID NO: 383133 - DNA, 512 bp, Homo sapiens
  misc_feature: GZ8MTXP02IIQT0.51.71.G05.1.454.CMB.2.raw
  modified_base (347)..(347): a, c, t, g, unknown or other
  modified_base (502)..(502): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtaataaagacactgagaggccctgagggatccctgagcgattctctggctcaggtcnggggacaacggtcacagttcggccatcagtggagtccgaggcagaggacgaggctgactattattgtacaatcaacagacacattgtacttatgtcttcggaactgacgacaaaggtccaccgtcctgggtacaacgcccgaaggcccaaacccnctcgactacc

SEQ ID NO: 383134 - DNA, 567 bp, Homo sapiens
  misc_feature: GZ8MTXP02GKXK1.51.71.G05.1.454.CMB.2.raw
  modified_base (237)..(237): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccgggccaggcccctgtgttggtgatgtataaagacactgagaggccctgagggatccctgagcgattctctggctccaggttcaggggacaacggtcacattggccatcagtggacgtccaggcagaggacgaggctgactagttattgtacaatcaaacagaaccacctattaggtacttaagtcgttacgttacgggaaactcgtaccggaaacctaaaggggtcctaacccggtccgttcggggttaccaacggacccccgaaacgggacccccaaaccccgtactacggtaccctaacccg

SEQ ID NO: 383135 - DNA, 558 bp, Homo sapiens
  misc_feature: GZ8MTXP02JC24O.51.71.G05.1.454.CMB.2.raw
tcagcgatcgtatacacgaccggtgctcgatttagtgtcgtcgcaagagagagggggtgggtccaggaggcagaactctgggtgtctcaccatagcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtaataaagacactgagaggccctcgagggactccctgacgcgacttctcgtggctcgaggtcagggggacaaacgggtcacagttcggccatcagtggacgtccgaggcaggaggacgaggctagacttattattgtacaatcaacagacacctagttggtacttagtgtcttacggaactggccgaaccgtaaaggtccaaccggttcccgtggggtaccaacggaccccaaacgggaccccaaaccccctacgtccgtacctaaccc

SEQ ID NO: 383136 - DNA, 676 bp, Homo sapiens
  misc_feature: GZ8MTXP02IP1OY.51.71.G05.1.454.CMB.2.raw
  modified_base (240)..(240): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttatggtaccagcagaagccggccacggcccctgtgttggtgatgtaataaagacactgagacggccctgagggctccccgtgacgtcgtacttcctctcggcttaccgaggttccgagggggaccaaacgggttccaacgtactttcgggaccctagtaccgaagtcggacgtacccgagggaccgaggaacgggaaccggagggtcttacggaactttaaagtttacgttgtaactaaattaccgaaaacaggtaaaccaaccgtagtttacgggttaacctttaagttcgttacgttaaccggtaaacgtcgtaacccggaaaccgtaaacgggttcccgtaacccgttccgttacgggggtacccaacggtacccccgaaaacgggacccccaaaaccccccggtattaccggtaccttaaaccccg

SEQ ID NO: 383137 - DNA, 525 bp, Homo sapiens
  misc_feature: GZ8MTXP02GNC90.51.71.G05.1.454.CMB.2.raw
  modified_base (333)..(333): a, c, t, g, unknown or other
  modified_base (363)..(363): a, c, t, g, unknown or other
  modified_base (426)..(426): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtaccagcagaagccgggccaggcccctgtgttggtgatgtataaagacactgagaggccctagagggactccctgagcgattcnctggctccgaggtcaggggacaacggtcanagttcggccatcagtggagtccgaggcagaggacgaggctagacttattatgtactaatcaanagacactattgtacttatgtctacggactgacgaccgaaaggtcctaaccgtccgtaggtacaacgacccgaaacggccccaaacccactcgtacaccg

SEQ ID NO: 383138 - DNA, 513 bp, Homo sapiens
  misc_feature: GZ8MTXP02G1I22.51.71.G05.1.454.CMB.2.raw
  modified_base (239)..(239): a, c, t, g, unknown or other
  modified_base (408)..(408): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggccaggcccctgtgtggtgatgtataaagacactgagaggccctcgagggactccctgagcgattctctggctccaggtcaggggacaacggtcacattggccatcagtggagtccgaggcagaggacgaggctgactattntagtcaatcaaacagacaccattggtacttatgtcttacggaactgacgaccgaaggtcaccgtctgggtcaacgacccaacggcccaacccactacgtctaccg

SEQ ID NO: 383139 - DNA, 566 bp, Homo sapiens
  misc_feature: GZ8MTXP02I0MR8.51.71.G05.1.454.CMB.2.raw
  modified_base (242)..(242): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaacgccgggccacggcccctgtgttggtgatgtaataaaagacactagagacggccctcgagggactcccgtgacgcgattcgtctggcttccgagggtcaaggggaccaacggtcacagttcggccatcaggtggacgtccgaggcaggaggacgaggctagaacttagttattgtacaatacaaacagaccactagttggttaacttagttcgttacttacggaaacttcggacctaaccgtaacgggtccaaccgttccgtgggtaccacgacccgaacggaccccaaccccacgtttccg

SEQ ID NO: 383140 - DNA, 503 bp, Homo sapiens
  misc_feature: GZ8MTXP02IPRFD.51.71.G05.1.454.CMB.2.raw
  modified_base (239)..(239): a, c, t, g, unknown or other
  modified_base (278)..(278): a, c, t, g, unknown or other
  modified_base (304)..(304): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccaaacgntatgcttatgtacagcagagcggcagcccctgtgtggtnatgtataaagacactgagaggccctnagggatccctgagcgattctctggctcaggtcaggggacaacggtcacattggcatcagtgagtcgagcagaggacgaggctgactattacttgtacaatcaacagacaccattagtaacttatgtcttacggaacttgacgacgtaaaggtcaccgtccgtgggtcaacgacccaaggacccaacccacttcgactac

SEQ ID NO: 383141 - DNA, 549 bp, Homo sapiens
  misc_feature: GZ8MTXP02HSJBZ.51.71.G05.1.454.CMB.2.raw
  modified_base (286)..(286): a, c, t, g, unknown or other
  modified_base (338)..(338): a, c, t, g, unknown or other
  modified_base (348)..(348): a, c, t, g, unknown or other
tcagcgatcgtatacacgaccggtgctcgatttagtgtcgtcgcaagagagagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttatggtaccagcagaagccggcaggcccctgtgttggngatgtaataaagacactgagaggccctgagggactcccgtgacgcgtattcnctggcctcgnggtcagggacaacggtcacattcggccatcagtggagtccgaggcaggaggacgaggctagacttattattagtacaatacaaacagacaacctagttaggtaacttatcgtacttacggaaacttcgacgtaaccgaacggtccaacccggttcgtaacgggtcaacgaccccgaaacggaccccaaacccgacttaccg

SEQ ID NO: 383142 - DNA, 545 bp, Homo sapiens
  misc_feature: GZ8MTXP02HDH3E.51.71.G05.1.454.CMB.2.raw
  modified_base (239)..(239): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggccaggcccctgtgttggtgatgtataaagacactgagaggccctgagggatcccgtgagcgacttctcgtgctccgaggtcagggacaacggtcactattggccatcagtggagtccgaggtccaggaggacgaggctagactattatgtcaatcaacgtagacaccagttggtacttagtcgttacttacggaactggaccgaaaccgaggtaccaccgttcgtacgggtacaacggacccgtaaacggccccaaaccccgtctaccgtacctaccg

SEQ ID NO: 383143 - DNA, 497 bp, Homo sapiens
  misc_feature: GZ8MTXP02FUYK6.51.71.G05.1.454.CMB.2.raw
  modified_base (239)..(239): a, c, t, g, unknown or other
  modified_base (311)..(311): a, c, t, g, unknown or other
  modified_base (344)..(344): a, c, t, g, unknown or other
  modified_base (464)..(464): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggcaggcccctgtgtggtgatgtataaagacactgagaggccctnagggatcctgagcgattctctggctcgaggtcnggggacaacggtcacattggccatcagtggagtccaggcagaggacgaggctagactattatgtacaatcaacagacactattggtacttatgtctaggaactgcgacaagtcaccgtcnggtcaagcccaaggcccaacccactcgactacc

SEQ ID NO: 383144 - DNA, 546 bp, Homo sapiens
  misc_feature: GZ8MTXP02JI64Y.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgaccaaaccgatatgcttatggtaccagcagaagccgggccaggcccctgtgttggtgatgtaataaagacactgagacggccctgaggggactccccgtggaacgcgtaactttcctcgtcggccttccgaagggttcgaggggacaaacgggtgacagttggccatcgagtggagtccgaggcagaggacgaggctagacttattattgacaatcaacagacactattgtacttatcgtcttacggaactgaccaccgaaacggtcaccgtcgtgggacaacgacccaacggcccaacccactcgtactaccc

SEQ ID NO: 383145 - DNA, 636 bp, Homo sapiens
  misc_feature: GZ8MTXP02GGB6T.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccgggccaggcccctggtgttggtgatgtaataaagacactgagacggccctcgagggactccctgagcgacttctctggctccgaggtcaggggacaacgggtcactagttggccatcgaggtggagtccgaggcgaaggacggaacggaggcctaggacttaagttattaggtactaaataccaaacaagaaaccctaacctaagtttacggtaactttaacgtagttacgtttacggaaacttacggacgtaaacccgtaaacgggttccgtaacccggtccggttacgggggttacccaaaccggtaaccccccgtaaaacggggtaccccccaaaacccccgtactaccggttaccctttaaccccgg

SEQ ID NO: 383146 - DNA, 540 bp, Homo sapiens
  misc_feature: GZ8MTXP02JYEDJ.51.71.G05.1.454.CMB.2.raw
  modified_base (240)..(240): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggccaggcccctgtgttggtgatgtaataaagacactgaagacggccctcgagggactcccgtgagcgattctctggctccgaggtcaggggacaacggtcacagttggaccatcagtggagtccgaggcaggaggacgaggctagacttagttattgtacaatacaaacagaacaacctagttaggtacttagtgtacttacggactgacgacctaacggcaccgtcctgggtcaacgacccgaacggccccaacccgactacgtcctaccg

SEQ ID NO: 383147 - DNA, 522 bp, Homo sapiens
  misc_feature: GZ8MTXP02I00F1.51.71.G05.1.454.CMB.2.raw
  modified_base (238)..(238): a, c, t, g, unknown or other
  modified_base (410)..(410): a, c, t, g, unknown or other
  modified_base (421)..(421): a, c, t, g, unknown or other
  modified_base (512)..(512): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggccaggcccctgtcgttggtgatgtataaagacactgagaggccctgagggactcccgtgagcgattctctggctcgaggtcaggggacaacggtcacgattggccatcagtggagtccgaggcagaggacgaggctgacttatnttgcaatcaanagacaaccattggtaacttagtgtcttacggaacttcgcgaaccaaaggtccaaccgtctcgggtacaacgccccaacggcccaaaacccnctcgactacc

SEQ ID NO: 383148 - DNA, 502 bp, Homo sapiens
  misc_feature: GZ8MTXP02FKOJR.51.71.G05.1.454.CMB.2.raw
  modified_base (471)..(471): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagcactgagaggccctcaggggatccctgagcgattctctggctccaggtcagggacaaacggtcacattggccatcagtggagtccaggcagaggacgaggctagactagttatgtacaatcaaacagacaccattggtacttatgtcttcggaactgcgacaaggtcaccgtcngggtcaagcccaaggccaacccactcgctac

SEQ ID NO: 383149 - DNA, 616 bp, Homo sapiens
  misc_feature: GZ8MTXP02INYDN.51.71.G05.1.454.CMB.2.raw
  modified_base (357)..(357): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgcttatggtaccagcagaacggccggccacggcccctgtgttggtgatgtaataaagacacgtgagacggccctcgagggactcccgtgacgcgtattctctggcctcgnggtcaagggaccacggtcacattcggccatcgagtggacgtccgaggcgaggacggacggaggcctaggaacttagtttagttagtactaaagtaccaaacgacgaacctaaccgtaagtttacggttaacctttagtacgttaccgttacggtaacgttacggtaccgaaaccgtaacgggtaccctaacccggttccgtaacggggtaccaacccggaccccgaaacggtaccccctaaaaccccgtacgttcccgg

SEQ ID NO: 383150 - DNA, 491 bp, Homo sapiens
  misc_feature: GZ8MTXP02JHIBC.51.71.G05.1.454.CMB.2.raw
  modified_base (343)..(343): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtaccagcagaagccggcaggcccctgtgtggtgatgtataaagacactgagaggccctcgagggactccctgagcgattctctggctccaggtcnggggacaacggtcacattggccatcagtggagtccaggcagaggacgaggctagactattatgtcatacaacagacacattgtacttatgtcttcggaactgcgacaaggtcacgtctggtcaagccaacggccacccgactcgctac

SEQ ID NO: 383151 - DNA, 498 bp, Homo sapiens
  misc_feature: GZ8MTXP02GG27Z.51.71.G05.1.454.CMB.2.raw
  modified_base (238)..(238): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatgtaccagcagaagccggccaggcccctgtgtggtgatgtataaagacactgagaggccctcagggatccctgagcgattctctggctccaggtcaggggacaacggtcacattggccatcagtggagtccaggcagaggacgaggctagactattatgtcaatcaacagacactattggtacttatgtcttcggaactgcgaccaaggtcaccgtctgggtcaacgcccaaggcccaacccactcgctacc

SEQ ID NO: 383152 - DNA, 513 bp, Homo sapiens
  misc_feature: GZ8MTXP02HVWIO.51.71.G05.1.454.CMB.2.raw
  modified_base (238)..(238): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgtggtgatgtataaagacactgagacggccctcgagggatccctgagcgtattctctggctcaggtcaggggacaacggtcacagttggccatcagtgatcaggcagaggacgaggctgactattattgtactaatacaacagacactattcggtacttatgtcttacggacttggacgacaaaggtcaccgtcgtgggtacaacgacccaacggcccaacccactcgtctacc

SEQ ID NO: 383153 - DNA, 543 bp, Homo sapiens
  misc_feature: GZ8MTXP02ILUEZ.51.71.G05.1.454.CMB.2.raw
  modified_base (239)..(239): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtaataaagacactgagacggccctgagggactcccgtgaggcgattctctggctccgaggtcaggggacaaacggtcactattcggccatcagtggagtccgaggcaggaggacgagctagactattattgtacaatacaacagacaacctattacggtacttatgtacttacggtaactgaccgaactaagggtcctaccgtccgtaggtaccaacgacccgaaacggcccaaacccgctacgtactacccg

SEQ ID NO: 383154 - DNA, 596 bp, Homo sapiens
  misc_feature: GZ8MTXP02GNGUK.51.71.G05.1.454.CMB.2.raw
  modified_base (365)..(365): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtggagatgctattcgacccaaacgatatgtacttagtcgtacagcaagaacgccggccacggccctgtgttggtgatagtaataaagactacgtaggagacggccctagaggactcccgtgacgcgtacttctcgtggcctcgnggtacgacgggacaaccggtcaacgtagttcggacctatccgtagtggtaacgtacccgaggccgaagggaacgggacggaggaccgtagtaacgttaatttagttgtacaaacgtacaaacgacgtaccaactagtttcggtactttagtcgttacgttacggaactcgtaccgaacgtaacggtccaccgttcgtggtacacgacccgaacggacccaaccctagtccg

SEQ ID NO: 383155 - DNA, 512 bp, Homo sapiens
  misc_feature: GZ8MTXP02HNYN5.51.71.G05.1.454.CMB.2.raw
  modified_base (345)..(345): a, c, t, g, unknown or other
tcagcgatcgtatacacgaccggtgctcgatttagtgtcgtcgcaagagagagggggctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgccaaacgatatgcttattggtaccagcagaagccggccaggcccctgtgtggtgatgtaataaagacactgagaggccctgagggactccctgacgcgattctctggctccnggtcagggacaacggtcacattggccatcagtggagtccgaggcagaggacgaggctagactattattgacaatcaacagacacattgtacttatcgttcttacggaactcgacgaaccacggtccaccgtcgtcgggtacacgacccgaagacccaaccccatccg

SEQ ID NO: 383156 - DNA, 513 bp, Homo sapiens
  misc_feature: GZ8MTXP02G56VX.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggcaggcccctgtgttggtgatgtaataaagacactgagaggccctgagggactcctgagcgattctctggctccgaggtcaggggacaaacggtcacattggccatcagtggagtcaggcagaggacgagggctagactattatgtacaatcaacagacaaccattaggtacttatgttcttcggaactgacgacaaggtcaccgtctgggtcaacgcccaacggcccaacccgactcgactacc

SEQ ID NO: 383157 - DNA, 569 bp, Homo sapiens
  misc_feature: GZ8MTXP02GLOF0.51.71.G05.1.454.CMB.2.raw
  modified_base (224)..(224): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaaccgatatgcttattggtaccagcagaagccgggccaggcccctgtgttggtgatgtaataaagacactgagaggccctcgagggactcccgtgagcgacttctctggctcgaggtcacggggacaacggtcacagttcggccatcagtggacgtccgaggacaggaggacgaggctgactagttatgtacaatacaaacgagaacacctaagtttacggtaactttatacgttcgttacggtaaacttgaccgtaccgaaaggtccaacccgttccgtacggggtccaacgccccgaaacggtaccccaaaccctacgtcgtacctacccg

SEQ ID NO: 383158 - DNA, 562 bp, Homo sapiens
  misc_feature: GZ8MTXP02IM0KE.51.71.G05.1.454.CMB.2.raw
  modified_base (300)..(300): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgcttatggtaccagcagagccggcaggcccctgtgtgtgatgtataagacactgagnggccctagaggactccgtgagcattcctctggctccgaggtcaggggacaacggtcactagttcggaccatcgagtggacgtccgagggacaggacgggaacgaggcctaggacttaagttacgttgtacaatacgaactaagaccactagttggtaacttagtacgtcttacggtaacttggaccgaacgtaaacggcctaccgttccgtggggtaccaacggaccccgaacggaccccaaaacccgtctacgtactaccc

SEQ ID NO: 383159 - DNA, 558 bp, Homo sapiens
  misc_feature: GZ8MTXP02JTRVS.51.71.G05.1.454.CMB.2.raw
  modified_base (237)..(237): a, c, t, g, unknown or other
tcagcgatcgtatacacgaccggtgctcgatttagtgtcgtcgcaagagagaggggcacgaccggtgctcgatttagtgtcgtcgcaagagagaggggggggagcctagctgtgctgtgggtccaggaggcagaactctgggtgtctcaccatggcctggatccctctacttctccccctcctcactctctgcacaggctctgagcctcctatgagctgacacagcccaccctggtntcagtcgccccaggacagacggccaggatcacctgctcgtggagatgcattcgaccaaaccgatatgtcttagttggtaccagacagaacgccggcccgacggcccctgtgttggtgatgtaataaagcatgagacgccctcgagggactcccgtggacgcgtattcctcgtggcctaccgaggtacgagggaaccaacgggttcaactagttcggacctaagtccaggttcgacgttccagtcgacgagggacggacggacggctacgaacttaatttagtaacgtactaaaactcaaaacacgaaccacctttaaacgg

SEQ ID NO: 383160 - DNA, 521 bp, Homo sapiens
  misc_feature: GZ8MTXP02IHAM7.51.71.G05.1.454.CMB.2.raw
  modified_base (427)..(427): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtaccagcagaagccggccaggcccctgtgtggtgatgtataaagacactgagaggccctgagggactccctgagcgtattctctggctcgaggtcaggggacaacgggtcactattcggacctatcagtggacgtccagggcaggaggacgaggctagactattattgtacaatcaanagacacattaggtacttatgtacttcgtactgtacgactaacggtcaccgtcgtcggtcaacgcccaacggacccaacccgctacgtactaccg

SEQ ID NO: 383161 - DNA, 497 bp, Homo sapiens
  misc_feature: GZ8MTXP02G4LQH.51.71.G05.1.454.CMB.2.raw
  modified_base (307)..(307): a, c, t, g, unknown or other
  modified_base (317)..(317): a, c, t, g, unknown or other
  modified_base (326)..(326): a, c, t, g, unknown or other
  modified_base (374)..(374): a, c, t, g, unknown or other
  modified_base (385)..(385): a, c, t, g, unknown or other
  modified_base (395)..(396): a, c, t, g, unknown or other
  modified_base (403)..(403): a, c, t, g, unknown or other
  modified_base (405)..(405): a, c, t, g, unknown or other
  modified_base (407)..(407): a, c, t, g, unknown or other
  modified_base (409)..(409): a, c, t, g, unknown or other
  modified_base (414)..(414): a, c, t, g, unknown or other
  modified_base (428)..(428): a, c, t, g, unknown or other
  modified_base (430)..(430): a, c, t, g, unknown or other
  modified_base (439)..(439): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctggagatgcattgccaaaaccgatatgcttaattggtaccagcagaaagccgggccaggcccctgtgtggtgatgtataaaagaacacngagaggcccncaggatccngagcgactctctgctcaggcgagggaacgaaacggtacacatgacatnagtggagcagnagaggagagnnatatatntnananaacanacacatagtatatntntcgtactancgacgaacgacaccgtccgtcggtcgaacgaccgaacgaccaacccacctacgtacac

SEQ ID NO: 383162 - DNA, 521 bp, Homo sapiens
  misc_feature: GZ8MTXP02GR4LJ.51.71.G05.1.454.CMB.2.raw
  modified_base (239)..(239): a, c, t, g, unknown or other
  modified_base (429)..(429): a, c, t, g, unknown or other
  modified_base (436)..(436): a, c, t, g, unknown or other
  modified_base (454)..(454): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccgggccaggcccctgtgttggtgatgtaataaagcactgagaggcccctgaggggactcccgtggagcgacttctctggcctccgaggtcgaggggtacaacgggtcacgagttcggccatcaggtggacgtccgaggcaggaggacgagcgtagactattatgtnaatcaanagacacctagtgtacttntgtctacgtaactgacgacgagtccaccgtcgtggtcaacgcccgaaggcccaaccactcgactacc

SEQ ID NO: 383163 - DNA, 507 bp, Homo sapiens
  misc_feature: GZ8MTXP02HDIAL.51.71.G05.1.454.CMB.2.raw
  modified_base (237)..(237): a, c, t, g, unknown or other
  modified_base (342)..(342): a, c, t, g, unknown or other
  modified_base (422)..(422): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgctatggtaccagcagaagccggccaggcccctgtgtggtgatgtataaagacactgagaggccctgagggatcccgtgagcgattctctggctcgaggtcnggggtaccaacggtcactattcggccatcaagtggaagtccgaggcagaggacgaggctgactattattgacaatcaaanagacactattgtacttatgtcttacggaactgacgaacaaggtcaccgtctggcaagcccaaaggcccaacccactcgtacaccg

SEQ ID NO: 383164 - DNA, 620 bp, Homo sapiens
  misc_feature: GZ8MTXP02H951Y.51.71.G05.1.454.CMB.2.raw
  modified_base (227)..(227): a, c, t, g, unknown or other
  modified_base (245)..(245): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttcctccccctcctcactctctgcacaggctctgaggcctcctatgagctgacacagcccaccctggtgtcagtcgtccccaggacagacggccaggatcacctgctctgganatgcattcgaccaaacgntatgcttatggaccagcaagaacgccggcacggccctggtgtggtgatgtaataaagacacgtaggacgacggtccctacggaaggggactccccgtaggaaccgtcggtatttccgcgttcggtccttcccgaggtcgaacgggaacctaaaccgggtcaacgtagttcgggaccctaagcgtaggtacggacgtacccgagggacgaagggaacgggacgagggtactaggtaacttatttaagtttagtaacaaactacaaacacgacaacctagttacggtacttaagtcgttacgtacggtactacgaccgtaactaacgtccgtaaccgtcgaacgggtcacggacccaacggccccaaccgtacctcg

SEQ ID NO: 383165 - DNA, 505 bp, Homo sapiens
  misc_feature: GZ8MTXP02JY0ZA.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcgagggatcccgtgagcgattctctggctcgaggtcaggggacaacggtcacattggccatcagtggagtccaggcagaggacgaggctgactatatgtacaatcaacagacaccattgtacttatgtcttcggaactgcgaacaaggtcaccgtcctgggtcaacgcccaacggcccaacccactcgctacc

SEQ ID NO: 383166 - DNA, 556 bp, Homo sapiens
  misc_feature: GZ8MTXP02I55ZP.51.71.G05.1.454.CMB.2.raw
  modified_base (286)..(286): a, c, t, g, unknown or other
  modified_base (314)..(314): a, c, t, g, unknown or other
  modified_base (430)..(430): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggngatgtaataaagacactgagaggccctnagggatcccgtgagcgattctctggctcgaggtcaggggacaacggtcactagttggcctatcagtggatccgaggcaggaggacgaggctagactagttattgtactaaatcaanacgacacctattaggtaacttagtgtacgtttacggaaacttggaccaaccgaaagggttccacccggtaccgtgggtaccaacggccccgaaacggaccccaaccccgtactaccgtactacccg

SEQ ID NO: 383167 - DNA, 594 bp, Homo sapiens
  misc_feature: GZ8MTXP02FRK5X.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtacagcagaagccgggccaggcccctgtgttggtgatgtataaagacactgagacggccctgaggggactcccgtgacgcgtacttctcgtggcctcgaggtcgaggggacaacggtcacattggccatcgagtggagtccgaggcaggacggacgagggctagacttaagttacgttgtacaaagtagaaacagtaaccaccgtattcggttaacttagtcgttacgtacggtaaactcgaccgtaaccgtaaacggtccgtacccggttaccgtacggggtaccaaccggtaccccgaaaacgggtacccccaaaccccctacgtaccggtacctaaacccg

SEQ ID NO: 383168 - DNA, 732 bp, Homo sapiens
  misc_feature: GZ8MTXP02IKNSP.51.71.G05.1.454.CMB.2.raw
  modified_base (242)..(242): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgacccaaaccgntatgcttattggtaccagcagaagccgggccaggcccctgtgttggtgatgtaataaagacactgagacggccctgagggactccccgtgaacgcgtactttcctcgtcgggctaccgtaggttcacgggggaccaaacggggtcaaccgtagtttcgggaccctaagttccgaggtacgggtagtaccccgagggacccgaagggacgggaacggagggtactacggtaaccttaaagtttagtttacggttaacctaaaacgttaccaaaacgaaacggtaaccctaaacccgttaagttttacggggtttaaaccttttagttacggtttacccgtttaacgggtaaaccgtttacggacccggtaaaccggtaaacgggttaccccgtaacccgggtttacccgttacgggttacccgaaccggtaacccccgaaacgggtacccccaaaacccccggtaccttaccggttacccgttaacccccg

SEQ ID NO: 383169 - DNA, 623 bp, Homo sapiens
  misc_feature: GZ8MTXP02FXJ8L.51.71.G05.1.454.CMB.2.raw
  modified_base (284)..(284): a, c, t, g, unknown or other
  modified_base (324)..(324): a, c, t, g, unknown or other
  modified_base (336)..(336): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatcacctgctctggagatgcattcgaccaaacgatatgcttagttggtaccagcagacgccggcacggccctgtgtgngatgtaataaagcactgagacggccctgagggactcccgngagcgtacttcncgtgctcgaggtcgaggggacaaacggtcacagttcggacctatacgagttaggacgtacccgaggaccaagggacggaaccggaaggtcctagaactttaatttattacggtacaaacttaccgaaaacacgaaaccctaccgtaagtttagggtttaaaccttagttcgtaccgtttaacgggaaacttcggaccgtaaacccgtaaaggttcccgaacccgttccgtggggtaccaaccggaccccgaaacggacccccaaacccctacgtacgtccctaaccg

SEQ ID NO: 383170 - DNA, 515 bp, Homo sapiens
  misc_feature: GZ8MTXP02IJELA.51.71.G05.1.454.CMB.2.raw
  modified_base (425)..(425): a, c, t, g, unknown or other
  modified_base (503)..(503): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtaccagcagaagcggccaggcccctgtgtggtgatgtaataaagacactgagaggccctgagggactccctgagcgtacttctctggctcgaggtcaggggacaaacggtcacagttggaccagtcagtggagtccaggcagaggacgaggctagactattattgtacaatcaanagacactattgtacttatgtcttacgaactgacgacaaggtccaccgtccgtggtcaacgcccaacggcccaaacccnctacgtactacc

SEQ ID NO: 383171 - DNA, 500 bp, Homo sapiens
  misc_feature: GZ8MTXP02GDVO8.51.71.G05.1.454.CMB.2.raw
  modified_base (307)..(307): a, c, t, g, unknown or other
  modified_base (341)..(341): a, c, t, g, unknown or other
  modified_base (391)..(392): a, c, t, g, unknown or other
  modified_base (465)..(465): a, c, t, g, unknown or other
  modified_base (490)..(490): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgatatgcttatggtaccagcagaagccggccaggcccctgtgtggtgatgtataaagacactgagaggccctnagggatccctgagcgattctctggctccaggtcnggggacaacgttcacattcggccatcagttggagtcaggcagagacgagnngactagtattgtacaatcaaacagaaccaccattagtacttatgtacttcgaactgcgacaaaggtcacgtcnggtcaagtcccaaacggccaacccnctcgtctacc

SEQ ID NO: 383172 - DNA, 514 bp, Homo sapiens
  misc_feature: GZ8MTXP02H6JDD.51.71.G05.1.454.CMB.2.raw
  modified_base (240)..(240): a, c, t, g, unknown or other
  modified_base (254)..(254): a, c, t, g, unknown or other
  modified_base (281)..(281): a, c, t, g, unknown or other
  modified_base (407)..(407): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgaccaaaccgntatgcttatgtacngcagagccggcaggcccctgtgtggtnatgtataaagacactgagaggccctgagggactccctgagcgattctctggcctcaggtcaggggacaacggtcactattcggccatcagtggagtccgaggcaggaggacgaggctagatagttnttagtacaatcaaacagaaccacgatttaggtactttagtgtcttacgaactgaccgacaaggtccacgtcgtgggtcaacgcccaacgccaacccgacttgacctc

SEQ ID NO: 383173 - DNA, 506 bp, Homo sapiens
  misc_feature: GZ8MTXP02FP4KO.51.71.G05.1.454.CMB.2.raw
  modified_base (239)..(239): a, c, t, g, unknown or other
  modified_base (312)..(312): a, c, t, g, unknown or other
  modified_base (345)..(345): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgtggtgatgtataaagacactgagaggccctnagggatccctgagcgattctctggctcaggtcngggacacggtcacattggccatcagtggagtccaggcagaggacgaggctgactattatgtcaatcaacagacaccattaggtacttagtgtcttcgaactgcgaaccgaaaggtcaccgtccgtggtacaacgcccaacggcccaaccccactcgctacc

SEQ ID NO: 383174 - DNA, 595 bp, Homo sapiens
  misc_feature: GZ8MTXP02G660Q.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctcgtggagatgacattcgaccaaacgatatgcttattgtaccagcagaacgccgggccacggcccctgtgttggtgatagtaataaagacatgagacggccctagagggactcccgtagacgcgtacttctcgtggcctcgaggtacgaggggaaccaacggtcacgtagttcggacctagtcgaggtcggacgtccgaggacgaggacggacgaggctagattattatgtactaatacaaacagaaccaacctagttacggtacttagtcgttacgttacgtaacttcggaccgtaaaccgtaggtacccgtaccgtaccgttcggaccgaaccgacccgaaccggaccccaaccctacgttaccgtccttaacccg

SEQ ID NO: 383175 - DNA, 560 bp, Homo sapiens
  misc_feature: GZ8MTXP02JYOPG.51.71.G05.1.454.CMB.2.raw
  modified_base (240)..(240): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggccaggcccctgtgttggtgatgtaataaagacactgagacggccctcgagggactcccgtagagcgacttctcgtggctcaggtcaggggacaacggtcacattcggaccatcgagtggagtccaggcagaggacgaggctgactattatgtacaatcaacagacaacctagttacggtacttagtcgtactttacggaaacttggaccgaaccgtaaaggtcctaacccggtccgtcggggtacaaccggaccccaacgggccccaaccccgacttcggtacctaacccg

SEQ ID NO: 383176 - DNA, 560 bp, Homo sapiens
  misc_feature: GZ8MTXP02HC9AL.51.71.G05.1.454.CMB.2.raw
  modified_base (239)..(239): a, c, t, g, unknown or other
  modified_base (453)..(453): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgccaaacgntatgtcttattggtaccagcagaagccgggccaggcccctgtgttggtgatgtaataaagacactgagaggccctgagggactcccgtgagcgtacttctcgtggctccgaggttcgacggggaactaacgggtcaacgtagttcggcccaatcgagtggagtccgaggcaaggacggacgagggctgaacttatttattgtactaatacaaanacgaacacctagttacggtaactttatgtcttacggaacttgacgtaccaaggtccaccgtcgtggacaacgacccgtaacgacccaaccctacgtcgtacctaccg

SEQ ID NO: 383177 - DNA, 516 bp, Homo sapiens
  misc_feature: GZ8MTXP02I1ZZU.51.71.G05.1.454.CMB.2.raw
  modified_base (309)..(309): a, c, t, g, unknown or other
tcagcgatcgtatacacgaccggtgctcgatttagtgtcgtcgcaagagagagggggtgggtccaggaggcagaactctgggtgtctcaacatggcctggatccctctacttctcccctcctcactctctgcacaggctctgaggcctcctatgagctgacacagccaccctcggtgtcagtgtccccaggacagacggccaggatcacctgctctggagatgcattgccaaacgatatgcttattggtaccagcagaagccggccaggcccctgtgttggtgatgtataaagacactgagaggccctnagggatccctgagcgattctctggctccaggtcaggggacaaacggtcactagttggccatcagtggagtccaggcaggaggacgaggctgactattattgtacaatcaacagacacctattggtaacttatgtctcggaactgacgtaccgaaaggtcaccgtccgtggtccaagccccaaaggcccaacccgactcgtacctacg

SEQ ID NO: 383178 - DNA, 698 bp, Homo sapiens
  misc_feature: GZ8MTXP02JWAJT.51.71.G05.1.454.CMB.2.raw
  modified_base (286)..(286): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgaccaaaccgatatgcttattggtaccagcagacgccggcacggccctgtgtggngatgtataagcatgagacggccctagagggactcccgtagacgtcgtacttcctcgtcggcctaccgagggtcagggggaccaaacgggtcacgtagttcgggacctagtccgtagggtcggacggtccgaaggggaccgaagggacggggaaccgaaggggtactacggtaaactttaagtttagtttaccggtactaaacgttaccaaaaccgaaggtaacccgtaaccttaaggtttacgggtttaacctttaagttacgtttacccgtttaacgggtaaaccgtttcggggaacccgtaaacccggtaaacgggttccccgtaaacccggtttcccggtacgggggttacccaaccggacccccgtaaacgggaccccctaaaccccgacgtttacgacccttacccg

SEQ ID NO: 383179 - DNA, 548 bp, Homo sapiens
  misc_feature: GZ8MTXP02HF2DD.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtaccagcagaagccggccaggcccctgtgtggtgatgtataaagacactgagacggccctgagggactcccgtgagcgattctcgtggctcaggtcaggggacaaacggtcacagttcggccaagtcgagtggacgtccgaggcagaggacgagctagactattattgactaatcaacagacactattaggtaacttatcgttactacggtaactgaccgaaccgtaaacggtccacccggttctcggggttaccaacggacccgaaacggaccccaaccccgtactccgtactacccg

SEQ ID NO: 383180 - DNA, 556 bp, Homo sapiens
  misc_feature: GZ8MTXP02GDX4P.51.71.G05.1.454.CMB.2.raw
  modified_base (286)..(286): a, c, t, g, unknown or other
  modified_base (490)..(490): a, c, t, g, unknown or other
  modified_base (528)..(528): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtaccagcagaagccggccaggcccctgtgttggngatgtataaaagacactgagaggccctacgagggatcccgtagacgacgtattctctggcctccgagggtcaaggggaacctaaaccgggtcaacgagttcgggacccaagttccaaggtggacgtacccgaggccaaggaggaccgaaggctagacttagttattgtacaaatacaaacagaacaccgtattggtaactttangttacttacggaactgaccgactacggtaccaccgtcnggtcacgacccaaggcccaacccgatcg

SEQ ID NO: 383181 - DNA, 543 bp, Homo sapiens
  misc_feature: GZ8MTXP02I0AEA.51.71.G05.1.454.CMB.2.raw
  modified_base (308)..(308): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtaccagcagaagccggcaggcccctgtgtggtgatgtataaagacactgagaggccctnagggactcctgagcgtattctcgtggctcaggtcaggggacacggtcacagttggccatcagttggagtccgaggcagacggacgaggctagacttagttattgtacaatcaacagaacactattggtaacttagtacgtacgttcggaaaactcggaccgaaccgtaaagggtccaaccgtccgtgggtaccaacggacccgaacggacccaaaccccgtactcgtacctaccg

SEQ ID NO: 383182 - DNA, 638 bp, Homo sapiens
  misc_feature: GZ8MTXP02FTRR8.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtaccagcagaagccggccaggcccctgtgttggtgatgtaataaagacacgtgagacggccctcgaggggactcccgtgacgcgtacttctcgtggccttcgaggtcaggggacaacgggtcactagttcggacctatcgaggtggacgtcccgaaggcgaaggacgggaacggagggctagacttaattaagttgtactaatacaaaacgtaacgaaccaaccgtaagtttcggttaaactttagttacgttaccgttacgggtaaaacttcggaccgtaaacccgtaaacgggttaccctaacccggttacccgtcggggttacccaaccggtaccccgaaaaccggacccccaaacccccgtacgttaccggtaccttaaccccg

SEQ ID NO: 383183 - DNA, 622 bp, Homo sapiens
  misc_feature: GZ8MTXP02F23ND.51.71.G05.1.454.CMB.2.raw
  modified_base (238)..(238): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattgacagcagagccggcaggccctgtgtggtgatgtaataaagacactgagacggccctgagggatcccgtgacgcgtattcctctggcctccgaggtacgagggggaaccaacgggtcacgtagttcggaccatcgaagtggaacgtccgaggcaaggacgggaacggaacgggctaggaacttaagtttagttagtacctaaattaccaaaacgtaagaaaccaacctaagtttacggttaactttaagttcggtttaccgtttacggaaacttacggaccgtaaaccgtaaacgggttccaaaccgttcccgtggggttaccaacggaccccgaaaacggtacccaaacccccgtacttacgtacctaacccg

SEQ ID NO: 383184 - DNA, 535 bp, Homo sapiens
  misc_feature: GZ8MTXP02HKKTI.51.71.G05.1.454.CMB.2.raw
  modified_base (238)..(238): a, c, t, g, unknown or other
  modified_base (281)..(281): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggcccctgtgtggngatgtaataaagacactgagaggccctgagggactcccgtgagcgattcctctggctccgaggtcaggggacaacggtcactagttcggacctagtcgagtggacgtccgaggcaggaggacgaggctagacttattattgtacaatcaaacagacaccattacggtacttatgtacttacggtactgacaccgaaaggtccaccgtcctgggtaccaacggcccaacggccctaaacccgctcgtacctaccg

SEQ ID NO: 383185 - DNA, 512 bp, Homo sapiens
  misc_feature: GZ8MTXP02FUV3B.51.71.G05.1.454.CMB.2.raw
  modified_base (409)..(409): a, c, t, g, unknown or other
  modified_base (421)..(421): a, c, t, g, unknown or other
  modified_base (475)..(475): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttattggtaccagcagaagccgggccaggcccctgtgtggtgatgtaataaagacactgagaggccctcgagggatcccgtgagcgattctctggctccaggtcaggggacaacggtcacattggccatcagtggagtccaggcagaggacgaggctagactattntgtcaatcaaanagaacacattggtacttatgtcttacggaactgacgtaccaaggtcaccgtcgnggtacaagtcccaacggaccaacccactcgtctaacc

SEQ ID NO: 383186 - DNA, 518 bp, Homo sapiens
  misc_feature: GZ8MTXP02JDT88.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgcttatggtaccagcagaagccggcaggcccctgtgtggtgatgtaataaagacactgagaggccctgagggactccctgacgcgtattctcgtgctcgaggtcaggggacaacggtcacattcggccatcagtggacgtccgaggcagaggacgaggctagactattatagtcaatcaacagacaccattgtacttatgtctacggactgacgaccgaagtccaccgtccgtggtcaacgcccgaacggaccccaacccacgtacgtctaccg

SEQ ID NO: 383187 - DNA, 589 bp, Homo sapiens
  misc_feature: GZ8MTXP02G2KP8.51.71.G05.1.454.CMB.2.raw
  modified_base (223)..(223): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattcgaccaaacgatatgtcttattgtacagcagaagccggcacggcccctgtgtggtgatgtaataaagacacgtgagacggccctacgagggtactcccgtagacgtcgtactttcgtcgtcggcctccgaggtcgaggggaccaacggtcaacgtagttcggcctagtcgaggttaggacgtccgaggcgaaggacggacgaggctagacttattagttagtacaatacaacgaagaaccactagttacgtacttatagttacgtacggtactcgaccgtaacgaacggtcctaaccgttccgtacggtacgaaccgacccgaaacggaccccaaacccgtacgttacgtacctacccg

SEQ ID NO: 383188 - DNA, 500 bp, Homo sapiens
  misc_feature: GZ8MTXP02GEZWA.51.71.G05.1.454.CMB.2.raw
  modified_base (238)..(238): a, c, t, g, unknown or other
  modified_base (308)..(308): a, c, t, g, unknown or other
  modified_base (328)..(328): a, c, t, g, unknown or other
  modified_base (417)..(417): a, c, t, g, unknown or other
  modified_base (466)..(466): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggccaggcccctgtgtggtgatgtataaagcactgagaggccctnagggatccctgagcgattcnctggctccgaggtcgagggacaacggtcacagttcggaccatcagtggagtccagcgagaggacgagctgactattatgtacaatcaanagacacattgtacttatgtctcggaactcgacacaaaggtccacgtccnggtcaacgaccaaggcccaacccactcgtctacc

SEQ ID NO: 383189 - DNA, 560 bp, Homo sapiens
  misc_feature: GZ8MTXP02IMZ5R.51.71.G05.1.454.CMB.2.raw
  modified_base (240)..(240): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatgtacagcagagccggcaggcccctgtgtggtgatgtataaagacactgagacggccctcgagggactcccgtgagcgtacttctcgtggcctccgaggtcgaggggacaacgggtcacgtagttcggccatcaggtggacgtccgaggcgaggagggacgaggctagtacttattagttgtacaagtacaacacgacacctagttaggtacttatcgtacttacggtaactcgacgtaaccaaggtccaccgtcgtacgggtccaacggacccgaaaccggcccaaaccccgtacgtacgtacctaacccg

SEQ ID NO: 383190 - DNA, 552 bp, Homo sapiens
  misc_feature: GZ8MTXP02HTK1H.51.71.G05.1.454.CMB.2.raw
  modified_base (239)..(239): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggccaggcccctgtgttggtgatgtataaagacactgagaggccctcaggggactccccgtgacgcgacttctctcggcctcgaggttcagggggaccaaacggggtcaacgtagttcgggaccctaatccgagtcgggaacgtcccgagggacaggacgggacggagggctagacttattattgtacaatcaacagacaccattgtacttatgtcttcggaactgacgaccaaggtcaccgtccgtgggtacaacgcccgaaacggtcccaaccctctacgtctacc

SEQ ID NO: 383191 - DNA, 533 bp, Homo sapiens
  misc_feature: GZ8MTXP02FGOCT.51.71.G05.1.454.CMB.2.raw
  modified_base (324)..(324): a, c, t, g, unknown or other
  modified_base (349)..(349): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcgagggactcccngagcgacttctctggctcgaggtcnggggacaaacggtcacattggccatcagtggagtccaggcaggaggacgagggctagaactattatgtacaatcaaacagaccaacgatttaggtacttaatgttcttacggaactcgacgaaccaacggtcacccgtctcggggtcaacgacccaaacggccccaaccccgtatcgtctaacc

SEQ ID NO: 383192 - DNA, 496 bp, Homo sapiens
  misc_feature: GZ8MTXP02H2TJX.51.71.G05.1.454.CMB.2.raw
  modified_base (167)..(167): a, c, t, g, unknown or other
  modified_base (236)..(236): a, c, t, g, unknown or other
tcagcgatcgtatacacgaccggtgctcgatttagtgtcgtcgcaagagagaggggcacgaccggtgctcgatttagtgtcgtcgcaagagagaggggggggagcctagctgtgctgtgggtccaggaggcagaactctgggtgtctcaccatggcctggatccctntacttctccccctctcactctctgcacaggctctgaggcctcctatgagctgacacagccaccctggtntcagtctccccaggacagacggccaggatcacctgctctggagatgcattgaccaaaccgatatgcttattggtaccagcagaagccggccacggcccctgtcgttggtgatgtataaagacactgagagccctgaggactcccgtgagcgtattcgtctggcctcgaggtcagggacaacggtcactagttggcctagtcagtggatccgatgcgaggaggacgaggctgacttagtattgacaatcaacacacactag

SEQ ID NO: 383193 - DNA, 527 bp, Homo sapiens
  misc_feature: GZ8MTXP02H0JRS.51.71.G05.1.454.CMB.2.raw
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtgttggtgatgtataaagacactgagaggccctgaggactcccgtgagcgattctctggctcaggtcaggggacaacggtcactatggaccatcagtggagtccaggcagaggacgagctgacgtattatgtacaatcaactagacacattgtacttatagtcttacggaacttgacgacgtaaggtccaaccgttccgtacggtcaaccggacccgaacggaccccaacccgtaactcggtacctaccg

SEQ ID NO: 383194 - DNA, 584 bp, Homo sapiens
  misc_feature: GZ8MTXP02JL1H2.51.71.G05.1.454.CMB.2.raw
  modified_base (242)..(242): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagagccggcaggccctgtgtgtgatgtataagacacgtgagacggccctacgagggactcccgtggacgcgtattctcgtggctccgaggtcaggggacaacggtcactattcggcctagtcaggtggagtccgaggcgaggaggacgaggcctagacgttattacgttgtacaaatacaaacgtacgaacacctagtttacggtaactttagtgtttaccgttacggaaacgttcggaccgtaaccgtaaacggtcctaacccggttccgtaaggggtccaacggaccccgaaacggaccccctaaacccccgtagttacccg

SEQ ID NO: 383195 - DNA, 601 bp, Homo sapiens
  misc_feature: GZ8MTXP02GYMJ7.51.71.G05.1.454.CMB.2.raw
  modified_base (238)..(238): a, c, t, g, unknown or other
  modified_base (281)..(281): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagagccggcaggcccctgtgttggngatgtataaagacactgagaggccctcgagggactcccgtgacgcgacttctctggctccgaggtcgaggggacaacgggtcactagttcggacctatcgaaggttggaacgtccgagggccgaggacgggaacgaggctagacttaagttattagtacaatcaaacagaaccacctagttaggtactttagtcgttacgttacggtaaacttcggaccgaaccgtaagggtaccctaaccggttccgtacggggttacccaacggacccccgaaaaccgggaccccaaacccccgtaacgttccggtaccttaaccccg

SEQ ID NO: 383196 - DNA, 523 bp, Homo sapiens
  misc_feature: GZ8MTXP02G8TV5.51.71.G05.1.454.CMB.2.raw
  modified_base (282)..(282): a, c, t, g, unknown or other
  modified_base (484)..(484): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagagccggcaggcccctgtgtggtnatgtaataaagacactgagaggccctgagggactcccgtgagcgacttctctggctccgaggtcaggggacaacggtcacattcggaccatcgagtggatcgaggcaggaggacgaggctagacttagttattgtacaatacaacaagaccactaattgtaacttatgtcttacggaactgacgactaaggtccaccgtcgnggtacaacgcccgaacggcccaaacccgctcgtactacc

SEQ ID NO: 383197 - DNA, 596 bp, Homo sapiens
  misc_feature: GZ8MTXP02JSJVR.51.71.G05.1.454.CMB.2.raw
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccacggcccctgtgttggtgatgtaataaagacactgaggacggccctcgagggactcccgtgacgcgacttctcgtggctcgaggttcgaggggaccaacgggtcactagttcggccatcaggtggacgtccgaggcgaggacgggacgaagggtctagtaacttagtttagttagtactaaagtacaaacgagaaccaaccgttagtttacggtaactttagtacgttcgttacggaacttcggaccgaacgtacggtcctacccgtccgtggtaccgaacgaccccgaaacggaccccaaacccgtacgtacgtacctacccg

SEQ ID NO: 383198 - DNA, 619 bp, Homo sapiens
  misc_feature: GZ8MTXP02HDGLX.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattcgaccaaaccgatatgcttattggtaccagcagaagccgggccacggcccctgtgttggtgatgtaataaagacactgagaggccctcgagggactccctgacgcgattctctggcctccgaggtcaggggaccaacgggtcacgtagttcggccaatccgagtggagtccgaggcgaggaggacgaggctagacttattacttgtactaatacaaacgaagaacctaacctagtttacggtactttaagtcgttacgttaccggtaaaacgttcggtaccggtaacccgtaaaacggggtccctaaaccccgggttccgttacgggggttaccaacggtacccccgaaacgggtaccccaaaaccccctacgtccgtaccctaacccg

SEQ ID NO: 383199 - DNA, 654 bp, Homo sapiens
  misc_feature: GZ8MTXP02JSG1P.51.71.G05.1.454.CMB.2.raw
  modified_base (287)..(287): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttatggtaccagcagaagccggccacggcccctgtgttggngatgtaataaagacactgagacggccctgagggactcccgtgacgcgtacttctcgttcggctccgaggtcaggggaactacggtcacgtagttcggacctataccgaggttaggacgtccgaggacgaaggacggacggaaggcgtagtacttaattagttacgtactaaactacaaacgaacgaaccctaaccgtaagtttacgggttaaactttacgttacgttaccgttaacggtaaaaccgtcggtacccggtaaaccgtaaacgggttcccctaaaccggttacccgtcggggtacccaaccggacccccgaaaacggggaccccctaaacccccgtaaccgttccggttacctaaccccg

SEQ ID NO: 383200 - DNA, 603 bp, Homo sapiens
  misc_feature: GZ8MTXP02JSE9K.51.71.G05.1.454.CMB.2.raw
  modified_base (237)..(237): a, c, t, g, unknown or other
  modified_base (281)..(281): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggcaggcccctgtgttggngatgtataaagacactgagacggccctcgagggactccctgacgcgattctctggctcgaggtcaggggacaacgggtcaacagttcggcccataccgagttaggacgtcccgaggcgaaggacggacggaagggctaggaacttagttagttaggtactaaattcaaacgtaagaaccaacccgtatttacgggtaactttagtcgttaccgttacggtaacttggaccggtaaccgtaaggttaccgtaccgttcccgtaggggtaccgaacggtaccccgaaacgggtccccaaaccccgaacgtccgtaccgtacccg

SEQ ID NO: 383201 - DNA, 511 bp, Homo sapiens
  misc_feature: GZ8MTXP02IEV20.51.71.G05.1.454.CMB.2.raw
  modified_base (344)..(344): a, c, t, g, unknown or other
  modified_base (385)..(385): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttattggtaccagcagaagccgggcaggcccctgtgtggtgatgtataaagacactgagaggccctcagggatcccctgagcgattctctggctcaggtcnggggacaacggtcacattggccatcagtggagtcaggcagnggagaggctgactattattgtcaatcaacagaccacattgtacttatgtctcggaacttgcgaccgaaggtcaccgtcgtggtacaacgaccccgaaggaccccaaaccccgtactacgtcctacc

SEQ ID NO: 383202 - DNA, 568 bp, Homo sapiens
  misc_feature: GZ8MTXP02JSNGC.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtataaagacactgagacggccctcgagggatcccgtgacgcgacttctctgcctccgaggtcaggggaccaaacggtttccaactagttcgggaccattccgaaggtggagtcccgaggcgaggacgggacgaaggctagacttattattgactaatacaaacagtaacaccagtttaggtactttagtcgtacttacggaaacctgacgaaccaacgggttccaaccgtccgtggtaccaacggcccaaacggaccccaacccgactcgtactacc

SEQ ID NO: 383203 - DNA, 503 bp, Homo sapiens
  misc_feature: GZ8MTXP02IIA9L.51.71.G05.1.454.CMB.2.raw
  modified_base (348)..(348): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccaggccccctgtgttggtgatgtataaaagacactgagaggcccctcgagggatccctgagcgattctctggctccnggtcagggacaacggtcacattggccatcagtggatccaggcagagacgagctagactatattgcaagtcaacagacaccattggtaacttatgttacttacggactgacgaccaagtccacgtcctgggtcacgcccaaggcccaacccactcg

SEQ ID NO: 383204 - DNA, 523 bp, Homo sapiens
  misc_feature: GZ8MTXP02FTZL5.51.71.G05.1.454.CMB.2.raw
  modified_base (239)..(239): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtaataaagacactgagaggccctgagggactcccgtgagcgattctctggctccgaggtcaggggacaacggtcacattggccatcagtggagtccaggcagaggacgaggctagacttattattgtacaatcaaactagaccacatttggtacttatgtcttacggaactggacgacaaacggtcaaccgtctggggtacaacgcccaacggcccaacccacgtctactacc

SEQ ID NO: 383205 - DNA, 541 bp, Homo sapiens
  misc_feature: GZ8MTXP02G5X6U.51.71.G05.1.454.CMB.2.raw
  modified_base (225)..(225): a, c, t, g, unknown or other
  modified_base (243)..(243): a, c, t, g, unknown or other
  modified_base (287)..(287): a, c, t, g, unknown or other
  modified_base (345)..(345): a, c, t, g, unknown or other
tcagcgatcgtatacacgaccggtgctcgatttagtgtcgtcgcaagagagagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaaccgntatgcttatggtaccagcagaagccggcaggcccctgtgttggngatgtaataaagacactgagacggccctgaggactcctgacgcgattctctggctcgnggtcagggaaccaacggtcaacagttcggaccatcgagtggagtccgaggcaggaggacgagctagactattattgactaatacaacaagacctacattaggtacttatcgtacttcggaaactgaccaacgtaacggtccacccgtacgtgggtaccaacggaccccaaaggtcccccaaaaccccgtactaccg

SEQ ID NO: 383206 - DNA, 531 bp, Homo sapiens
  misc_feature: GZ8MTXP02H2YBU.51.71.G05.1.454.CMB.2.raw
  modified_base (310)..(310): a, c, t, g, unknown or other
  modified_base (330)..(330): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgcaaaccgatatgcttatggtaccagcagaagccgggcaggcccctgtgtggtgatgtaataaagacactgagaggccctnagggatccctgagcgattcngtggctcaggtcaggggacaacggtcactattggccatcagtggatcgaggcagaggacgagctagacttattattgtacaaatacaaacagaccacatttcggtaacttatgttcttacggaactcggacgaaccgaaagtccgaacccgtccgttgggacaaccgaccctaaacggcccaaacccacgtcgtactaccg

SEQ ID NO: 383207 - DNA, 536 bp, Homo sapiens
  misc_feature: GZ8MTXP02HM9GD.51.71.G05.1.454.CMB.2.raw
  modified_base (222)..(222): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaaccgatatgcttatggtaccagcagaagccgggccaggcccctgtgttggtgatgtataaagacactgagaggccctcgagggactccctgagcgacttctctggctcgaggtcaggggacaaacggtcactagttcggccatcgagtggagtccgaggcaggaggacgaggctgactattattgtactaatcaaacagacactattagtacttatcgtcttacggaactgtacgacctaaggtaccaccggtaccgtgggtaccaacgcccaacggacccaaacccactcgtactacccg

SEQ ID NO: 383208 - DNA, 559 bp, Homo sapiens
  misc_feature: GZ8MTXP02GVM4R.51.71.G05.1.454.CMB.2.raw
  modified_base (242)..(242): a, c, t, g, unknown or other
  modified_base (285)..(285): a, c, t, g, unknown or other
  modified_base (297)..(297): a, c, t, g, unknown or other
  modified_base (428)..(428): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgccaaacgntatgcttatggtaccagcagaagccggcaggcccctgtgtggngatgtaataaanacactgagacggcctcgagggactccgtgacgcgattctcgtggcctccagggtcacggggacaaccgggtcacgtattggcccagtccagttgggacgtcccgaaggcaaggaggacgagcagactattntgtacaatacaaacagacacctaagttcggtaacttagtcgttacgttacggaaacttcggaccgaaccgtaaggtccctaaccggtcgtcgggtacaccgacccgtaaacggccccaacccgtacgtccg

SEQ ID NO: 383209 - DNA, 498 bp, Homo sapiens
  misc_feature: GZ8MTXP02HYV64.51.71.G05.1.454.CMB.2.raw
  modified_base (238)..(238): a, c, t, g, unknown or other
  modified_base (251)..(251): a, c, t, g, unknown or other
  modified_base (302)..(302): a, c, t, g, unknown or other
  modified_base (340)..(340): a, c, t, g, unknown or other
  modified_base (413)..(413): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccaaacgntatgctatgtacngcagagcggcagcccctgtgtgtgatgtataaagacactgagacggccctnagggatccctgacgcgacttctcgtggcttccaggtcnggggacaacggtcacattggccatcagtgagtccaggcagaggcgaggctgactattattgtacaatcaacanacacattggtacttatgtcttcggaatgcggaacaaggtccaccgtctcgggtcaacgccaacggcctaacccactcgtactacc

SEQ ID NO: 383210 - DNA, 507 bp, Homo sapiens
  misc_feature: GZ8MTXP02FUW2I.51.71.G05.1.454.CMB.2.raw
  modified_base (313)..(313): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtaataaagacactgagaggccctnagggatccctgagcgattctctggctccaggtcaggggacaaacggtcacattggccatcagtgagtcaggcagaggacgaggctagacttattattgtcaatcaaacagacacattgtacttatgtcttcggaactgacgtaccaaaggtcaccgtcctgggtcaacgcccaaggcccaacccgactcgtcac

SEQ ID NO: 383211 - DNA, 575 bp, Homo sapiens
  misc_feature: GZ8MTXP02JVQ14.51.71.G05.1.454.CMB.2.raw
  modified_base (564)..(564): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgaccaaacgatatgcttattggtaccagcagaagccgggccacggcccctgtgttggtgatgtaataaagacactgagacggccctgagggactcccgtgacgcgacttctcgtggcctcgaggtcgaggggacaaacgggtcacgtattcggaccatacgagtggacgtccgaggacaggacgggaacgagggctagaacttaatttacgttgacaaatacaaacgagaaccacctaagttacggttaacttagttacgttacgttacggaacttcgacgtaaccgaaggtccaccgtccgtggtacaacgacccgaaacggcccaaacccnctcgactaccg

SEQ ID NO: 383212 - DNA, 542 bp, Homo sapiens
  misc_feature: GZ8MTXP02F1U3C.51.71.G05.1.454.CMB.2.raw
  modified_base (236)..(236): a, c, t, g, unknown or other
tcagcgatcgtatacacgaccggtgctcgatttagtgtcgtcgcaagagagaggggcacgaccggtgctcgatttagtgtcgtcgcaagagagaggggggggagcctagctgtgctgtgggtccaggaggcagaactctgggtgtctcaccatggcctggatccctctacttctccccctctcactctctgcacaggctctgaggcctcctatgagctgacacagccaccctggtntcagtcgtccccaggacagacggccaggatcacctgctctggagatgcattcgaccaaaccgatatgcttatggtaccagcagaagccggcccacggcccctgtgttgtgatgtataaagacactgagacggccctacgagggtactcccgtagagcgtattctctggcctcgaggtacgaggggaacacgggtacacgtaagttcggacccatcgaggtcggacgtaccgaagtcgacgaggagggaccggaaggtctagtaacttattaagttgtacaaataccaaacgacgaaccaccttaag

SEQ ID NO: 383213 - DNA, 583 bp, Homo sapiens
  misc_feature: GZ8MTXP02GTB57.51.71.G05.1.454.CMB.2.raw
  modified_base (222)..(222): a, c, t, g, unknown or other
  modified_base (239)..(239): a, c, t, g, unknown or other
  modified_base (286)..(286): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgcttatggtacagcagagccggccagcccctgtgtgtgatgtanaaagcactgagacggccctgagggtactccgtggacgcgtattctcgtcggctccgtaggtcgaggggacaacggtcacagttcggccatcgagtggagtccgaggcaggaggacgaggctagacttattagttgtataatacaaacgaagaacctaaccgtagtttacggtaactttaagtcgttaccgttaacgggaaaactcggtaccggaaaccgtaaacggttccgaacccgttccgtacgggtaccaacgtaccccgaaaggacccccaacccgtactcgtacctaacccg

SEQ ID NO: 383214 - DNA, 642 bp, Homo sapiens
  misc_feature: GZ8MTXP02H0PY7.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgatatgcttatggtaccagcagaagccggccaggcccctgtgtggtgatgtataaagacactgagacggccctgagggactcccgtaggacgtcgtactttcgtacgtcggcctccgagggttcagggggaccaaacgggtcacgtagttcggacctagtcgaggttcggagtcccgaggcgaggacggacgaggctgacttattatagtacaatacaaactagaaccaccgtaagtttacggtaaactttagttacgttacgtttaccggtaaaacgtcggtaaccgtaaacccgtaaacgggttacccgtacccggttaccgtacgggggttacccaaccggtacccccgtaaaccggacccccaaaacccccgtaccgtttaccggtaaccgttaccccg

SEQ ID NO: 383215 - DNA, 600 bp, Homo sapiens
  misc_feature: GZ8MTXP02I4S7L.51.71.G05.1.454.CMB.2.raw
  modified_base (391)..(391): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcactgctctggagatgcattgccaaacgatatgcttatggtacagcagagccggccaggcccctgtgtggtgatgtataaagacactgagacggccctgagggactcccgtgagcacttctctggctccgaggtcaggggacaacggtcacagttcggccatcagtgagtcaggcagaggacgnggctagacttattattgtactaatacaaactagacacctaagttcggttaactttagttacgttacgttaccgggtaacttacggacccgtaaaccggtaaaacgggttccctaaacccggttcccggtacggggttaccgaaaccggaccccccgaaaacgggtcccccctaaaaacccccgccgttaccggtacccctttaaccccg

SEQ ID NO: 383216 - DNA, 532 bp, Homo sapiens
  misc_feature: GZ8MTXP02G11XV.51.71.G05.1.454.CMB.2.raw
tcagcgatcgtatacacgaccggtgctcgatttagtgtcgtcgcaagagagaggggcacgaccggtgctcgatttagtgtcgtcgcaagagagaggggggggagcctagctgtgctgtgggtccaggaggcagaactctgggtgtctcaccatggcctggatccctctacttctccccctctcactctctgcacaggctctgagcctcctatgagctgacacagcccaccctcggtgtcagtcgtccccaggacagacggccaggatcacctgctctggagatgcattcgaccaaaccgatatgctttattggtaccagcagaacgccggcccacggccctgtgttggtgatgtaataaagacactagagacgcctacgaggactccgtgagcgtattcgtcgtcggctcgaggtcgacgggacaacgggtcaactagttacgaccagtcgtaggtaggacgtaccaagtcgacgagagggacgaggtctagacttagttataagtacaaactcaaacacgaacactttaag

SEQ ID NO: 383217 - DNA, 506 bp, Homo sapiens
  misc_feature: GZ8MTXP02FHRMX.51.71.G05.1.454.CMB.2.raw
  modified_base (472)..(472): a, c, t, g, unknown or other
  modified_base (498)..(498): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcaggggactccctgagcgacttctctggctccaggtcgagggacaaacggtcacattggcatcagtggagtcaggcagaggacgaggctagactattatgacaatcaaacagacaccattaggtacttatgtcttggaactgcgacaaggtcaccgtcnggtcaagccaacggcccaacccgacncgactacc

SEQ ID NO: 383218 - DNA, 517 bp, Homo sapiens
  misc_feature: GZ8MTXP02HNHE6.51.71.G05.1.454.CMB.2.raw
  modified_base (312)..(312): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtgttggtgatgtataaagacactgagaggccctnagggactccgtgagcgattctctggctcaggtcaggggacaacggtcactattcggccatcgagtggagtccgaggcaggaggacgaggctagacttattattgtacaatcaacagacaccattggtacttatgtctacggaactgacgaaccaaggtcaccgtcgtcggtcaacgcccaacggacccaacccactcgtactacc

SEQ ID NO: 383219 - DNA, 496 bp, Homo sapiens
  misc_feature: GZ8MTXP02FVT2I.51.71.G05.1.454.CMB.2.raw
  modified_base (239)..(239): a, c, t, g, unknown or other
  modified_base (440)..(440): a, c, t, g, unknown or other
  modified_base (468)..(468): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagacggccctgagggactcccgtgagcgtacttctctggctccaggtcaggggacaacggtcacattggccatcagtgagtccaggcagaggacgaggctagacttattatgtacaatcaacagacacattgtactntgtcttgaactgcacgaaggtcacgtcnggcaagccaaggccacccatcgtacacg

SEQ ID NO: 383220 - DNA, 602 bp, Homo sapiens
  misc_feature: GZ8MTXP02F80BH.51.71.G05.1.454.CMB.2.raw
  modified_base (244)..(244): a, c, t, g, unknown or other
  modified_base (289)..(289): a, c, t, g, unknown or other
  modified_base (350)..(350): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgntatgcttatggtaccagcagaagccggccaggcccctgtgttggngatgtataaagcatgagcggccctgagggactccgtgacgcgtattctcgtcggccttcgngggtcaggggacaacggtcactgttggccatcgagtggacgtcgaggcaaggaggacggacggctaggtaacttaagtttacttagtactaaaagttaccaaacacgaaccaaccgttaacgtttaggttaaactttagttcgtttaccgttacgggtaaacctcggaaccgtaaccgtaacgggtaccctaaccggttccgtcggggtaccaacggaccccgaaacggtaccccaaaccccgtacttaccg

SEQ ID NO: 383221 - DNA, 500 bp, Homo sapiens
  misc_feature: GZ8MTXP02JK477.51.71.G05.1.454.CMB.2.raw
  modified_base (237)..(237): a, c, t, g, unknown or other
  modified_base (309)..(309): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggccaggcccctgtgtggtgatgtataaagacactgagaggccctnagggactcccgtgagcgacttctctggctccaggtcaggggacaacggtcacagttggccatcgagtggagtccaggcagaggacgaggctgactatattgtcaatcaacagacaccattgtacttatgtctacggaactgacgaccaggtcaccgtcgtggtcaagcccaaggcccaacccgctcgctac

SEQ ID NO: 383222 - DNA, 498 bp, Homo sapiens
  misc_feature: GZ8MTXP02FKZZT.51.71.G05.1.454.CMB.2.raw
  modified_base (371)..(371): a, c, t, g, unknown or other
tcagcgatcgtatacacgaccggtgctcgatttagtgtcgtcgcaagagagaggggcacgaccggtgctcgatttagtgtcgtcgcaagagagaggggggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgccaaaccgatatgcttatggtacagcagaagccggcccaggcccctgtgttggtgatgtataaagacactgagagccctnagggactccctgagcgattctctggctaccaggtcacgggtacaacggtcacagttggcccatcaggttgagtccagtgacagagggacgagggctcgactattattgtcaatcaacagacactaag

SEQ ID NO: 383223 - DNA, 596 bp, Homo sapiens
  misc_feature: GZ8MTXP02HBCRW.51.71.G05.1.454.CMB.2.raw
  modified_base (355)..(355): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtgggagatgctattcgaccaaaccgatatgcttatcggtaccagcaagaaggccgggccacggcccctgtgtggtgatgtaataaagacacgtgaggacggcccctggacgggactcccgtgacgcgacttctcnggcctcgaggtcgacggggacaacgggtcacgtagttcggacctagtcgaggtggacgtccggagacgagggacggagacggtacagtacttaagttacgttagtactaacgtaacaaacacgaacctacgttagttacgtaacttgttacgttcgtacgtacgtcgacgtaacgtacggtacctaccgtcggtacgaccgaacggaccgaacccgaccctaccgaccgtcgtacctcccg

SEQ ID NO: 383224 - DNA, 563 bp, Homo sapiens
  misc_feature: GZ8MTXP02JKACW.51.71.G05.1.454.CMB.2.raw
  modified_base (243)..(243): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgaccaaaccgntatgcttattggtaccagcagaagccgggccacggcccctgtgttggtgtatgtaataaagacactgagcggccctcgaggactcccgtgacgcgtacttctcgtgctcaggtcagggacaacggtcaactagttcggcatcgaggtggacgtccgaggcgaaggagggacgaagggtcaggtaacttattattagtacaatacaaacagaacacctaagttgtaacttgtagtcttacgaacgtgaccgtaaccaggtaccgtaccgtaccgttggaccgaacgacccgaacggccccaaccgtactacgtcctacccg

SEQ ID NO: 383225 - DNA, 535 bp, Homo sapiens
  misc_feature: GZ8MTXP02I8GP7.51.71.G05.1.454.CMB.2.raw
  modified_base (237)..(237): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccgggccaggcccctgtgttggtgatgtataaagacactgagaggccctcagggatccctgagcgattctctggctcaggtcaggggacaacggtcacattggccatcagtggagtccaggcagaggacgaggcagactattacgttgtacaatcaacaagacaccattggtaacttattcgtctttacggaaactgaccgaactaaaggtcctaaccgtccgtaggtccgaacgccccgaaaggaccccaaaccccgactcggtacctacccg

SEQ ID NO: 383226 - DNA, 591 bp, Homo sapiens
  misc_feature: GZ8MTXP02IHOBJ.51.71.G05.1.454.CMB.2.raw
  modified_base (279)..(279): a, c, t, g, unknown or other
  modified_base (332)..(332): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctggagatgcattgaccaaacgatatgcttatgtacagcagagccggcaggccctgtgtggngatgtaataaagcaacgtgagcggccctgagggactcccgtgacgcgacttcncgtgctccgaggtcaggggacaacggtcacagttggccatcagtggacgtccgaggcgaggagggacgaggctagacttaagttatttagtactaaattacaaacgaacgaaccctaccgtaagtttacggttaacgtttattcggttaccgttacgggtaaactcggtaccgaaccgtaaacgggtacctacccggtaccgttcggggtaccaacggaccccgaaacggcccctaaaacccgtctacgtactaacccg

SEQ ID NO: 383227 - DNA, 575 bp, Homo sapiens
  misc_feature: GZ8MTXP02IJOWY.51.71.G05.1.454.CMB.2.raw
  modified_base (222)..(222): a, c, t, g, unknown or other
  modified_base (238)..(238): a, c, t, g, unknown or other
  modified_base (268)..(268): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaacgntatgcttatgtacagcagagcggcagcccngtgtggtgatgtataaagacactgagaggccctgagggactcccgtgacgcgattctctggctccgaggtcaggggacaacggtcacagttggcctatcagtggagtccgaggcagaggacgaggctagactattacttgtactaatacaacgaagacccaacctagtttacgggttaaccttaagttcgtacgtttacggaaaacgttcggaccgaaccgtaaaggtacccaccggttacccgtaggggtaccaacggtaccccgaaacgggccccaaaaccccgtacttaccggtacctaacccg

SEQ ID NO: 383228 - DNA, 733 bp, Homo sapiens
  misc_feature: GZ8MTXP02I8ICS.51.71.G05.1.454.CMB.2.raw
  modified_base (239)..(239): a, c, t, g, unknown or other
  modified_base (285)..(285): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgggctgacacagccaccctcggtgtcagtgtccccaggacagacggccaggatcacctgctctggagatgcattgaccaaacgntatgcttattggtaccagcagaagccggcaggcccctgtgttggtnatgtataaagacactgagacggccctcgaggactccctgacgcgtattccctcgtcggcctcgaggtcgaagggaccgaacgggttcaacgtagttcggaccctaagtccgaggtcgggacgtaccgagggaccaagggacgggacggaacggccgtaggtaacttaagtttagtttacggtaacctaaacgttacaaaaccgacggtaaaccctacccgttaaagtttaccgggtttaaaaccttttagtttacggtttaaccgtttaaccggggtaaaaccgtttaccggaacccggtaaacccgtaaacggggtttaacccccgtaaacccgggtttcccgttaaccgggggttacccgaaacccggtaacccccgtaaaaccgggaccccccctaaaacccccgtaaccgtttcccggttaccccgtaacccgttttacccccg

SEQ ID NO: 383229 - DNA, 608 bp, Homo sapiens
  misc_feature: GZ8MTXP02I2FG4.51.71.G05.1.454.CMB.2.raw
  modified_base (241)..(241): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgntatgtcttatggtaccagacagaacgccggccacggcccctgtgtggtgatgtataaagacactgagacgccctgaggctcctgacgcgtattctcgtgcctcgaggtcgagggacaacggtcacgtagttcggacctatacgagtaggacgtccgaaggccgaaggacggacgaggctagacttattattgactaagtacaacgtagaacctaccgtattacggtaacttaagttcgttaccgttacggaaaaccttcggaccgtaaaccgtaacggttaccgtaccccggttacggtcggggtaccaaccggaccccgaaaccggtacccctaaaacccccgtacgtaccgtaccgttaaccccg

SEQ ID NO: 383230 - DNA, 532 bp, Homo sapiens
  misc_feature: GZ8MTXP02GPW3A.51.71.G05.1.454.CMB.2.raw
  modified_base (241)..(241): a, c, t, g, unknown or other
  modified_base (283)..(283): a, c, t, g, unknown or other
  modified_base (342)..(342): a, c, t, g, unknown or other
  modified_base (377)..(377): a, c, t, g, unknown or other
tcagcgatcgtatacacgaccggtgctcgatttagtgtcgtcgcaagagagagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggcaggcccctgtgtgngatgataaagcactgagaggccctgagggactccctgacgctattctcgtggccttcgnggtcgagggacaacgtcactagtcggccatcgagnggactccgaggcaggagacgagctagacttattagtttagataagtacaacagacctaactagttcggtacttagtcgttacgttacggacttcgacgtaacgaacgtccacgtccgtgggtaccacgacccaacggacccaacccgacttaccg

SEQ ID NO: 383231 - DNA, 551 bp, Homo sapiens
  misc_feature: GZ8MTXP02JZGP5.51.71.G05.1.454.CMB.2.raw
  modified_base (287)..(287): a, c, t, g, unknown or other
  modified_base (336)..(336): a, c, t, g, unknown or other
  modified_base (366)..(366): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaccgatatgcttatggtaccagcagaagccggccaggcccctgtgttggnatgtaataaagacactggagacggccctgagggatccctgagcgattcncgtggctcgaggtcaggggacaacggtcanattggccatcaggtggagtccaggcaggagggacgaggctagaacttattattgtacaatacaacagaacacctaagttggtaacttagtgtcgttacggaacttcgacgaacccgtaaagggtccaccggtccgtcggggtacaacggacccaacggacccaaacccccgctacgtactacccg

SEQ ID NO: 383232 - DNA, 523 bp, Homo sapiens
  misc_feature: GZ8MTXP02HE0R8.51.71.G05.1.454.CMB.2.raw
  modified_base (238)..(238): a, c, t, g, unknown or other
  modified_base (282)..(282): a, c, t, g, unknown or other
  modified_base (369)..(369): a, c, t, g, unknown or other
  modified_base (431)..(431): a, c, t, g, unknown or other
  modified_base (514)..(514): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagcggccaggcccctgtgttggngatgtaataaagcactgagacggccctcgagggactccctgagcgactttctcgtggcctcgaggtcaggggaccaacgggtcaacngttcggccagtcagtggagtccgaggcagacggagaggctagactattattgactaatcaanagacactagttgtacttagtgtctacgaactcgacgaccaaggtccaccgtctcggtacaagcccgaaacggtcccaaacccnctcgtacac

SEQ ID NO: 383233 - DNA, 500 bp, Homo sapiens
  misc_feature: GZ8MTXP02FJBUA.51.71.G05.1.454.CMB.2.raw
  modified_base (242)..(242): a, c, t, g, unknown or other
  modified_base (345)..(345): a, c, t, g, unknown or other
  modified_base (495)..(495): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggccaggcccctgtgttggtgatgtataaagacactgagaggccctcagggatccctgacgcgattctctggctccnggtcgagggacaacggtcacattggccatcagtggagtccgaggcagaggacgagctagactattatgtacaatcaacagaacacattgtacttatgtcttacggactgacgacaacgtcaccgtctggtcacgccaacggcccaacccnctacg

SEQ ID NO: 383234 - DNA, 582 bp, Homo sapiens
  misc_feature: GZ8MTXP02H7WBP.51.71.G05.1.454.CMB.2.raw
  modified_base (239)..(239): a, c, t, g, unknown or other
  modified_base (422)..(422): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgtcttatggtacagcagaagccgggcacggccctgtgttggtgatgtataaagcactgagacggccctcgagggactcccgtagacgcgtactctcgtcgctcgaggtcgagggacgaaacggtgactagttcggccatcgagtggacgtccgaggcaggaggacgaggctagactattnttgactaaatcaaacagaacaacctagtttacggtactttaagtcgttacgttacggtaaactcggtaccgaacctaaaggtccaacccggttccgtcggggtaccaaccggaccccgaaacgggaccccaaaacccccgtcgtaccgttacccaacccg

SEQ ID NO: 383235 - DNA, 504 bp, Homo sapiens
  misc_feature: GZ8MTXP02I2W0T.51.71.G05.1.454.CMB.2.raw
  modified_base (286)..(286): a, c, t, g, unknown or other
  modified_base (294)..(294): a, c, t, g, unknown or other
  modified_base (315)..(315): a, c, t, g, unknown or other
  modified_base (353)..(353): a, c, t, g, unknown or other
  modified_base (368)..(368): a, c, t, g, unknown or other
  modified_base (418)..(418): a, c, t, g, unknown or other
  modified_base (431)..(431): a, c, t, g, unknown or other
  modified_base (448)..(448): a, c, t, g, unknown or other
  modified_base (459)..(459): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgcttattggtaccagcagaagccggcacggcccctgtgtggngatgtaanaaagacactgagacgccctanagggactcccgtgagcgacttctctggcctcgaggtcnggggacaacggtcangttggctatcagtggacgtaccgaggcaggaggacgaggcagacttattntgtacaatcgaanagacactattgtacttntgtctcggacngcacaagtcacgtcctggtcaagcccaaggcccaccactcgctac

SEQ ID NO: 383236 - DNA, 638 bp, Homo sapiens
  misc_feature: GZ8MTXP02HBAAL.51.71.G05.1.454.CMB.2.raw
  modified_base (330)..(330): a, c, t, g, unknown or other
  modified_base (337)..(337): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgcttattggtaccagcaagaagccgggcaggcccctgtgtggtgatgtataaagacactgagaggccctgagggactccctgacgngacttcnctcggctcgaggtcaggggacaaacgggtcactaagttggaccatcgagtggagtccgaggcgaaggacgggaacgacgggtccaggtaacttatttatttacggactaaattaccgaaacacgtaaccaacccggtaatttacggtaactttaaggttcgttacgtttacccggtaaaattcggtaccgaaacccgtaaagggttacccgtaacccggttaccggtttcgggtaccgtaacggacccccgaaaacggggcccccaaaacccccgtacggtaaccgtccctttaaaccccg

SEQ ID NO: 383237 - DNA, 491 bp, Homo sapiens
  misc_feature: GZ8MTXP02GH1VI.51.71.G05.1.454.CMB.2.raw
  modified_base (104)..(104): a, c, t, g, unknown or other
  modified_base (350)..(350): a, c, t, g, unknown or other
  modified_base (378)..(378): a, c, t, g, unknown or other
  modified_base (432)..(432): a, c, t, g, unknown or other
  modified_base (451)..(451): a, c, t, g, unknown or other
  modified_base (463)..(463): a, c, t, g, unknown or other
  modified_base (476)..(476): a, c, t, g, unknown or other
tcagcgatcgtatacacgaccggtgctcgatttagtgtcgtcgcaagagagaggggcacgaccggtgctcgatttagtgtcgtcgcaagagagaggggggggancctagctgtgctgtgggtccaggaggcagaactctgggtgtctcaccatggcctggatccctctacttctccccctcctcactctctgcacaggctctgaggcctcctatgagctgacacagcccaccctcggtgcagtcgtccccaggacagacggcaggatcacctgctctggagatgcattcgaccaaaccgatatgctttatggtaccagcagaacgccggcccaggcccctgtcgttggtnatgtataaagacactgagacggccctanacgggatcccgagagcgtacttctcgtgctaccgaggtccgaggactacggcanatgccatcagtggatcatncagagacgagcncgactatatgtanacacacacacactag

SEQ ID NO: 383238 - DNA, 504 bp, Homo sapiens
  misc_feature: GZ8MTXP02IDR8Q.51.71.G05.1.454.CMB.2.raw
  modified_base (103)..(103): a, c, t, g, unknown or other
  modified_base (235)..(235): a, c, t, g, unknown or other
  modified_base (335)..(335): a, c, t, g, unknown or other
  modified_base (367)..(367): a, c, t, g, unknown or other
  modified_base (379)..(379): a, c, t, g, unknown or other
  modified_base (386)..(386): a, c, t, g, unknown or other
  modified_base (442)..(442): a, c, t, g, unknown or other
tcagcgatcgtatacacgaccggtgctcgatttagtgtcgtcgcaagagagaggggcacgaccggtgctcgatttagtgtcgtcgcaagagagagggggggancctagctgtgctgtgggtccaggaggcagaactctgggtgtctcaccatggcctggatccctctacttctccccctctcactctctgcacaggctctgagcctctatgagctgacacagcccaccctcggtntcagtgtcccccaggacagacggccaggatcacctgctctggagatgcattgccaaaaccgatatgcttatggtaccagcagaagcggcccagcccctgngttgtgatgtaataaagacactgagagccctnagggattcccgngagcgtntctctcgcgtcgacgacgaggacgaacgtacactagtgcatacgtagtgagtacangacgagaggacgagacgtacgtacttaattattaagtactaactacaacacgaacaactacg

SEQ ID NO: 383239 - DNA, 686 bp, Homo sapiens
  misc_feature: GZ8MTXP02IL0JP.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgcttatggtaccagcagagccggcacggccctgtgtgtgatgtaataaagacactgaagacgccctgagggtactcccgtgacgcgtacttctcgtggtcctccgaggttacagggggaacctaaacgggtcacgtaagtttcgggacctagtccgaaggttggaacgtcccgaagggccaaggggaagggaaccggaggggtcctaggtaaccttaagttactttaggtactaaataccaaacgaagaaaccctaacctaagtttacggtaacctttagttacgttacgttaccgggtaaacttcgggaccgtaaacccgtaaaacgggttcccgtaccccggttaccggtttacgggggtacccaaaccgggtaacccccgtaaaaccggggtaccccccaaaacccccgtaaccgttccggtttaaccccctaaccccg

SEQ ID NO: 383240 - DNA, 619 bp, Homo sapiens
  misc_feature: GZ8MTXP02I4WCE.51.71.G05.1.454.CMB.2.raw
  modified_base (239)..(239): a, c, t, g, unknown or other
  modified_base (280)..(280): a, c, t, g, unknown or other
  modified_base (288)..(288): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggactcacctgctctggagatgcattgaccaaacgntatgtcttatggtacagcagaagccggcaggccctgtgtgngatgtaanaaagcactgagaggccctgagggactccctgacgctacttctcgtcggctccgaggttcaggggacaaacggtcacgattcggaccatacagtggaacgtcgaaggcgagacggagaggctagacttagtacgttagactaatacaaacgaacgaactaacccgtaatttacgggtaacctttagtacgttacgtttacgggaaaactttcgggaaccaaaccgtaaaacggtccgtaaccccggttacccgttacgggggtaacccaaccggttacccccgaaaacgggtacccccgaaaaccccctaacggtcgttaaccctaaacccg

SEQ ID NO: 383241 - DNA, 589 bp, Homo sapiens
  misc_feature: GZ8MTXP02GRNCM.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgctattgaccaaaccgatatgcttatggtaccagcaagaacgccgggccacggcccctggtgttggtgatgtaataaagacacgtgacgacggccctgagggactcccgtgacgcgtacttctcgtggcttccgaggtcgaggggacaacgggtcacgagttcggacctatcgagttaggacgtaccgagggccgaaggacgggaacgagggctagacttaagttgttatacaatacaaacgacgaacactagttacgtaacttagtagttcgttacggaactcgaccgtaacctaaggtacctaacccgtcgttgggaccaacgacccgaaacggtaccccaaaccgtactcgtactaacccg

SEQ ID NO: 383242 - DNA, 518 bp, Homo sapiens
  misc_feature: GZ8MTXP02HN5WD.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtgtggtgatgtataaagacactgagaggccctcagggatccctgacgcgattctcgtggctccgaggtcaggggacaacggtcacagttggccatcagtggagtccgaggcagaggacgaggctaggacttattattggtacaatacaacagacaccattggtacttatgtcttacggaacttgacaccaaggtcaccgtcctgggtccaacgcccaacggcccaacccactcgactacc

SEQ ID NO: 383243 - DNA, 597 bp, Homo sapiens
  misc_feature: GZ8MTXP02FU7ON.51.71.G05.1.454.CMB.2.raw
  modified_base (222)..(222): a, c, t, g, unknown or other
  modified_base (239)..(239): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaaccgntatgcttattggtaccagcagaagccgggccaggcccctgtgttggtgatgtaataaagacactgagacggccctcgaggggactccctggagcgattctctggctccaggtcaggggacaacggtcacattggccatcgagtggagtccgaggcagaggacgaggctagacgttattagttgtacaaattcaaacagaacctaaccgtagtttggttaaaccttatacggttactttacgggaaaacttcgggaccgtacccgaaaacgggttcctaacccggttccgtaggggttaccaaccggaccccgtaaacggggaccccctaaaaccccgaccgttacggtaccttacccg

SEQ ID NO: 383244 - DNA, 523 bp, Homo sapiens
  misc_feature: GZ8MTXP02F2UL2.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagacggccctcaggggactcccgtgacgcgattctctggctccgaggtcgaggggacaacggtcactattggccatcagtggagtccaggcagaggacgaggctagactattattgtacaatcaaacagacacattggtacttatgtctacggtaactgacgaaccgaaggtcaccgtcgtgggtacaacgcccaaggcccaacccgactcgtactaccg

SEQ ID NO: 383245 - DNA, 574 bp, Homo sapiens
  misc_feature: GZ8MTXP02JE35H.51.71.G05.1.454.CMB.2.raw
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtaataaagacactgagacggccctgagggactccctggacgcgattctcgtggctcgaggtcaggggaccaacggtcacgagttggccagtcgagtggacgtcgaggcgagacggacgaggctagacttaagttattgactaatcaacacgaacacctaagtttagtactttagtcgtcttacggaaacttcggaccgaaccgtaaagggtccctaacccgttccgtacggggtacccaacggccccgaaacggacccccaaacccctacgtccgtacctacccg

SEQ ID NO: 383246 - DNA, 523 bp, Homo sapiens
  misc_feature: GZ8MTXP02JVH0F.51.71.G05.1.454.CMB.2.raw
  modified_base (239)..(239): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggccaggcccctgtgttggtgatgtataaagacactgagacggccctgaggggatccccgtagacgcgattcctcgtggcctccgaggtcgaggggacacggtcactattggccatcagtggagtccgagcagaggacgaggctgactagttattgcaatcaatagacactagttgtacttatgtcgttacgactgcgacgaacggtcacccgtaccgtggtccaacgcccgaacggccccaacccactcgactaccg

SEQ ID NO: 383247 - DNA, 641 bp, Homo sapiens
  misc_feature: GZ8MTXP02JZ3TT.51.71.G05.1.454.CMB.2.raw
  modified_base (241)..(241): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggccaggcccctgtgttggtgatgtaataaagacactgagacggccctcgagggactccccgtgagtcgtacttctcgtggcctcgaggttcgaggggaccaacggtccactagttcggacctatcgaaggtggacgtccgagggcaggaggaacgaggctagacttagttattaggtactaaataccaaacgagaacctaaccgtagtttacggttaactttaacgttcgtttacgtttaccgggtaaaacttcgggaaccggtaacccgtaaaacggggtccctaaacccggttccggtacggggttaccgaaccggtaaccccgaaacgggacccccaaaacccccgacgttaccggtacctttaacccg

SEQ ID NO: 383248 - DNA, 679 bp, Homo sapiens
  misc_feature: GZ8MTXP02I92QG.51.71.G05.1.454.CMB.2.raw
  modified_base (223)..(223): a, c, t, g, unknown or other
  modified_base (298)..(298): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattcgaccaaaccgatatcgtacttagttcggtaccagcaagaacgccgggccacggcccctgtcgttggngatgtaataaagacactagaggacggccctgagggactccgtagacgctacttcgtcgtcgctccgaggttcagggggacctaacgggtccaacgtagttacggaccctagtaccgaggttacggacgtacccgaggggaccgaagggtacgggaacggacgggtaccgtaggtaacctttaagtttaacgttacggtaactaaacttaccgaaacgtacgaaaccctaacccgtagtttacggttaactttaggtacgttacgttaacggaaccttcggaccgtaaaccgtacggtcccgtaacccggtccgttacgggaccaaccggtaaccccgaaccggtacccccaaccccgtacgttaccgtaccgttaaccccg

SEQ ID NO: 383249 - DNA, 541 bp, Homo sapiens
  misc_feature: GZ8MTXP02FJLDW.51.71.G05.1.454.CMB.2.raw
  modified_base (242)..(242): a, c, t, g, unknown or other
  modified_base (418)..(418): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggccaggcccctgtgtggtgatgtaataaagacactgagaggccctcagggatccctgacgcgattctctggctccagggtcaggggacaacggtcacgattggccatcagtggagtccaggcagaggcgaggctgactattatgacaatnaacagacaacctattggtaactttagtcgttacgtttacggaacttcggacgtaaccaaacgggttccaacccggttcctcgggggtaccacggacccaacggaccccaaacccctacgtccg

SEQ ID NO: 383250 - DNA, 526 bp, Homo sapiens
  misc_feature: GZ8MTXP02JA9UC.51.71.G05.1.454.CMB.2.raw
  modified_base (421)..(421): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgcttattggtaccagcagaagccgggccaggcccctgtcgttggtgatgtataaagacactgagacgccctgaggactcctgagcgacttcgtcgtggctcgaggtcagggacacggtcacattgccatcagtggagtccgaggcagaggacgaggctgacttattattagttaatanaacagaccactagttaggtacttagtgttcgttacgaaacttcgcgaacaaacggtccaccgtcgtcggtcacgcccgaacggaccaacccgatcgtcacttccc

SEQ ID NO: 383251 - DNA, 588 bp, Homo sapiens
  misc_feature: GZ8MTXP02IAEBG.51.71.G05.1.454.CMB.2.raw
  modified_base (378)..(378): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaaccgatatgcttattggtaccagcagaagccgggccaggcccctgtgttggtgatgtataaagacagtgaggacggccctgagggactcccgtggagcgtacttctcgtggctccgaggttcgaggggtaccaacggtcacngttcggccagtcagtggacgtccagggcgaggacggacgaggctgaactatttagttacgactaatacaaacgagacacctagttacggtaactttagtgtacgttacgaacttcggaccgtaacgtaaacgggtcctacccgtccgttacggggaccaacggacccgaaaccgggaccccaaaccccgtaccgtacgttaccctacccg

SEQ ID NO: 383252 - DNA, 635 bp, Homo sapiens
  misc_feature: GZ8MTXP02IU36G.51.71.G05.1.454.CMB.2.raw
  modified_base (347)..(347): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtggagatgctattcgacccaaacgatatgtcttattggtacagcagaagccggccaggccccctgtcgttggtgatgtaataaagacactgagacggccctgagggactccgtgaagcgtattcctntcggcttcgaggttcgaggggaccaacggtacactacgttcggcctatacgagttggagtaccgaggacgaaggacgggaacggaggtaccgtaggaacttaagtttacgtttaggtacaaacttaccaaacgaaccggaacgacccttaatttacgggttaaacttttagttacggtttacgttacggtaacgttcgaaccgaaccgtaaacggttaccacccggttaccgtcggttacgaaccgacccgaaacggaccccaacccgtaacctcggtaaccttcccg

SEQ ID NO: 383253 - DNA, 647 bp, Homo sapiens
  misc_feature: GZ8MTXP02HGRPD.51.71.G05.1.454.CMB.2.raw
  modified_base (223)..(223): a, c, t, g, unknown or other
  modified_base (247)..(247): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattcgaccaaacgatatgtnttattggtacagcagagccggccaggcccctaggtcgtggtgatgtaataaagcactgagacggccctgagggactccgtagacgctacttctcgtcggcctccgaggtcgagggacaacgggtcaaccgtagttcggccctaagtccgtaaggtcgggtaacgtccccggaaggaccgaaggaacggggacggacgggtccgtagaacgtttagtttaacgtttgtaaccgtaaaataccaaaacgaccgaaacctaaccgtatttacggttaactttagttacgttacgttacggtaaaacgtcgaacgtaacccgtaaaggtccctaacccgttccggtaggggttaccaaccgacccgaaacggaccccaaaacccccgtcgtaccgtacctaccc

SEQ ID NO: 383254 - DNA, 592 bp, Homo sapiens
  misc_feature: GZ8MTXP02I30ER.51.71.G05.1.454.CMB.2.raw
  modified_base (242)..(242): a, c, t, g, unknown or other
  modified_base (285)..(285): a, c, t, g, unknown or other
  modified_base (334)..(334): a, c, t, g, unknown or other
  modified_base (343)..(343): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccggcacggccctgtgtggngatgtaataaagcactgagacggcctgagggactccgtgacgcgattcnctggctcgnggtcaggggaccacgtcacgattggaccatcgagtggacgtccgaggccaaggacggacgaggctaggacttattagttgtacaatacaaacagaaccaactagttggtaactttagtacgttacgttacggaaacttcggaacccgtaaaccgtaacggttacccgtaacccgttccggtaacggggtacccaaccggtaacccccgaaaaccgggtacccccaaaacccccgtacgtttaaccccgg

SEQ ID NO: 383255 - DNA, 608 bp, Homo sapiens
  misc_feature: GZ8MTXP02FRLU8.51.71.G05.1.454.CMB.2.raw
  modified_base (245)..(245): a, c, t, g, unknown or other
  modified_base (355)..(355): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctcgtggagatgcattcgaccaaaccgntatgcttatgtaccagcagaacgccggcacggccctgtgttggtgatgtaataaagacacgtagagacggccctcgagggactcccgtgacgcgtattctcgtgcctcgnggtcgagggacaacgtcacgtagtcgactatcgagtggacgtccgaggcaaggacggacgaggtctaggtaacttagtttagttgtactaactacaaacgacgtacctacgtaagttcggtaacttagttcgttacgttacggaacttcggaccgtaaaccgtaacggttacccgacccggttaccggtaacggggttacccgaaccggaccccgtaaaccgggaccccctaaaaccccgtcgtttaacccgg

SEQ ID NO: 383256 - DNA, 663 bp, Homo sapiens
  misc_feature: GZ8MTXP02IBE8O.51.71.G05.1.454.CMB.2.raw
  modified_base (241)..(241): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtggagatgcattcgaccaaacgntatgtcttattggacagcagacgccggcacggccctgtgtggtgatgtaataaagacacgtgagacgccctagagggactcccgtagacgcgtacttccgtcgtcgcctaccgtagggtaccgacggggaacctaaacgggtacctaacgtagttacggacctaacgtacccgtagggtacggtacgacccgaaggggaccgtaaggggaacggggtaacggacgggtacgttacgtaacgtttaagtttagtttacgaactaaattaccaaacgaacgtaaccgtaacctagtttcggtaaactttagtacgttaccgttaacggaaacttccggacggaaaccgttaacgggtcccgtaaccgtccgttaggacccaacgacccgaaacggaccccaaaccccgtcgtactacctacccg

SEQ ID NO: 383257 - DNA, 572 bp, Homo sapiens
  misc_feature: GZ8MTXP02JOFYS.51.71.G05.1.454.CMB.2.raw
  modified_base (223)..(223): a, c, t, g, unknown or other
  modified_base (242)..(242): a, c, t, g, unknown or other
  modified_base (379)..(379): a, c, t, g, unknown or other
tcagcgatcgtatacacgaccggtgctcgatttagtgtcgtcgcaagagagagggggggtgagtccaggaggcagaactctgggtgtctcaccatggcctggatccctctacttctccccctcctcactctctgcacaggctctgaggcctcctatgagctgacacagccaccctcggtgtcagtgtccccaggacagacggtcaggatcacctgctctgganatgcattcgaccaaaccgntatgcttatggtaccagcagaagccggccacggcccctgtcgttggtgatgtaataaagacacgtgagacggccctcgagggactcccgtgacgccgtattctcgtcggctccgaggtcgacgggacaacggtcacngttcggccatcaggtggacgtcgaggcaggaggacggagctagactattatgtactaatacaaacacgacacctagttacggtacttagtcgtacgttacggaacttggaccgtaccgtaaacggtccaacccgttccgtacggtaacgaccggaccccgaacggtaccccaaccccgtacgtcgttaacccg

SEQ ID NO: 383258 - DNA, 635 bp, Homo sapiens
  misc_feature: GZ8MTXP02IAKZD.51.71.G05.1.454.CMB.2.raw
  modified_base (242)..(242): a, c, t, g, unknown or other
  modified_base (284)..(284): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctcccccctcctcattctctgcacaggctctgaggcctcctatgagctgacacagccaccctcggtgtcagtcgtccccaggacaggacggccaggatcacctgctctggagatgcattgaccaaacgntatgcttatggtacagcagagccggcaggcccctgtgtggtnatgtaataagacactgagacggccctgagggactcccgtgagcgtacttctcgtggcctcgagggtcagggggacaaacgggtcacgtagttcggaccctagtccgaaggtcggacgtccgaagggcgaagggacgggaacggagggtcctaggaaccttaagtttagtttaggtactaaagttaccaaacgaacgaacccgtaacctaagtttacgggttaaacctttagttaacgtttccgttaaccgggtaaacttcggacccgtaaccgtaaacgggtcctaacccggtccgttgggtaccaacggaccccgaaacggaccccaaaccccgacgttacgactacccg

SEQ ID NO: 383259 - DNA, 593 bp, Homo sapiens
  misc_feature: GZ8MTXP02G0NRI.51.71.G05.1.454.CMB.2.raw
  modified_base (244)..(244): a, c, t, g, unknown or other
  modified_base (281)..(281): a, c, t, g, unknown or other
  modified_base (430)..(430): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgaccaaacgntatgcttatgaccagcagagccggcagccctgtgtgngatgtaataagacactgagacggccctagaggggactcccgtgacgcgtacttctcgtggcctcgaggggtccaaggggtaccaaacgggttccaacgtagttcgggaccctagttcgagtggacgtccgaggacaggaggacgaggtntagacttattactgtacaagtacaacgagaacctactaagtttggtactttaagtcgttacttacgggaacttcggaccgaaaccgtaacggtaccgacccggttaccgtcggggtaccaaccggaccccgtaaacggaccccctaaaccccgacgtttcccg

SEQ ID NO: 383260 - DNA, 624 bp, Homo sapiens
  misc_feature: GZ8MTXP02HEOSL.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgcttattggtaccagcagaagcccgggccacggcccctgtgttggtgatgtaataaagacacgtgagacggccctgagggactcccgtagacgcgacttcgtcgtgcctcgaggtcaggggacaacggtcactagttcggacctatacgagtacggacgtccgaggcgaggacggacgaggctagacttagttagtttgactaaagtacaaacgtaacgaacctaaccgttaagtttacgggttaaacttagttacgtttaccgttacggtaaaacttcggaccgtaacccgtaaacggtcccgtaacccggtccgttacgggtacccaacggtaccccgaaaccgggacccctaaacccgtacgtacgtaccctacccg

SEQ ID NO: 383261 - DNA, 614 bp, Homo sapiens
  misc_feature: GZ8MTXP02H5AX8.51.71.G05.1.454.CMB.2.raw
  modified_base (241)..(241): a, c, t, g, unknown or other
  modified_base (284)..(284): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgaccaaaccgntatgcttatggtaccagcagacgccggcacggccctgtgtggnatgtaataaagacagtgaggacggccctgagggactcccgtagacgcgtattctcgtggcctccgaggttcaggggacaacggtccaatagttcggaccatcgagtggacgtcgaggcgaaggacggacgaggctagacttaattagttgtaactaaagtaccaaatacgaaacctaaccgtaagtttacggtaactttagtacgttacgtttaaccgggtaaactggtaacccgtaaacgtaaaccgggtacctaaccccggttccgttaggggacccaacggaccccgaaacggacccccaaaccccgtacttcggtaaccctacccg

SEQ ID NO: 383262 - DNA, 637 bp, Homo sapiens
  misc_feature: GZ8MTXP02G86GA.51.71.G05.1.454.CMB.2.raw
  modified_base (222)..(222): a, c, t, g, unknown or other
  modified_base (279)..(279): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaacgatatgcttatgtacagcagagccggcacggccctgtgtggtnatgtaataaagacacgtgagacggccctagagggactccgtagacgtcgtacttctcgtcggcctaccgaggtcgacggggacctaaacgggtcaacgtagttcggaccatcgagtcggacgtccgaggcgaggacgggacgagggtctaggacttaagttagttacgtactaaacttaccgaaaacgtaacgaacctaaccgttaagtttacggttaacttaagttcgttacgttaccggtaaacgttcggaccgtaaaccgtaaacggttcccgtaaccggttccgtacggggtaaccaaccggtaccccgaaaaccggacccctaaaacccccgtcgttaccggtaccttacccg

SEQ ID NO: 383263 - DNA, 677 bp, Homo sapiens
  misc_feature: GZ8MTXP02GZR22.51.71.G05.1.454.CMB.2.raw
  modified_base (242)..(242): a, c, t, g, unknown or other
  modified_base (292)..(292): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgntatgtcttattggtaccagcagaacgccgggccacggcccctgtgttggngatgtaataaagacacgtgacgacggccctcgagggacctccgtgagcgtacttctcgtgctcgaggtcacggggacaacggtcactagttcggactatacaggtacggtacgccgaggaccgaaaggacggacggacgggaccgttaggtaactttaagtttaagttacgttaacctaaaagttaccaaaacggaccgtaaaccgtaaccttaggtttacggtttaaactttacgtttacggttaccgtttaaccgggtaaaacttccgggaccgaaaccccgttaacggtaccccgtacccgttaccggtagggttacccaaccggtacccccgaaaaccggtacccccaaaaccccgttaccgtccggtaccctttaacccg

SEQ ID NO: 383264 - DNA, 596 bp, Homo sapiens
  misc_feature: GZ8MTXP02IL4NN.51.71.G05.1.454.CMB.2.raw
  modified_base (340)..(340): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctctggagatgcattcgaccaaacgatatgtcttatggtaccagcagaacgccggccacggcccctgtgtggtgatgtaataaagcacgtgagacggccctagaggctccgtgagcgtacttcncgtgcctcgaggtcgacgggacaacggtcacgtacgttcggacctagtcgtaggtacggtacgtaccgaggacgaaggacgggacgaggctagacttatttagttcgtactaagtacaaacgtaacgaccaacctagttaggttaacttagttcgtacgttacggtaactcggaacctaaccgtaacggtccgtaacccgttcgtacggtaccgaaccgcccgaacggacccccaaaccgtcgtacgtactacccg

SEQ ID NO: 383265 - DNA, 594 bp, Homo sapiens
  misc_feature: GZ8MTXP02HPG8S.51.71.G05.1.454.CMB.2.raw
  modified_base (292)..(292): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgaccaaaccgatatgcttattggtaccagcagaagccggccacggcccctgtgttggngatgtaataaagacactgagacggccctgagggactcccgtaggacgcgtattctcgtcggcctccgagggtccgaaggggaccgaaccgggtcaacgtagttcgggactaaagtcgaggtaggacgtccgaggacgaaggaggacggaggcgtagtaacttattagttagactaagtacaaacgacgacaccgtattggtacttatcgttacttacggactcgacgaccgtaacggtcctaaccgtccgtcgggtaccaaccggtaccccgaaacggacccccaaaccccgtacgtacccg

SEQ ID NO: 383266 - DNA, 593 bp, Homo sapiens
  misc_feature: GZ8MTXP02H7W6T.51.71.G05.1.454.CMB.2.raw
  modified_base (240)..(240): a, c, t, g, unknown or other
  modified_base (282)..(282): a, c, t, g, unknown or other
  modified_base (289)..(289): a, c, t, g, unknown or other
  modified_base (576)..(576): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctggagatgcattgaccaaacgntatgcttatggtacagcagagccggcacgcccctgtgtggtnatgtaanaagacactgagacggccctgagggtactccgtgacgcgtacttctcgtggcctaccgagggtcgaggggactaaacggtccacgagttcggactatcgagtggacgtcgaggcgaggacggacggaggctagaacttagtttattggtactaaatacaaactacgaaccaacgtagtttacggtaactttagtgtttccttaacggaactcggtaccgaaccgtaaagggtccctaacccgtccgttacggggacctaacggccccgaaacggaccccctaaacccncgtacgtaccctacccg

SEQ ID NO: 383267 - DNA, 497 bp, Homo sapiens
  misc_feature: GZ8MTXP02JYPMX.51.71.G05.1.454.CMB.2.raw
  modified_base (239)..(239): a, c, t, g, unknown or other
  modified_base (414)..(414): a, c, t, g, unknown or other
  modified_base (418)..(418): a, c, t, g, unknown or other
  modified_base (490)..(490): a, c, t, g, unknown or other
  modified_base (496)..(496): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggccaggcccctgtgttggtgatgtataaagacactgagaggccctgagggatcccgtgacgcgacttctctggctccgaggttcaggggacaacggtcacattggccatcagtggagtccaggcagaggacgaggctgactattatgnaatnaacagacacattggtacttatgtctcggaactgcgacaaggtcacgtctggtcaagcccaaggcccaacccnctcacnc

SEQ ID NO: 383268 - DNA, 597 bp, Homo sapiens
  misc_feature: GZ8MTXP02J19O6.51.71.G05.1.454.CMB.2.raw
  modified_base (224)..(224): a, c, t, g, unknown or other
  modified_base (241)..(241): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgcattgccaaaccgntatgcttattggtaccagcagaacgccgggccacggcccctgtgttggtgatgtaataaagacactgagacggccctgagggactcccgtgacgcgtacttcctcgtggctcgaggtcgaggggaccaacggtcacgtagttcggaccagtcgaaggtggacgtccgaggcgaggacgggacgagggtctagtaacttagttagttcgtacaacttacaaacgacgtaacaccgttaagttcggttaacttagtcgttacgttacggtaacttcggaccgaaccgtaacggtccaccgtccgtacgggtaccaaccggaccccgaaacggccctaacccgtactcgtacctacccg

SEQ ID NO: 383269 - DNA, 597 bp, Homo sapiens
  misc_feature: GZ8MTXP02HXHBR.51.71.G05.1.454.CMB.2.raw
  modified_base (179)..(179): a, c, t, g, unknown or other
  modified_base (240)..(240): a, c, t, g, unknown or other
  modified_base (256)..(256): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtntcagtcgtccccaggacagacggccaggatcactgctctggagatgcattgacccaaacgntatgcttatggtaccngcagaacgccggccaggcccctgtgtggtgatagtaataaagacacgtagaggcggccctacgagggactcccgtagacgtcgtacttctcgcggcctcgaggtcgaggggaccgaacggtccacgtagttcggacctagtcgaggttggacgtaccgaggaccgaggacggacgagggtcctagaattatttacgtattactaaatacaaacgaacgaactaaccgtagtttacggtactttagtcgttacgtacggtaaactggaccgaacgtaacggtcccaccgttccgcggtaccgaacgcccgaaaccgaccccaacctactacgtacctacccg

SEQ ID NO: 383270 - DNA, 580 bp, Homo sapiens
  misc_feature: GZ8MTXP02HESFF.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgcttatgtaccagcagaagccggccacggcccctgtgttggtgatgtaataaagactacgtgagacggccctcgagggactcccgtagacgcgtacgttctcgtggcttccgaggtcgacggggaactaacggtcaacgtagttacggacctatacgaggtacgacgtccgagggacgaggacggacgaggcctagacttattattcgtacaatacaacagactacctattggtacttagtcgtcgttacggaacgtcgacgaaccgtaacggcctaaccgtccgtaggtaccaaccgtacccgaacggaccccaaaaccccgctcgtacctacccg

SEQ ID NO: 383271 - DNA, 653 bp, Homo sapiens
  misc_feature: GZ8MTXP02IVSH8.51.71.G05.1.454.CMB.2.raw
  modified_base (245)..(245): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgaccaaaccgntatgcttatggtaccagcagaagccggccaggcccctgtgtggtgatgtaataaagacactgagacggccctcgagggactcccgtagacgcgtacttctcgtcggccttccgagggttcgaacggggacctaaaccggggttaccaacgtacgtttcgggaccctaagtaccgaggttacgggacggttcccgaaggggcgaagggaaagggacccgggagggcgtacggaactttaagtttagtttggttaaccaaattacgaaaacgacgtaacacctaagtttaggttaactttaagtcgttacgtttacggaaacttcggacgtaaaccgtaacggtccctaacccggttccgtaacggggtccaacggaccccgaacggaccccaaccccctacgttaaccg

SEQ ID NO: 383272 - DNA, 602 bp, Homo sapiens
  misc_feature: GZ8MTXP02GZHMT.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgcttagtggtaccagcagaacgccggccaggcccctgtgttggtgatgtaataaagacactgacgacggccctagagggactcccgtgacgcgtacttctcgtcgctccgaggtacgacgggggaccaacggtcaacgtagttcggacctagtcgagtggacgtccgaggcgaaggacgggacgagggctagactttaattagttagtactaagtacaacgagaacccactagttacggttaacttagttacgttacgttacggaacttacggacgtaaccgtaaacggtccaaccgtccgttagggaccaaccggaccccgaaacggaccccaaacccgtacgtacgtaccttacccg

SEQ ID NO: 383273 - DNA, 592 bp, Homo sapiens
  misc_feature: GZ8MTXP02G7O3D.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggcaggcccctgtcgttggtgatgtaataaagacacgtgagacggccctgagggactcccgtagagcgacttctctggctcgaggtcgaggggaccaaacgggtcacagttcggaccaagtcgaaggtggacgtacccgaaggggcccaaggagggacgaaggggctaggaacttatttatacgttcaaattacaaacagacaaccgtattaggttaacttatgtcgttcggtaaactcgaccgtaccgaaacggtccgtaaccgtccgtgggttaccgaacgtaccccgaacggacccaacccccgaacctcggttacctaacccg

SEQ ID NO: 383274 - DNA, 816 bp, Homo sapiens
  misc_feature: GZ8MTXP02G9UHG.51.71.G05.1.454.CMB.2.raw
  modified_base (240)..(240): a, c, t, g, unknown or other
tcagcgatcgtatacacgaccggtgctcgatttagtgtcgtcgcaagagagaggggggtgggtccaggaggtagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccggccaggcccctgtgtggtgatgtaataaagacactgagacggccctacgagggactccccgtgacgcggatttccctcgtcgggccttaccgaggtccgaaggggaccgaaacgggttcaacgtagttcgggaccctaagttccgaagggtggtaaacggttcccgaaggggacccgaaaggggaacggggtaaccggaaggggtaccctaggggtaaacctttaaagttttaaagtttcggttaaacctaaaacgtttccgaaaaacctaacgggaaaccctaaaccccgttaaagttttacgggggtttaaaaccctttttaagtttaccgggtttaccgtttaaaccgggggtaaaaccctttacggggaaaccccggtaaaaccccggttaaaacgggggtttccccaaaacccccggggttttccccggttaacgggggtttacccaaaacccgggtaacccccggaaaaacccggggtaccccccgaaaaaccccccctaccgtttaacccgggtttaccccgtaaacccctttttcccccgg

SEQ ID NO: 383275 - DNA, 621 bp, Homo sapiens
  misc_feature: GZ8MTXP02JVJA0.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggcacggcccctgtgttggtgatgtataaagacactgagaggccctgaggggactcccgtagagcgacttctcgtcggctccgaggtcgacgggacgaacggtcactagttggccatcgagtaggagtaccgaggacgagacggacgtaggctgaacttagttattacggtacaatacaacgaacgaaccaaccgtagtttacgggtaactttaagttcgttaccgttacgggtaaaaccgttcggaccggtaaacccgtaacgggttacccgtaacccggtccgttacggggtaccgaaccgtaccccggaaacgggacccccaacccccaaccgttcggtaccctaaccccg

SEQ ID NO: 383276 - DNA, 533 bp, Homo sapiens
  misc_feature: GZ8MTXP02IDT3Q.51.71.G05.1.454.CMB.2.raw
  modified_base (238)..(238): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtacagcagaagccggcaggcccctgtgtggtgatgtaataaagacactgagacggccctgagggactcccgtggacgcgtacttctctggctccgaggtcagggggacaacgggtcacagttcggcctatcgagtggagtccgaggcaggaggacgagggctagactagttatgtactaatcaacagacactattgtaacttatcgtcttacggaactgaccacgtaaaggtccaccgtacgtgggtacaacgacccgaacggacccaacccactacgacctac

SEQ ID NO: 383277 - DNA, 576 bp, Homo sapiens
  misc_feature: GZ8MTXP02F26TL.51.71.G05.1.454.CMB.2.raw
  modified_base (237)..(237): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccacggcccctgtgtggtgatgtataaagcacgtgagacggccctgagggtactcccgtgaacgcgtactttcgtcgtggccttaccgaggttcgaggggaccaaacgggtcaacgagtttcggccctatcgaagttggacgtccgaaggcgaggacggacgaggcctagaacttagtttagttcgtacaattacaaactagaaccaccattggtacttagtgtacttcggaactgacgaacctaaaggtcaccggttacgtcgggtacaacggccccgaaacggcccaaccccgtactcgtactacccg

SEQ ID NO: 383278 - DNA, 532 bp, Homo sapiens
  misc_feature: GZ8MTXP02JOKOW.51.71.G05.1.454.CMB.2.raw
  modified_base (410)..(410): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggccaggcccctgtgttggtgatgtaataaagacactgagaggccctgagggatccccgtgagcgattctctggcctcaggtcaggggacaacggtcacattcggcatcagtggagtccgaggcagacggacgaggctagactagtntagtcaatcaacagacactattggtacttagtagtcttacggacttggccgtaacgaacgtctaccgtccgtagggtacaacgccccaaagggaccccaaacccacgtacgttacctacccg

SEQ ID NO: 383279 - DNA, 575 bp, Homo sapiens
  misc_feature: GZ8MTXP02FJJOD.51.71.G05.1.454.CMB.2.raw
  modified_base (245)..(245): a, c, t, g, unknown or other
  modified_base (292)..(292): a, c, t, g, unknown or other
  modified_base (357)..(357): a, c, t, g, unknown or other
  modified_base (432)..(432): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgntatgcttatggtaccagcagaacgccggccacggcccctgtgttggngatgtaataaagcactgagacggccctacgaggactcccgtgacgcgtattctcgtggcctccgnggtcgacgggaacgacgtcactagttcggaccatcgagtggacgtccgaggcaggacggagagctagtactattntacgtacaatacaaacgagtaacaactagttacggtactttagtacgttccttacggaacttcggaccgaaccgtaaacggtccctaccgttccgtaagggtaccaccggaccccgaacggtaccccaaaccccgtctacccg

SEQ ID NO: 383280 - DNA, 563 bp, Homo sapiens
  misc_feature: GZ8MTXP02FIU61.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtgttggtgatgtataaagacactgagaggccctgaggggactccccgtgacggcgacttcctactggccttccgagggtcgaggggaccaaacgggtcaaccattggccagtccgaggtggagtccgaggcaggacgggacgagggctaggacttagttatagttacaatacaaactagacaaccagttaggtacttatgtctacggaactgccaacaacggtcacccgtcgtacgggtcaaccggaccgaaacggacccaaaccccgtactacggtacctaacc

SEQ ID NO: 383281 - DNA, 509 bp, Homo sapiens
  misc_feature: GZ8MTXP02G2X6Y.51.71.G05.1.454.CMB.2.raw
  modified_base (350)..(350): a, c, t, g, unknown or other
  modified_base (411)..(411): a, c, t, g, unknown or other
  modified_base (423)..(423): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggactccctgagcgacttctctggctccgaggtcnggggacaacggtcacattggccatcagtggagtccaggcagaggacgaggctagactattnttgtcaatcaanagacacattggtaacttatgtctacggaactgacgacctaaggtcaccgtctgggtcaacgcccaacggccaacccactcgctacc

SEQ ID NO: 383282 - DNA, 615 bp, Homo sapiens
  misc_feature: GZ8MTXP02I6LT8.51.71.G05.1.454.CMB.2.raw
  modified_base (333)..(333): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccgggccaggcccctgtgttggtgatgtaataaagacactgagaggccctgagggctcctgagcgattcnctgctcaggtcaggggacaacgggtcacgtagttcggccatcgagtggacgtcgaggcaggacgggacgaggcctagacttattacgttgtactaatacaaacaagaccaaccgtagttacggttaactttagttacgttacgttaccggtaaaactcggtaaccgtaacccggtaaaaggttcccgtaacccggttcccgtacggggttacccgaaacggtacccccgaaacggggaacccccctaaaacccccggaactttccggtaccctttaaccccg

SEQ ID NO: 383283 - DNA, 612 bp, Homo sapiens
  misc_feature: GZ8MTXP02H16US.51.71.G05.1.454.CMB.2.raw
  modified_base (242)..(242): a, c, t, g, unknown or other
  modified_base (295)..(295): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctctcactctctgcacaggctctgaggcctcctatgagctgacacagcccaccctcggtgtcagtcgtccccaggacagacggccaggatcacctgctctggagatgcattcgaccaaaccgntatgtcttagttcggtaccagcagaacggcccgggccaggcccctgtgttggngatgtaataaagacagtgagacggccctagagggactccccgtgacgcgtacttctcgtcggcctcgagggtcaggggaccaacggtcaagtacgttcggacctagtccgaggtggtacgtcccgaagggacgaaggacgggacgaggtctagtaacttagtttattcgtaactaagtacaaacgagaacctaacctagtttacggtacttagtacgttacgtacggtactcggtaccgaacgtaaacgtccgtacccgtcgtacgggtaccaaccggacccgaacggacccccaacccgtactaccgttaccaccg

SEQ ID NO: 383284 - DNA, 576 bp, Homo sapiens
  misc_feature: GZ8MTXP02IWZP3.51.71.G05.1.454.CMB.2.raw
  modified_base (457)..(457): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccgggcacggcccctgtggttggtgatgtaataaagacactgagacggccctgagggctccgtgagcgtattctcgtggcctcgaggttcaggggacaacggtcaactagttcggaccatcgaggtggacgtccgaggcaagggacgggaacgaggccgtagaacttaagttagttgtaacctaaataccaaanacgaacctacctagtttaggtaactttatgtccttacggaactcgtaccgaacgtaaacgtcgtacccgtacgtcggtacaaccgaccgaacggacccaaccctacgtcgtacctaccg

SEQ ID NO: 383285 - DNA, 535 bp, Homo sapiens
  misc_feature: GZ8MTXP02I44QI.51.71.G05.1.454.CMB.2.raw
  modified_base (225)..(225): a, c, t, g, unknown or other
  modified_base (243)..(243): a, c, t, g, unknown or other
  modified_base (357)..(357): a, c, t, g, unknown or other
  modified_base (439)..(439): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggactcacctgctctgganatgcattcgaccaaacgntatgcttattggtaccagcagaacgccgggccaggcccctgtcgttggtgatgtataaagacactgagacggccctcagggactccctggagcgattctctggctcgacggtcnggggtaccaacggtcactattcggccagcagtggacgtccgaggcaggacggacgaggctgacttattattgacaatacaanagacactagttgtacttagtgtactcggaaactgactacgaagtcaccgtcgtcggtacaacgacccgaacggaccccaaccgtactcgtactacc

SEQ ID NO: 383286 - DNA, 544 bp, Homo sapiens
  misc_feature: GZ8MTXP02FRC8X.51.71.G05.1.454.CMB.2.raw
  modified_base (105)..(105): a, c, t, g, unknown or other
  modified_base (145)..(145): a, c, t, g, unknown or other
  modified_base (239)..(239): a, c, t, g, unknown or other
  modified_base (462)..(462): a, c, t, g, unknown or other
  modified_base (485)..(485): a, c, t, g, unknown or other
tcagcgatcgtatacacgaccggtgctcgatttagtgtcgtcgcaagagagaggggcacgaccggtgctcgatttagtgtcgtcgcaagagaggaggggggggancctagctgtgctgtgggtccaggaggcagaactctgggtntctcaccatggcctggatccctctacttcctcccccctctcactctctgcacaggctctgagcctcctatgagctgacacagcccaccctggtntcagtcgtccccaggacagacgccaggatcacctgctctaggagatgcattcgacccaaaccgataagtcgctttagttggtaccagccaagaacggccgggaccccacggtcccctggtgttggtagtattgtaaataaacgacactgaagcggaccctacgacgggacttcccgagacgcgtatctcgtggactcgaggtacgagggacacggtcaacgtnttgccatcgaggtgaactccgancgacagacggaacgtgaccgtagacttattagtaagtacaaacacaacgactacactag

SEQ ID NO: 383287 - DNA, 691 bp, Homo sapiens
  misc_feature: GZ8MTXP02IUPK1.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgctattcgaccaaaccgatatgtcttagttcggtaccagcaagaacggccggccacggcccctggtcgttggtgagtagtaataaagactacgtggacgacggccctagaggaactcccgtaggacgtacgtactttccgtcgtcggtcctaccgtacgggttccgaacgggggtaccgtaaacggttccgaacctagttccggacctaagttaccgaggttaggtaacgtccggaagggaccgaaggaacgggaccggtagggtacctaggtaactttaagtttagttcggtaaactaaacgtaccaaaacgacgaaccaaccgttagtttacggtaacttattcggtacgttacggtaacgtacgaccgtaaaccgtaaacggtcccgtaaccgtccgtacggggtaccaaccgtaacccgaaaccggtaccccaaacccctacggtccgtttaaccctaccg

SEQ ID NO: 383288 - DNA, 582 bp, Homo sapiens
  misc_feature: GZ8MTXP02GQRQ1.51.71.G05.1.454.CMB.2.raw
  modified_base (240)..(240): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggccaggcccctgtgttggtgatgtataaagacactagagacggccctacgagggatcccgtgacgcgacttctctggctccgaggtcgaggggacaaacggtcacgagttcggcctatcagtggagtccgaggcaggaggtacgaggctagacttattattgtacaatacaaacagaaccaaccgtatttacggtaaactttagtagttacgtttacgggaacttcggaccgaaactaaacggggtcctacccgttaccgtgggtaccaacgtaccccgaaacggcccccaaaaccctcgtacgtacctaaccg

SEQ ID NO: 383289 - DNA, 552 bp, Homo sapiens
  misc_feature: GZ8MTXP02FN5RP.51.71.G05.1.454.CMB.2.raw
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccaaaccgatatgcttattggtaccagcagaagccgggcacggcccctgtgttggtgatgtataaagacactgagacggccctgagggactccctgagcgattctctggctcgaggtcgagggacacggtcacatcggcatcagtggagtccgaggcaggacgggacgaggcctagacgttatttagttgtacaatacgaaacaggaaccaaccgtagtttacggtactttagtgttcgttacggaaacttgaccgtacgaaaggtaccaccgtccgtggtccaacgcccgaacggacccaacccgactcgtactacccg

SEQ ID NO: 383290 - DNA, 541 bp, Homo sapiens
  misc_feature: GZ8MTXP02F42G7.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagagccgggccaggcccctgtgttggtgatgtaataaagacactgagaggccctcgagggatcccgtgagcgattctctggctcaggtcagggacaaacggtcacattcggccatcagtggacgtccgaggcaggacggaacgaggctagactattatgtacaatcaacagacacattggtacttagtgtcttacggaactggacgaaccgtaaaggtcctaacccgtccgtgggtccaacggaccccaaacgggccccaaaccccgactacgtctaacccg

SEQ ID NO: 383291 - DNA, 752 bp, Homo sapiens
  misc_feature: GZ8MTXP02H7NR4.51.71.G05.1.454.CMB.2.raw
  modified_base (183)..(183): a, c, t, g, unknown or other
  modified_base (246)..(246): a, c, t, g, unknown or other
tcagcgatcgtatacacgaccggtgctcgatttagtgtcgtcgcaagagagagggggctgtgggtccaggaggcagaactctgggtgtctcaccatggcctggatccctctacttcctccccctcctcactctctgcacaggctctgaggcctcctatgagctgacacagcccaccctcggtntcagtcgtccccaggacagacggccaggatcacctgctctggagatgcattcgaccaaaccgntatgtcttagttggtaccagcaagaacggcccggaccacggcccctgtgttggtagatagtaataaagactacgtggaacgacggtccctacgagggtacctccccgtagaccgcgtacttcgtcgtacggcctaccgagggttccgaaacggggaaccctaaaccgggtccaacgtacgtttaccggaccctagtccgtagggttaggaccgtacccggaaggaccggaacgggaagggaaccgggacgtacgttacggtaaactttaagtttacgtttacgtaaccgtaaattacccgaaaaccgtaacggtaaaccctaacccgtaaggtttttaaccgggttaaccttttaagttccggtttaaccgttacgggtaaacctttacgggaaccccgtaaaccgtaaaacggggtccccgttaacccgggttcccgtaaccggggttaccaaccggtaacccccgtaaacgggacccccctaaaacccgttccgttaaccccgg

SEQ ID NO: 383292 - DNA, 554 bp, Homo sapiens
  misc_feature: GZ8MTXP02HJJJV.51.71.G05.1.454.CMB.2.raw
  modified_base (222)..(222): a, c, t, g, unknown or other
  modified_base (430)..(430): a, c, t, g, unknown or other
  modified_base (437)..(437): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagttgacacagccaccctcggtgtcagtgtccccaggacagacggccaggatcacctgctctgganatgcattgaccaaacgatatgcttattggtaccagcagaagccgggcacggcccctgtgtgtgatgtataaagacactgagacgccctagagggatcccgtgagcgtattccctcgtggctcgaggtcagggacaacggtcacgattcgcatcagtgacgtaccgaggcaggaggacgaggctagactattagtcgtacaatttctanagaactntaccgtagttagtacttacgtcgttacgttacggtaacgtcgggacctaaacgggtcctaccgtaccgtaggtacctaccgccgaacggacccaacccgactcgacctaccgttccg

SEQ ID NO: 383293 - DNA, 628 bp, Homo sapiens
  misc_feature: GZ8MTXP02F5RQG.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgcattcgaccaaaccgatatgcttattggtaccagcagaaggccgggccacggcccctgtgttggtgatgtaataaagacactgagacggccctcgagggactccccgtgacgcgtacttctcgtggcctcgacggtcgacggggactaaacggtcacgattggaccatcgaggtggacgtccagggaccaggacggacggaggctagacttattattcgtacaatacaaacgagaaccacctagtttcggtaacttagtacgttacgttacgggtaaaacttcggaaccgtaaacccgtaaaacgggtccctacccgggttacccgtacggggttaccgaacccggtaacccccgaaacgggaacccccaaaccccgtaaccttaccgtaccctaaccccg

SEQ ID NO: 383294 - DNA, 613 bp, Homo sapiens
  misc_feature: GZ8MTXP02FSAP6.51.71.G05.1.454.CMB.2.raw
  modified_base (236)..(236): a, c, t, g, unknown or other
  modified_base (355)..(355): a, c, t, g, unknown or other
tcagcgatcgtatacacgaccggtgctcgatttagtgtcgtcgcaagagagaggggcacgaccggtgctcgatttagtgtcgtcgcaagagagaggggggggagcctagctgtgctgtgggtccaggaggcagaactctgggtgtctcaccatggcctggatccctctacttctccccctctcactctctgcacaggctctgaggcctcctatgagctgacacagccaccctggtntcagtcgtccccaggacagacggccaggatcacctgctctggagatgcattgaccaaaccgatatgcttatcgtaccagcagaacgccgggcccacggcccctgtgttggtgatgtaanaaagacactgagaggccctacgagggactcccgtagacgcgtacttctcgtcggcttaccgaggtacgaaggggacctaaacgggtactacgtaaagttcgggaccctaagttaccgaaggttacgggaacgttacccgagttacggacctaacgggaagggaaccggaaagggtccgtagggtaaacctttaagttttaagttaaggttaaacaaaacgttacccaaaaggaacgtaaacctaaccctttaaaacgg

SEQ ID NO: 383295 - DNA, 639 bp, Homo sapiens
  misc_feature: GZ8MTXP02FVLPF.51.71.G05.1.454.CMB.2.raw
  modified_base (297)..(297): a, c, t, g, unknown or other
  modified_base (494)..(494): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacacgccaccctcggtgtcagtcgtccccaggacagacgccaggatcacctgctctggagatgctattcgaccaaacgtatatgtacttattcggtaccagcagaacgccggccacggcccctgtgttggngatgtaataaagacacgtgagacggccctagaggactcccgtgacgcgtacttctcgtcggtcctaccgaggtcgaacgggtaaccaaccgggtccaacgtagtttcggaccctagtaccgtagggtacggacgtaccgagggccaaggacgggacgagtctagtaacttatttagttgtactaacgtacaaacganaacctactaagttcggtaacttagtcgttacgttacggtaaacttcggaaccgtaaccgtaccggttacccgacccggttaccgtaacgggttaccgaacccgaaccccggaaccggaacccccaaaccccggtcgtttaacccg

SEQ ID NO: 383296 - DNA, 622 bp, Homo sapiens
  misc_feature: GZ8MTXP02GU7BE.51.71.G05.1.454.CMB.2.raw
  modified_base (225)..(225): a, c, t, g, unknown or other
  modified_base (243)..(243): a, c, t, g, unknown or other
  modified_base (288)..(288): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctctgganatgctatcgaccaaacgntatgtcttatggtaccagcagacgccggcacggccctgtgtggtnatgtaataaagcacgtgagacgccctgagggtactccgtgacgcgtacttcgtcgtcggctccgaggtacgaggggtaccaacggtcacgtagttcggaccctagtacgaggtcggacgtccggaggaccgaggacggacgaggctagtaacttagttgtagtactaaatacgaactagaacctaacgttagttacggttaacttagtacgttacgttaccggtaactaccggaccgtaaccggtaaacggttcccgtaccggttccggtacggggtaccaacccggacccgtaaaccggacccccaaacccgttcgtaccgttaccgtacccg

SEQ ID NO: 383297 - DNA, 756 bp, Homo sapiens
  misc_feature: GZ8MTXP02IKPSH.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctggagatgcattgaccaaaccgatatgcttatggtaccagcagaagccggcacggcccctgtgttggtgatgtaataaagacatgaggacggccctagagggactcccgtgacgcgtactttcctcgtgggcctccgacggggttacgacgggggtaactaaaccggggtcaaccgtagtttacggggacccctaagtaccgtaaggtacgggacgttaccccgaaggggacccgaaaggggaacgggggaaaccggaaggggtccgttaacgggaaaccgtttaaagttttaaacgttttacgggttaacctaaaaacgttacccgaaaaccgaaacggtaaaccctaaacccgttaagttttacggggttaaacctttaaagttcggtttacccgtttaacgggtaaacgttacggaccggaaacccggtaaacgggtcccgtaaacccgggttcccgttaggggtacccgaaccggaacccccggaaacggtaccccccgaaaccccctaaccggttaccggtaccctaaccccg

SEQ ID NO: 383298 - DNA, 627 bp, Homo sapiens
  misc_feature: GZ8MTXP02HHPKV.51.71.G05.1.454.CMB.2.raw
  modified_base (237)..(237): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtcccaggacagacggccaggatcacctgctctggagatgcattgaccaaacgntatgcttatggtaccagcagaagccggccagcccctgtgtggtgatgtaataaagacactgagaggccctacgagggactcccgtgagcgacttctcgtggcttcgaggtcgacgggacaaacggtcactaagttcggacctatcgaaggtggaacgtcccgaggccgaaggacggaaggtaacgggcctacggtaacttaatttaagtttggaaccttaaaaactaacgaaaacgaacgtaaccgtaaaccgttaagtttacggttaactttacgtcgttacgttaacggtaacgtacgaaccgtaaacgtaaacggtaccgtaaccgtcgtacggtaccgaaccgacccgtaaaccggaccccaaacccgtacttaccgtacctaccg

SEQ ID NO: 383299 - DNA, 707 bp, Homo sapiens
  misc_feature: GZ8MTXP02H72WT.51.71.G05.1.454.CMB.2.raw
  modified_base (247)..(247): a, c, t, g, unknown or other
  modified_base (304)..(304): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggactcacctgctcgtggagatgacattacgaccaaacgntatgtacttatacggtaccagcgaagaacggccgggccaacggcccctggtgttggngattagtaataaacgacacgtaggaacggacggcccctggaacgggtactacccgtggacggtctacgttccgtcgtcggacctcgaggggtaccgacggggaaccgtaaacgtaccgacgttaagttccgggaaccctaaacgtaacggtaggtacggtaaccgtaccggaacggacgaaagggaacgggtacggacggtctaagttaacttagtttaacgttaacaaacgtaacacgaaaacgtacgtaacctaacgttaagttacgttaatttacgttacgttaccgtaacgtaacgtacggtaccgtaaccgtaacgggtcccgtaccggttccggtacggacccgaacccgtacccgaaacccggtaccccaaacccgtccgttaccgtaccctaccg

SEQ ID NO: 383300 - DNA, 596 bp, Homo sapiens
  misc_feature: GZ8MTXP02ICECC.51.71.G05.1.454.CMB.2.raw
  modified_base (223)..(223): a, c, t, g, unknown or other
  modified_base (288)..(288): a, c, t, g, unknown or other
  modified_base (331)..(331): a, c, t, g, unknown or other
  modified_base (396)..(396): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaaccgatatgtcttattggtacagcaagacgccgggcacggccctgtgttggnatgtaataaagacacgtgagcggccctgaggtctcctgagctntctcgtgctcgagtcgaggacaaggtcactagtcgaccatcagtggactcgaggacagaggacgnggctagaacttattatgactaataccaaagacgtaccaaccgtagtttaggtaaaccttttagtcgttaccgttaacccggtaagttacggaccggtaacccttaaaacggggtccctaacccgggtccgtttaggggaccaacccggaaccccaaaccgggttacccccaaaaccccgtccttaacgtcccctaacccg

SEQ ID NO: 383301 - DNA, 555 bp, Homo sapiens
  misc_feature: GZ8MTXP02F4PIL.51.71.G05.1.454.CMB.2.raw
  modified_base (225)..(225): a, c, t, g, unknown or other
  modified_base (243)..(243): a, c, t, g, unknown or other
  modified_base (350)..(350): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaaccgntatgcttattggtaccagcagaagccggccacggcccctgtgttggtgatgtataaagacactgagacgccctcgagggatcccgtgacgcgattctctggctccgnggtcgaagggacaacggtcacgtattcggaccatcgagtggacgtcccgaggcaaggaggacgagctaggacttattatgtactaatacaacagaacacctagttacggtacttatcgttcgttacggtaactcggacgaaccgtaacgtccgaaccggttccgtgggtaccacggacccaacggacccaaacccgacgttaccg

SEQ ID NO: 383302 - DNA, 564 bp, Homo sapiens
  misc_feature: GZ8MTXP02H3890.51.71.G05.1.454.CMB.2.raw
  modified_base (240)..(240): a, c, t, g, unknown or other
  modified_base (255)..(255): a, c, t, g, unknown or other
  modified_base (279)..(279): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgntatgcttatggtacngcagagccggcaggccctgtgtgngatgtataagcatgagacggccctagagggctcccgtgacgcgtacttctcgtgcctcgaggtcaggggactaacggtcagagttcgcctatcagtggacgtcaggcagaggacgaggcgtagaactagttacttgtactaagtacaaacagaacctacagtttacggactttagtcgttcgtttacggaacttcgaccggtaaccaacggttaccaacccggttccgtacggggtccaacgaccccgaaaacggccccaaaccccggacttcggtacctacccg

SEQ ID NO: 383303 - DNA, 652 bp, Homo sapiens
  misc_feature: GZ8MTXP02I8P8E.51.71.G05.1.454.CMB.2.raw
  modified_base (238)..(238): a, c, t, g, unknown or other
  modified_base (303)..(303): a, c, t, g, unknown or other
tcagcgatcgtatacacgaccggtgctcgatttagtgtcgtcgcaagagagaggggcacgaccggtgctcgatttagtgtcgtcgcaagagaggagggggggggagcctagctgtgctgtgggtccaggaggcagaactctgggtgtctcaccatggcctggatccctctacttcctccccctctcactctctgcacaggctctgagcctctatgagctgacacacgccacctcggtntcagtcgtccccgaggacagacgccaggactcactgctcgtggagatgcattcgacccaaaccgntatgtactttatcggtaccagcaagaacggccggcccctacggccctgtcggttggcgatgtaataaagactactggacgacggtccctaggaggtacctcccgtggacgtacgttattccgtacgtcggtaccttcggaacgggttaccggtaaacgggggaacctaaaccgggttcaaaccgtacggtttaccggaccctaaggtaccgtagggttacggtaacggttcccaaagttccggaacgaaggggaacggggaccgtaaacgggtctacggttaaaccttaagtttaagtaacgttactaaaacgtcccaaaaggaaccgtaacctaaacccgttttaagg

SEQ ID NO: 383304 - DNA, 594 bp, Homo sapiens
  misc_feature: GZ8MTXP02GO83N.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccacggcccctgtgtggtgatgtataaagacactgagaggccctgagggtactcccgtagagcgtacttctcgtcggcttccgaggttcgaggggaaccaaacgggtccacgtagttcggacctacgtccgaggtcggacgtccgaggccgaggacgggacgaggctagacttattagttgtacaatacaacagaacctaacctagtttaggtaactttagtcgttacgttacggtaacttggaccgtacgtaacggtaccaccgttaccgtgggtaccaacggtaccccgaacggacccaaccccgtacgtacgtaccttacccg

SEQ ID NO: 383305 - DNA, 645 bp, Homo sapiens
  misc_feature: GZ8MTXP02FQFUS.51.71.G05.1.454.CMB.2.raw
tcagcgatcgtatacacgaccggtgctcgatttagtgtcgtcgcaagagagaggggcacgaccggtgctcgatttagtgtcgtcgcaagagagagggggggggagcctagctgtgctgtgggtccaggaggcagaactctgggtgtctcaccatggcctggatccctctacttctccccctctcactctctgcacaggctctgagcctcctatgagctgacacacgcccacccgtcggtgcagtcgtcccaggacagacggccaggatcacctgctcgtggagatgcattcgacccaaaccgtatatgtactttagttacggtaccagacagaaacggccgggaccccgacggcccccgtggttcggttggtagtagttagtaaagtaaacgacgtagtaggaacggaccggtcccgtacggaacggtacctccgtaggacgtacgttacttccgtcgtacgtcctacggtaggttacggaacggaaacgacggtacacgtacggttcgacctagtacgtaggttacggacgttaccgagtacggacgaggaacgggacggtacggtactaacggttaacgtttaatttacgtaacggtaaacttaaacgtaaaccaacggtaaacaacgtaaccgtttaaacgg

SEQ ID NO: 383306 - DNA, 676 bp, Homo sapiens
  misc_feature: GZ8MTXP02J0E37.51.71.G05.1.454.CMB.2.raw
  modified_base (223)..(223): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgganatgctattgccaaaccgatatgcttatggtaccagcagaacgccggccacggcccctgtgttggtgatgtaataaagacacgtgagacggccctagagggactcccgtgagcgtattccgtctggctcgaggtcgacgggacgaaacggtcaacgtagttcggccagtcgtaaggtcggacgtacccgagggaccgaagggacggggaacggagggaccgttaggaacctttaatttacgttggtacaaattaccgaaacgtaacgaacctaaccgtagtttacgggttaacctttagttacggttaccgtttaaccgggtaacttacgggaccgaaacccggtaaaacgggttccccgaaacccggttcccggtacgggggttaccaaccgggtaccccgaaaaccggggtacccccaaaacccccgtccgttaccggtaccctttaacccg

SEQ ID NO: 383307 - DNA, 565 bp, Homo sapiens
  misc_feature: GZ8MTXP02F7LGO.51.71.G05.1.454.CMB.2.raw
  modified_base (289)..(289): a, c, t, g, unknown or other
  modified_base (316)..(316): a, c, t, g, unknown or other
  modified_base (341)..(341): a, c, t, g, unknown or other
  modified_base (347)..(347): a, c, t, g, unknown or other
  modified_base (422)..(422): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggcacggcccctgtgttggngatgtaataaagcactgagacgccctnagggactccctgacgcgattctcgngctcgnggtcagggacaacggtcacagttcgccatcagtggagtccaggcagacggacgagctagaacttattagttgtanaactacaaacagaaccactaagttcggtactttaatcgttacgtacggtaaacttcggaaccgtaaccgtaaacggtacctacccggttacgtcggggtaccaacggacccccgtaaaggacccccaaacccaacgtttaccg

SEQ ID NO: 383308 - DNA, 588 bp, Homo sapiens
  misc_feature: GZ8MTXP02GKHG3.51.71.G05.1.454.CMB.2.raw
  modified_base (241)..(241): a, c, t, g, unknown or other
  modified_base (280)..(280): a, c, t, g, unknown or other
tcagcgatcgtatacacgaccggtgctcgatttagtgtcgtcgcaagagagaggggggtgggtccaggaggcagaactctggatgtctcaccatggcctggatccctctacttcctccccctcctcactctctgcacaggctctgaggcctcctatgagctgacacagcccaccctggtgtcagtcgtcccaggacaggacgccaggatcacctgctcgtggagatgcattcgaccaacgntatgcttatgacagcagagccggcacggccctgtgtggnagtgtaataacgcagtggagacgcctagacggactccgagcgcgtacttctacgtcggtcctccgacgggtcgaacgggaaccgtaacggtacacgtagttacgggacctagtacgaggttaggacttacccggaggacgaggaacggtaccggagtactacggtaacttagtttagtacgtacaatacgaacacgtacacgtagttacgtacttagtcgttacgtacggactcgaacgaccgtacgtacctacccggtcgttacgggaaccacccggaccgacgaccccaaccgtacgtaccgtacc

SEQ ID NO: 383309 - DNA, 760 bp, Homo sapiens
  misc_feature: GZ8MTXP02GTVFO.51.71.G05.1.454.CMB.2.raw
  modified_base (179)..(179): a, c, t, g, unknown or other
  modified_base (225)..(225): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctggtntcagtcgtccccaggacagacggccaggatccacctgctcgtgganatgctattcgacccaaacgatatgtacttagttggtaccagcaaggaacggcccgggccacggcccctggtggttggtgattagtaataaacgacacgtagacggacggtccctaggacgggtactcccgtaggacgtcgtaactttccgtacgttcggccgttaccggaacgggttcggaacgggggtaaaccgtaaaccggggttaccaaaccgttacggtttaccgggaccctaacgttaccgtagggttacggggtaacgtacccgggaagggaaccgtaaagggaacggggaacgggaacgggtaccgtaaggtacctttaaagtttaagtttcggtaaactaacttaaccgaaacggaacgtaaccctaaaccgttagtttaaggttaacctttagttcgtttaccgttacggtaacgttcgggacctaacccggtaaggtaccctacccgggttcccggtaggttacccgaaccggtaaccccggaacccggaccctaacccccgtaacgtcccggttaccctacccg

SEQ ID NO: 383310 - DNA, 633 bp, Homo sapiens
  misc_feature: GZ8MTXP02GPBQF.51.71.G05.1.454.CMB.2.raw
  modified_base (229)..(229): a, c, t, g, unknown or other
  modified_base (249)..(249): a, c, t, g, unknown or other
  modified_base (300)..(300): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatccacctgctctgganatgctattcgaccaaaccgntatgtcttatgtaccagcaggaacgccggccacggtcccctggttgttggngtatagtaataaaagactacgtggagacggccctacgagggactcccgtgacgcgtactttcgtcgtggcctcgacgggttccgaaggggtaaccgtaaaccgggtcaacgtacgttcgccctagtaccgagggtgggaacgtcccggaggaccgaagggacgggagacggcgtagtacgttattagttcgtacaacttacaaacacgaacgtacctaagtttacgttaacttagttcggttacgtttaccggacgttcgaaccgacgtaacgcccgttaaccggtcgtaacgggtaccaccgacccgtaacggacccaccccgtagtacccg

SEQ ID NO: 383311 - DNA, 697 bp, Homo sapiens
  misc_feature: GZ8MTXP02JWQDS.51.71.G05.1.454.CMB.2.raw
  modified_base (243)..(243): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgntatgcttatggtaccagcagagccgggcacggcccctgtgtggtgatgtaataaagacaactgaagacggccctcgagggactcccgtgacgtcgacttcgtacgtgggccttccgaggttcgacggggtaccaacgggtcacgagttcggaccctaagtcgtaggtcggacgtacccgagggccaagggacgggaacgggaggtaccgtaggtaaacctttaagttttacgttacggtaacctaaaagttacctaaacgaacggttaaaccaacccgttaaggtttacgggttaactttagttcggtaccgtttacggtaaacgttacgggaccgtaaacccggtaaacggtacccgaacccggtttcccgggtagggttacccgaacccggtacccccggaaaacgggtaccccccaaaacccccgtacgttccggtaccctttaacccccg

SEQ ID NO: 383312 - DNA, 748 bp, Homo sapiens
  misc_feature: GZ8MTXP02HUM43.51.71.G05.1.454.CMB.2.raw
  modified_base (244)..(244): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaccgntatgcttatgtaccagcagaagccggcacgcccctgtgtggtgatgtaaataaagacacgtagagacggtcccctgagggtactccctaggacgcgtacttctcgtggtcctccgagggtccgaagggaaccgaaccgggttaccaacgaaagtttcgggaccctaaagtaccgtaagggttacgggacgttacccgaaagggcccgtaaaggggaaacgggtaaccgggtaagggacgtttaacggaaccgttttaaattttaaagttttacggttaaacctaaaacgttaaccaaaacgtaaacggtaaacccaaacccgttaaagtttcgggtttaaaactttaacgtttcggtttacgtttacccgggttaaaccgtttacggaacccggtaaaccgtaaaccgggttacccgtaacccccgtttacccggtaacgggggttaccaaacccggtacccccgaaaacgggacccccaaaacccccggtactttaaccccgg

SEQ ID NO: 383313 - DNA, 701 bp, Homo sapiens
  misc_feature: GZ8MTXP02HV92P.51.71.G05.1.454.CMB.2.raw
  modified_base (216)..(216): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagcccacctcggtgtcagtcgtccccaggacagacggccaggatcactgctntggagatgctattcgaccaaaccgtataatgtctttattcggtaaccagcaaggaaacggcccggggccacggcccccgttggttcggtttggtgattagtaataaagacacgtagacggacggccctgaggactccgtgagcgtacttctcgtcggccttacgacggttcgacggggtaacaaaccggttcaacgtagttcggacctactcgagtggtacgtccgaggcgaaggacggacggaggcttagaacttatttagttcgtataaactacgaaacgtacaacctaaccgtaagtttcggtaaactttaagtgtttaccgtttacccggaaacttcgggtaaccgtaaacccgtaaacgggttcccctaaacccgggttcccggttaacgggggttacccaaaccggtaacccccggtaaaaccggggtaaccccccaaaaccccccgtaaacgtttcccggtttaaccccgtaaccccg

SEQ ID NO: 383314 - DNA, 654 bp, Homo sapiens
  misc_feature: GZ8MTXP02GSPYP.51.71.G05.1.454.CMB.2.raw
  modified_base (243)..(243): a, c, t, g, unknown or other
  modified_base (291)..(291): a, c, t, g, unknown or other
  modified_base (535)..(535): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgacccaaacgntatgcttattggtaccagcagaagccgggccacggcccctgtgttggngatgtaataaagacactggagacggcccctagacgggtactcccgtgacgtcgtacttcgtctggctccgaggtcgaggggacctaacgggtccaagtcgttacgggacctagtcgtacgggttcggacgtccggaaggcgaaaggtacggggaacgtaacgggctacggtaacttaagtttagtttacggtactaaaattaccaaacgaacgaaacctaaccgtaagtttggtaaaacctttntacggtttccgttaacggtaaaacgttcggacgtaaaccgtacggtaccttaccgggtccgttacgggacgaaccgccccgaaaacggcccaaaccccgtagtaccggtaccttacccg

SEQ ID NO: 383315 - DNA, 506 bp, Homo sapiens
  misc_feature: GZ8MTXP02JXAIP.51.71.G05.1.454.CMB.2.raw
  modified_base (243)..(243): a, c, t, g, unknown or other
  modified_base (258)..(258): a, c, t, g, unknown or other
  modified_base (288)..(288): a, c, t, g, unknown or other
  modified_base (339)..(339): a, c, t, g, unknown or other
  modified_base (402)..(402): a, c, t, g, unknown or other
  modified_base (416)..(416): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccacctcggtgtcagtcgtccccaggacagacggccaggatcacctgctctggagatgctattcgacaaacgntagtgcttatgtacngcagagccggcaggcctgtgtgtgatgtanaagacagtgagacgcctagaggactccgtgacgcgtattctgtcggctcgnggtcagggactacgcacgtatcgacatcgagtgagtccaggctagagacgagtcagactattntgtacactacgaanacgactacgattaggtacttaatgtaccgttagactcgacgacaacggtccacgtcgtggactacggaccacggaccctaaaccattccg

SEQ ID NO: 383316 - DNA, 628 bp, Homo sapiens
  misc_feature: GZ8MTXP02F35XM.51.71.G05.1.454.CMB.2.raw
  modified_base (223)..(223): a, c, t, g, unknown or other
  modified_base (239)..(239): a, c, t, g, unknown or other
  modified_base (278)..(278): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaacctcggtgtcagtcgtccccaggacagacggccaggatcacctgctctgganatgcatcgaccaacgntatgcttagtgtacagcagagccggcacgccctgtgtgngatgtataaagcactgagacgccctagagggtactccgtagacgcgtacttcctcgtcggccttacgacggtacgacggggaaccgaaacgggtcaacgtagttcggacctagtaccgtaggttaggacgtaccgaaggacgaggacgggaacgtagggtactacggaactttaattagtttacgtaacaaatacccaaaacgacgaaacctaaccgtaagtttacgggttaaccttagttacgttacgtttaacggaacgttacggaccgaaaccgtaacggtcctaacccgttcggtacggtaccgaacgtacccgaacgacccccaaaccctacgtcaccttaaccc

SEQ ID NO: 383317 - DNA, 720 bp, Homo sapiens
  misc_feature: GZ8MTXP02F9S2T.51.71.G05.1.454.CMB.2.raw
  modified_base (252)..(252): a, c, t, g, unknown or other
  modified_base (325)..(325): a, c, t, g, unknown or other
  modified_base (504)..(504): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagcccacccgtcggtgtcagtcgtacccccgaggacaggaccggccaggactccacctgcctgtggagatgctatcgaccaaacgnttatgtcttagttcgacagcgaaggacggccgggccgacggtccccgtggtggttggtagtataggtttaaanaaacgacgtacgtggaacgaccggtccccgtaggaacgggtaccttcccgtaggacgtcgtaaccgtttcctccggtggtccccgttacggacgggttacgacggggaaccaacgggtcacgttagttcggactactagaggtacggcgaccggaggacgacgggagggtacgacggtntacgtactttagttgttacactaacctacgaacgaacgtaaaccctaccgttaagttacggtttaaacttagtacgttttaccgaacgttaacgttcgaaccgtaaccggtaaacggttcccggtaccccggtttaccgggtcggaaacccgtaacccggaaccccgaacccggtaccccctaaaaccccggtcttaccggtaccctttaacccgg

SEQ ID NO: 383318 - DNA, 592 bp, Homo sapiens
  misc_feature: GZ8MTXP02JVELW.51.71.G05.1.454.CMB.2.raw
  modified_base (285)..(285): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtggagatgcattgaccaaaccgatatgcttatcggtaccagcagacgccggcacggccctgtgtggnatgtaataagcactgagacgccctgaggctccgtgacgcgtacttcctcgtcgcctcgaggtcgagggacaacggtcactagttcggactatcgagtcggacgtccgaggcagacggacgagctagaacttattagttcgtacaatacaaacacgaactaccgtagttacggtaacttagtacgttacgttacggaacgtcgaaccggtaccgtaaacgggtcctaacccgggttcccgttacggggtaccaacccggtacccgaaaccggtaccccaaaacccccgtcgttaccgtaccctacccg

SEQ ID NO: 383319 - DNA, 632 bp, Homo sapiens
  misc_feature: GZ8MTXP02HFLAQ.51.71.G05.1.454.CMB.2.raw
  modified_base (240)..(240): a, c, t, g, unknown or other
  modified_base (325)..(325): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgccaaaccgntactgcttatggtaccagcagaagccggcaggcccctgtgtggtgatgtaataaagacacgtgacgaggccctgaggactcctgngcgacttctcgtcggcctaccgaggaccgaggggaacctaacgggtcaacgtaacgttcggaccctaattccgaaggttcggggaaaccgtacggacgggacgaagggtacgggaacggaggtcgtagtaacttaagttagttacgtaactaatacgaaacaacgtaaccacttagttacgttaacttagttacgttacgttaacggtaaacgtcggacgtaaccgtaaccggttaccgtaccgttaccggtacggtaccgaaccggaacccgaaccggaccccaacccgtacgtaccgtacctacg

SEQ ID NO: 383320 - DNA, 686 bp, Homo sapiens
  misc_feature: GZ8MTXP02IHL37.51.71.G05.1.454.CMB.2.raw
  modified_base (300)..(300): a, c, t, g, unknown or other
  modified_base (367)..(367): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggatcacctgctctggagatgcattcgaccaaaccgatatgtcttattcggaccagcagaacggccggaccgacggcccctgtgtttggngatgtaataagacacgtgacgcgccctacggaggacctcccgtggaccgcgtattctcgtcggtccncggaggtccgagggaaccgaacggtcacgtaagttcgggaccctagttacgaggttaggaacgtcccgagggccgtaaggaacgggggaaccgaggtccgtaaaggtacctttaagtttaccgtttagaactaacttaacgaaacaacggtaacctaaccgtagttttaggtaacctttaaggtcgtttaccggttaccggaacttccgggaaaccggtaacccgtaaacgggttacccgaacccccggttcggttaacgggttaacccgaaccggtaccccggaaacccggaacccccctaaccgaacccgtttccgg

SEQ ID NO: 383321 - DNA, 652 bp, Homo sapiens
  misc_feature: GZ8MTXP02HF123.51.71.G05.1.454.CMB.2.raw
  modified_base (298)..(298): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtggagatgcattcgaccaaaccgatatgtcttagttcggtaccagcaaggaacggccggccacggcccctgtgtggngtatgtaataaagacacgtagacggacgccctaggaggactcccgtgacgcgtacttcctcgtcgtcctcgaggtcgacgggacacggtcactagttcgccaatcgagtggacgtccgaggcgaaggacggacgacggcgtacgattaattgttacgtaactaataccaaaacaccgaactaccgttagttacgtttaacttagttacgttacgttaaccggtaacgttacgaaccggtaaccgtaaaacggttcccaacccgggttacccgttcggggtaacccgaaccggtaacccccgaaaacccgggttaccccaaaacccccgtcggtaccgttaccgtttaacccccg

SEQ ID NO: 383322 - DNA, 586 bp, Homo sapiens
  misc_feature: GZ8MTXP02FJENW.51.71.G05.1.454.CMB.2.raw
  modified_base (225)..(225): a, c, t, g, unknown or other
  modified_base (242)..(242): a, c, t, g, unknown or other
  modified_base (257)..(257): a, c, t, g, unknown or other
  modified_base (351)..(351): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacgccaggatcacctgctctgganatgcattgaccaaacgntatgcttatgtaccngacagaagccggcacggcccctgtgtgtgatgtaataaagacactagagacggccctacgaggactcccgtgacgcgtacttctcgtgcctcgnggtcgaacgggacaacggtcactagttcggacatcagtggacgtccgaggcgaagaggacgaggctagactattagttgtacaatacaacagacacctagttacggtactttagtcgttacgttacggtaaacttcggaccgtaaaccgtaacggtaccgacccggtttaccggcgggttaccgaaccggacccccggaaacccggacccccgtaaaccccctacgttaaccccg

SEQ ID NO: 383323 - DNA, 634 bp, Homo sapiens
  misc_feature: GZ8MTXP02HUIJO.51.71.G05.1.454.CMB.2.raw
  modified_base (223)..(223): a, c, t, g, unknown or other
  modified_base (334)..(334): a, c, t, g, unknown or other
tcagcgatcgtatacacgaccggtgctcgatttagtgtcgtcgcaagagagaggggggtgggtccaggaggcagaactctgggtgtcccaccatggcctggatccctctacttctccccctcctcactctctgcacaggctctgaggcctcctatgagctgacacagccaccctcggtgtcagtcgtccccaggacagacggccaggatcacctgctctgganatgcattcgaccaaaccgatatgcttattggtaccagcagagccgggccacggcccctgtggttggtgatgtaaataaagacactggagacggcccctagagggactccgngacgcgtattcctcgtcggtcaggtcgacgggactacgggtcaacgtagttcggacctagtcgaggtggacgtccgaggcgaggacggagagcgtagactttattagttacgtactaaactactaaacgacgaacctaacccgtaagtttacggttaactttaagttcggtttaccgttacggtaaacttccgacggtaaaccgtacggtaccctaccggttccgttacgggacctaccgaccccgaaacggaccccaaacccccgtacgtaccgtaccttaccgttccgtttacccccg

SEQ ID NO: 383324 - DNA, 701 bp, Homo sapiens
  misc_feature: GZ8MTXP02HBF5C.51.71.G05.1.454.CMB.2.raw
  modified_base (626)..(626): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctcgtggagatgctattcgaccaaacgtatatgtctttattcggtaaccagacaaggaacgcccgggaccacggtcccctggtgttggtgattgtaataaagacacgtgacgcggccctgaggactccgtgacgtcgaccttcgcgtacggctcgaggtcgacggggaactacgggtctacgacgttcggacattcgaggtacggcgtaccgaggacgaggacgggacggaggtctacgacttaagtttgttaggtaacctaagtacaacgtaacgtaacccaaccgtttagtttaccggttaactttacggtttacgttaccggttacccggttaaacttaccggggaacccgtaaaccgttaaaccgggttaccctaaacccggggttccggtcggggttaaaccccncccgggtaaacccccggaaacccgggtacccccttaaaacccccggtacctccggtttaaacccccttaccccgg

SEQ ID NO: 383325 - DNA, 658 bp, Homo sapiens
  misc_feature: GZ8MTXP02IHR4D.51.71.G05.1.454.CMB.2.raw
  modified_base (223)..(223): a, c, t, g, unknown or other
  modified_base (290)..(290): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgctattcgaccaaaccgatatgcttatggtaccagcagaagccgggccacggcccctgtgttggngatgtaataaagacactgagacggccctgaggactcccgtgaagtcgaacttcctcgtacggctccgaggttcgagggggaccaacggggtacaaccgtagtttcgggcctaagtccgtaggtcgggaacgtcccgagggaccgaaggtacgggacggaaggtcgtacggtacttaatttagttacgtactaaactaccaaacgtacgaacctaaaccgtagtttacggttaactttaagttcgttacgttaccggtaaacgtcgaccggtaaccgtaaaacggtccgtaacccggttccgttacggggttacaaccggtaccccgaacgggtacccccaaaccccgtacgttacggtaccttacccg

SEQ ID NO: 383326 - DNA, 676 bp, Homo sapiens
  misc_feature: GZ8MTXP02G6YS2.51.71.G05.1.454.CMB.2.raw
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagcccacccgtcggtgtcagtcgtccccaggacagacggccaggatcacctgcctcgtggagatgcattcgaccaaaccgtatagtgtcttagttcggtaccagacaagaacggcccgggccgacggccccgtggtcggttggtgagttgtaaataaacgactaacgtggaacggacggcccgtacgaacgggtacctacccgtagacgtcgtaccttcgtcgtcggacctcggacggttcgaggggtaaccgaacggtcacgtagttacgggacctaagtccgtaggtcggacgtaccggaggacgaaggacgggacgggtacggacgtaggtaacttaagtttagttaacggtactaaataccaaaacgaacgaacctaacgttaacggtttacgttaacgtttactacgtttaccgttacgggtaacttacggtaccgaaaccgtacgtacccgtacgtccgtcgtacgaacgacccgaacgacccaaccctacgtacgtactaccc

SEQ ID NO: 383327 - DNA, 554 bp, Homo sapiens
  misc_feature: GZ8MTXP02HU9YP.51.71.G05.1.454.CMB.2.raw
  modified_base (228)..(228): a, c, t, g, unknown or other
  modified_base (247)..(247): a, c, t, g, unknown or other
  modified_base (357)..(357): a, c, t, g, unknown or other
  modified_base (442)..(442): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagcccaccctcggtgtcagtgtcccccaggacagacggccaggatccacctgctctgganatgctattcgaccaaacgntatgcttatgtaccagcagaacgccggccacggcccctgtgttggtgatgtaataaagacacgtggagacggccctgagggtactcctgacgcgtattctcgtgcctcgnggtcgacggacacgtcactagttcggcatcgagtggatcgaggcaggaggacgagctagtactatttagttgtacaataccaaanagactaactagttagttaaactgttcgttacgttacggaaacttcgaccgtaacgaacggtcctacccgttacgcggtacccacgacccgacggaccccaacccgtactccg

SEQ ID NO: 383328 - DNA, 637 bp, Homo sapiens
  misc_feature: GZ8MTXP02HW7IY.51.71.G05.1.454.CMB.2.raw
  modified_base (295)..(295): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccacctcggtgtcagtcgtccccaggacagacggccaggatcacctgctcgtggagatgcattcgaccaaacgatatgtcttattcggtacagcagaacgccggcacgcccctgtgtggtgatagtanaaagacacgtagagacgccctagaggtactccgtagacgcgtacttctcgtcgcctcgaggtcgacgggacacggtcacgtagttcggactatcgagtcggtacgtcgaggacgaggacggacgagggtctagacttaatttgttacgtactaatacaacgaacgactaaccgtagtttaacggtactttagttagttaccgtttaaccgggtaacttacgggtaaccgaaccccggttaaacggttaccctaacccgggttcccgtagggttaaccccaaccgggaccccgtaaacccgggaccccctaacccgtaccggttaccttacccgtttaacccg

SEQ ID NO: 383329 - DNA, 589 bp, Homo sapiens
  misc_feature: GZ8MTXP02GJOUH.51.71.G05.1.454.CMB.2.raw
  modified_base (244)..(244): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgctattcgacccaaacgntatgcttattggtacagcagaagccgggccaggcccctgtgtggtgatgtaataaagacactgagacggccctcgagggactcccgtgacgcgacttctctggctccgaggtcgaggggacaacggtcactagttcggaccatcgaggtggacgtaccgaggcgaaggaggacggaggccgtagtacttagttattgtactaatacaaacagaaccacctagttggtaacttatacgttacttacggtaacttacgaccgtaaccgtaaacggtcctacccgtaccgtacggtcgaaccgaccccgaaacggacccccaaaccccgacgtacgtaccctaacccg

SEQ ID NO: 383330 - DNA, 656 bp, Homo sapiens
  misc_feature: GZ8MTXP02I4P6I.51.71.G05.1.454.CMB.2.raw
  modified_base (222)..(222): a, c, t, g, unknown or other
  modified_base (247)..(247): a, c, t, g, unknown or other
  modified_base (342)..(342): a, c, t, g, unknown or other
  modified_base (352)..(352): a, c, t, g, unknown or other
  modified_base (464)..(464): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagcccaccctggtgtcagtcgtccccaggacaggacggccaggactcacctgcctntggagatgctagttcgaccaaacgntatgtcttattacggaccagcaaggacggcccggccgacggccctgtgttggtgatagtaagtaaagactacgtgagacggccctgaggctccgngagtcattcncgtcgctcgaggtacgaggggaccaaacggtcaactgtcggacctatcgagtggacgtcgagggacagggaggacggacgtcgtagtacttaagtttcgttaagacttaaanaccgaaacgaaagtaccctaacgttaagtttacggttaaactttcgtacgtttacgttaaccggtaacgtacggacccgtaacggtaaaaccgggttcccgtaccggttaacccggttgggaaccccgtaacggaaaccccccgtaaacgggacccccctaaaaccccggtctttaccggtaacctaccccg

SEQ ID NO: 383331 - DNA, 705 bp, Homo sapiens
  misc_feature: GZ8MTXP02JLUYX.51.71.G05.1.454.CMB.2.raw
  modified_base (106)..(106): a, c, t, g, unknown or other
tcagcgatcgtatacacgaccggtgctcgatttagtgtcgtcgcaagagagaggggcacgaccggtgctcgatttagtgtcgtcgcaagagaggagggggggggancctagctgtgctgtgggtccaggaggcagaactctgggtgtctcaccatggcctggatccctctacttctccccctcctcactctctgcacaggctctgacgcctcctatgagctgacacacgcccacccgtcggtgtcagtcgtccccaggacagacgccaggactcacctgctcgtggagatgctattcgaccaaaccgtatatgtactttagttcggtaaccagacgaaggaacggcccgggaccccgaccggtccccgtggttacggttggtagtaagttacgtaaagttaaaacggacccgtaacgtacggaacgggtaccgggtaccccgtacggaacgggtaccgttccccgtaggacgtcgttacttccgtcgttcggtccctacggtacgggtaccggaacgggtaaccgtaaccgggtacctacgtacgttacggacctagtacgaggttacggtacgtccgtagtcggaaccgagggacgggaacggtacggtaccgttaacggtaacctttaacgttttaagttaacgttaaacctaaaacgttaaccgaaaacgtaaaccgtaaacccgtaacccgttttaaacgg

SEQ ID NO: 383332 - DNA, 541 bp, Homo sapiens
  misc_feature: GZ8MTXP02GWMQD.51.71.G05.1.454.CMB.2.raw
  modified_base (276)..(276): a, c, t, g, unknown or other
  modified_base (284)..(284): a, c, t, g, unknown or other
  modified_base (413)..(413): a, c, t, g, unknown or other
  modified_base (448)..(448): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcacctgctctggagatgcattgaccaaacgatatgcttatggtaccagcagagcggcagcctgtgtgngatgtaanaagcagtgagacggccctagagggtactccgtagacgcgtacttctgtcgctcgagtcgagggtcaacggtcacgtagttcggacctagttccgaggttacggacgtaccgaggacgaggacggaacgngacgtagaacttagtttagtgacaaatcaaacganactactagttgtactttatgtccttagaactggactacgtaacgtcaccgtcgcggtacaacgtcccaacggccccaaccgtctcgtactccg

SEQ ID NO: 383333 - DNA, 737 bp, Homo sapiens
  misc_feature: GZ8MTXP02F1P5Z.51.71.G05.1.454.CMB.2.raw
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcattcgacccaaaccgatatgtactttagttacggtaccagcaaggaacggcccgggaccacggtcccctggtggttggtgattagtaataaacgactacgtaggacggacggccctcgagggtacctcccgtgaacgcgtacctttccgtcgtcggtccttaccgagggtaccgaggggaaccaaccggtacacgtagttacggacctagtacgtagggtcggtaaccgtccgaacgggacgaagggaacggggaaccggaggtacccttagggtaactttaagtttaagtttacgaaccgtaaaagtaccaaaaccggtaacgtaaccccgtaaaccttaaggtttaacgggtttaaacctttacgttacggtttacgttaaccggtaaacgttacgggaacccgtaaaccggttaaacggtccgtaaaccccgggttccgtacggggtaccgaacccgacccgaaaccggaccccctaaaacccgtcgtaccgttacttaaccccg

SEQ ID NO: 383334 - DNA, 628 bp, Homo sapiens
  misc_feature: GZ8MTXP02HNLHA.51.71.G05.1.454.CMB.2.raw
  modified_base (217)..(217): a, c, t, g, unknown or other
  modified_base (221)..(221): a, c, t, g, unknown or other
  modified_base (238)..(238): a, c, t, g, unknown or other
  modified_base (287)..(287): a, c, t, g, unknown or other
  modified_base (296)..(296): a, c, t, g, unknown or other
  modified_base (338)..(338): a, c, t, g, unknown or other
tcagcgatcgtatacacgaccggtgctcgatttagtgtcgtcgcaagagagagggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcactgctntganatgcattgaccaaacgntatgcttattggaccagcagaacggccgggcacggccctgtgtgggtanagtagtaanaagacagtagacgacgcctagaggactccgagacgctactcncgtcgctcgaggtacgacggacaacgtcacgtagtcgactagtacgaggtacggacgtacgagggacgaaggtaacggaacgtacggtacgttacgtaactttagtttaagttacgtaactaaaactacgaaacgagaaacctaacgttaggttacgttaacttagttacgtttacgtaaccggtaacgtacgaaccggtaaacgtaaccgggtacctaccggtaccggttacggaaccgaaccggaacccgaaaccggaccccaaacccgtacgtaccgtacctacccg

SEQ ID NO: 383335 - DNA, 595 bp, Homo sapiens
  misc_feature: GZ8MTXP02GB9G4.51.71.G05.1.454.CMB.2.raw
  modified_base (475)..(475): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgctattcgacccaaacgatatgtcttaattggtaccagcaagaacgccggccacggcccctgtgttggtgatagtaataaagacactggagacggccctacgagggatcccgtagaccgcgtacttctcgtcggcctacgacggtcgaacggggaaccaacgggtacaacgtacgttcggaccctagtacgaggtacggacgtccgaggacgaaggacgggacgagtctagtactaattagttcganaatacgaacacgaacactaagttgtaactttagtgttcgtacgtacgtctaccggaactaacggtctaccggtacgtaacggtccaaccgacccgaaccggaccctaacccgacttaccg

SEQ ID NO: 383336 - DNA, 672 bp, Homo sapiens
  misc_feature: GZ8MTXP02IS4TO.51.71.G05.1.454.CMB.2.raw
  modified_base (181)..(181): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccacctcggtntcagtcgtcccaggacagacggccaggactcacctgctcgtggagatgctattgacccaaacgttatgcttatcggtaccagcagaacggccggccgacggtcccctgtcggttggtgtatgtaataaaacggactaacgtggacggacggcccttacggaagggtacctcccgtaggacggtacgtacttccgttcgtcggccttaccgacgggttaccgacggggaaaccgtaaaccgggtccaacgtagttacggaccctagtaccgaggttcggaacgttcccgaggaccgaagggaaggaacgggtagacgttacggtaatttaagttacgttttacgacttaaactaccaaacgaacgacctaacgtagtttacggttaacctagtacgtttaccggtacggtaactcggaacccgtaacgtacggttacccaccggttacgtcggactaccgacccggaacgaccccaaccccgtaacttcccg

SEQ ID NO: 383337 - DNA, 591 bp, Homo sapiens
  misc_feature: GZ8MTXP02JGH6R.51.71.G05.1.454.CMB.2.raw
  modified_base (450)..(450): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgctattcgaccaaaccgatatgcttatggtaccagcagaacgccgggccacggcccctggtcgtggtgatgtaataaagacactgagacggccctagagggactccgtagacgtcgtacttcgtacgtcgctccgaggtcgacgggggtaaccaacgggtcaactgttcggaccaatccgagtcggacgaccgaggcgagacggacggaggtctagacttagttnttaggtactaaatacaaacagaacctacctagttacggtaacttagtcgttacgtacgtaaacgtcggacgtaaaccgacgtacgccgtacgttgggaccaacggtacccaacggtaccccaaccgtactacgtcctaccg

SEQ ID NO: 383338 - DNA, 636 bp, Homo sapiens
  misc_feature: GZ8MTXP02GKSXP.51.71.G05.1.454.CMB.2.raw
  modified_base (183)..(183): a, c, t, g, unknown or other
  modified_base (228)..(228): a, c, t, g, unknown or other
  modified_base (249)..(249): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacacgccaccctcggtntcagtcgtccccaggacagacggccaggatcacctgctcgtgganatgactattcgaccaaacgtntatgtcttatcggtaccagcagaacgccggaccacggcccctgtgttggtgatgtaataaagacagtgagacgcctacgaggtactccgtgacgcgtacttcgtcgtcggcctcgacgggtcgacgggaaccgtaacggtctaacgtagttcgggactagtacgaggtacggacgtacccgaggccgaagggaacggggacggacggtcgtagtaacgttaaatttagttacgtactaaacgtacaaaccgacgaactacctagtttacggtactttaagtcgttacgttacggaaactcggaccgtaaaccgtacgggtcccgaaccgttccggtaacggtacccgaacggaccccgaacggaccccgaacccctacgttacccgg

SEQ ID NO: 383339 - DNA, 632 bp, Homo sapiens
  misc_feature: GZ8MTXP02G2WHL.51.71.G05.1.454.CMB.2.raw
  modified_base (287)..(287): a, c, t, g, unknown or other
tcagcgatcgtatacacgaccggtgctcgatttagtgtcgtcgcaagagagaggggcacgaccggtgctcgatttagtgtcgtcgcaagagagaggggggggagcctagctgtgctgtgggtccaggaggcagaactctgggtgtctcaccatggcctggatccctctacttctccccctcctcactctctgcacaggctctgagcctctatgagctgacacacgcccacccgtcggtgtcagtcgtccccaggacaggacggccaggactcaccgtgctcgtggantgctattcgaccaaaccgatatcgtctttagttcggtaccagcgaagaacggccggacccgacggcccccgtgtcggttggagtatggtaataaagctacgtgaagacgccctagagggtactcccgtagacgtcgtattccgtacgtcggtcctaccgaggtcgaaacggggaacaaaccgggttcaacgtaggttccgaccgtagtacgacgggtacgtaacgtccctagtacgaccggaagggagggaaacggacgggtaccgtaggtaaacctttaacgtttaaagtttaacgtaaactaaacgttacgaaaacaaccggtaacctaaacccggtttaagg

SEQ ID NO: 383340 - DNA, 695 bp, Homo sapiens
  misc_feature: GZ8MTXP02J29R3.51.71.G05.1.454.CMB.2.raw
  modified_base (181)..(181): a, c, t, g, unknown or other
  modified_base (224)..(224): a, c, t, g, unknown or other
  modified_base (290)..(290): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctggtntcagtcgtcccaggacagacggccaggatcactgctcgtgganatgcattgaccaaacgatatgtacttattcgaccagcagagccggcacgcctgtgtgtgatgtaanaagcacgtgagacgccctagacggtactccgtagaccgacgtattccgtcgtcggtccgttaccggacgggtaccggaaacgggaaccgtaacgggttaccaacgtaacgtttcgggaccctaaagttcgaacgggtacggtaccgtacccgagggacgaacgggacggaaaccgggttgtaccgtaggtaaaccttacttaaggtttacgaaacctaacgttaacccaaaacgaccggtaaacctaacccgttaagtttaccggttaaacttaaacgttcgtttacgttaacccggaaacttacggtaacccggaaacctaaacgggtccctaaacccggttccggttaacggacccgaaccgggacccaaaacccgggacccctaaaaccccggcttaacccg

SEQ ID NO: 383341 - DNA, 721 bp, Homo sapiens
  misc_feature: GZ8MTXP02GCP6U.51.71.G05.1.454.CMB.2.raw
  modified_base (239)..(239): a, c, t, g, unknown or other
  modified_base (277)..(277): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctggagatgcattgaccaaacgntatgcttatgtacagcagacgccggcagccctgtgtgngatgtaataaagcacgtgagacggccctgagggtactcccgagacgcgtacttcgtcgtcgtcctcgaggtcgacggggacaacgggttcaacgtacgttcgggaccctaagttaccgaggttacgggttacgtacccggaaggggacccgaaaggggaccggggaacggacgggtaccgttaacgtaaaccgtttaaatttaggtttacggttaaacctaaacttaaccggtaaaacaacggtaaaccctaacccgttaaggttttaacgggtttaaacctttagttaccggtttacgtttaaccgggtaaacgttacggaaccggtaaacccgtaaaacgggttcccgtaacccggttaccggtacgggttaacccaaccgggtaacccccgtaaacgggaaccccctaaccccctaacggttcccgtaccgtttaaccccg

SEQ ID NO: 383342 - DNA, 694 bp, Homo sapiens
  misc_feature: GZ8MTXP02F7NHT.51.71.G05.1.454.CMB.2.raw
  modified_base (184)..(184): a, c, t, g, unknown or other
  modified_base (251)..(251): a, c, t, g, unknown or other
  modified_base (299)..(299): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttcctccccctcctcactctctgcacaggctctgaggcctcctatgagctgacacagcccaccctcggtntcagtcgtccccaggacaggacggccaggatccacctgctcgtggagatgctattcgaccaaaccgntatgtcttagtgtaccagcagaacgccggcacggcccctgtggttggngtatagtaataaagactacgtggagaccggccctagacgggtacctcccgtaggacgtacgtacttcgtcgtcggtcctaccggtacgggtacggaacgggaaccgtaaaccggtccgtaacgtacgttcggaccctagtaccgaggtacggacgtccgaacggcgaaggacgggacgacggtcgtaaggtaacttaagtttagttagtacaaacttaccgaaacaacgtactaaccgttagtttaacgggttaactttagttcggtttaccgttaacggtaaacctacggtaacccggtaaaccgtaaccgggtaccccgtaacccggttcggttaacggtacccgaaccgtacccccggaaaacggacccctaaacccccgtacgttaacccg

SEQ ID NO: 383343 - DNA, 631 bp, Homo sapiens
  misc_feature: GZ8MTXP02FK5ZV.51.71.G05.1.454.CMB.2.raw
  modified_base (458)..(458): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgaccaaacgatatgcttattggtaccagcaagagccgggccacggcccctgtgtggtgatgtaataaagacactgagacggccctagagggtactcccgtagacgtcgtacttctcgtgacctccgaggtacgaggggacctaaacgggtcaacgtagttcggaccatcgaggtggacgtaccgagggacaaggagggacggacgggtctacggtaattaagtttnttacgtactaaataccaaaacaacgaaccaaccgttagtttaccggttaaacttagtacggttacgttaccggtaaacttcggaaccgtaaccgtaaacgggtccctacccggttacgtcggggaccaaccggaccccgaaacggaccccaaccctacgtacgtcctaacccg

SEQ ID NO: 383344 - DNA, 739 bp, Homo sapiens
  misc_feature: GZ8MTXP02IOCD2.51.71.G05.1.454.CMB.2.raw
tcagcgatcgtatacacgaccggtgctcgatttagtgtcgtcgcaagagagagggggggtgggtccaggaggcagaactctgggtgtctcaccatggcctggatccctctacttctcccccctcctcactctctgcacaggctctgaggcctcctatgagctgacacagccaccctcggtgtcagtcgtccccaggacagacggccaggactcacctgctcgtggagatgctattcgaccaaacgatatgtacttatggtaaccagacagaacggccggcacggtcccctgtgtggtagatagtaataagacacgtgagacgccctagaggactccgtagacgcgtacttcgtcgtgtcctcgaggtacgacggggtaactaacggtactaacgtagttcggacctagtacgtagtacggtacgtacgacggacgaagggacgggaacggacggtaacgttacggaatttaaacgtttaacggtttactaaacgttaaaacgtaaccgaaaacgtaaacccggaacccttaaaccgttaaacgtttttacggggtttaaacctttacggtttaacggttacccggtttaaacggtaaaccggttacgggtacccgtaaacccggtaaacgggttacccgtaccccggggttaccgttacggggtacccgaaaccgtaacccccggaaaccgtaaacccccgtaaccccgtaaaccgtttccggaacccgtttaaccccg

SEQ ID NO: 383345 - DNA, 653 bp, Homo sapiens
  misc_feature: GZ8MTXP02IP5DL.51.71.G05.1.454.CMB.2.raw
  modified_base (222)..(222): a, c, t, g, unknown or other
  modified_base (338)..(338): a, c, t, g, unknown or other
tcagcgatcgtatacacgaccggtgctcgatttagtgtcgtcgcaagagagaggggcgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaaccgatatgcttattggtaccagcagaagccggaccaggcccctgtgttggtgatgtataaagacactgagagccctgagggactcccgtgacgccgtattcncgtggctaccgaggtcgacggggtaacaaccgggtcaacgtacgttcgggacccattaccgaggttacggacgttcccgaaggggaccaggacgtacggaaccggaggtcctagggaacctttagtttaagtttacggtactaaagttacaaaacgaacgtaaccaaccgtagtttaacgggttaacttaacgtcgttacgttacggtaaacgttcgaccgtaaccgaaacggttaccgtaaacccggttccgtaacgggggttaccaaccggtaccccgtaaacgggacccccaaaaccccttcgttaaccccg

SEQ ID NO: 383346 - DNA, 561 bp, Homo sapiens
  misc_feature: GZ8MTXP02I94HR.51.71.G05.1.454.CMB.2.raw
  modified_base (167)..(167): a, c, t, g, unknown or other
  modified_base (237)..(237): a, c, t, g, unknown or other
  modified_base (362)..(362): a, c, t, g, unknown or other
tcagcgatcgtatacacgaccggtgctcgatttagtgtcgtcgcaagagagaggggcacgaccggtgctcgatttagtgtcgtcgcaagagagaggggggggagcctagctgtgctgtgggtccaggaggcagaactctgggtgtctcaccatggcctggatccctntacttctccccctctcactctctgcacaggctctgaggcctcctatgagctgacacagcccaccctggtntcagtcgtccccaggacagacggccaggactcacctgctcgtggagatgcattcgaccaaaaccgatatgtactttagtcgtaccagcgagaacggccggccacgccctgtgttcgtgatgtaanaaacgacacgtgagacgccctagaggactcccgtagagcgtatttcctcgtgtcctacgacgtcgaacgggacaacggtcacgtagttcggacagtcaggtacgacgttaccaagtcgacgaggaacggtacgaacggtcgtacgtaacgttaatttaacgtgttaacaaacttacaaacgtacaacctaacctttaag

SEQ ID NO: 383347 - DNA, 538 bp, Homo sapiens
  misc_feature: GZ8MTXP02GX4K8.51.71.G05.1.454.CMB.2.raw
  modified_base (240)..(240): a, c, t, g, unknown or other
  modified_base (426)..(426): a, c, t, g, unknown or other
  modified_base (434)..(434): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggccccctgtcgttggtgatgtataaagacactgagaggccctcagggatcccctgagcgattctctggctccaggttcaggggtacaacgggtcacattcgggaccatcagttggacgtcccgaggccagaggacgaggctgactattatgtnaatcaacngaacaccattggtacttagtgtacgttcgaactgacgaccgaaaggtccaccgtcctgggtccaacggcccgaaacggcccaaaccccgacgtcgtctaacccg

SEQ ID NO: 383348 - DNA, 569 bp, Homo sapiens
  misc_feature: GZ8MTXP02H1F6L.51.71.G05.1.454.CMB.2.raw
  modified_base (221)..(221): a, c, t, g, unknown or other
  modified_base (240)..(240): a, c, t, g, unknown or other
  modified_base (386)..(386): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccacctcggtgtcagtcgtccccaggacagacggccaggatcacctgctctgganatgctattcgaccaaacgntatgcttattggtaccagcagaacgccgggccacggcccctggtgttggtgatagtataaagacatgagacggccctgagggactccgtgagcgtacttctcgtcggctcgaggttcaggggaccaaaggtccacagttcgactancgagtggacgtccgaggcaggacggcgaaggcgtagtacttaagtttatttacgtactaaagtaccaaacgtacgaactacctagtttacggtacttattcgtcttaacggactgaccgtacaaacggttcaccgttacgcggtcaaccgacccgaacgccccaaccgcctacgtacctaccg

SEQ ID NO: 383349 - DNA, 664 bp, Homo sapiens
  misc_feature: GZ8MTXP02F2KHZ.51.71.G05.1.454.CMB.2.raw
  modified_base (226)..(226): a, c, t, g, unknown or other
  modified_base (241)..(241): a, c, t, g, unknown or other
  modified_base (414)..(414): a, c, t, g, unknown or other
tcagcgatcgtatacacgaccggtgctcgatttagtgtcgtcgcaagagagaggggcacgaccggtgctcgatttagtgtcgtcgcaagagagagggggggggagcctagctgtgctgtgggtccaggaggcagaactctgggtgtctcaccatggcctggatccctctacttcctccccctctcactctctgcacaggctctgaggcctcctatgagctgacacncgcccacccgtggtntcagtcgtcccgaggacagacggccaggactcacctgctcgtggagatgctagttcgacccgaaaccgatagtcgtactttagttacggtaacctagaccgaagaaacggcccggaccccgaccggtccccctggtcggttggtagtagttgtaaacgtaaacgacgtaacgnggacgacggaccccgttagacggtacctcccgagacgacgtattccttcgtcggtccacgtacggtacgacgggactaaccggtcacgtaggttcgacctagtaccgtaggttacggacgttacccgaagtacggaccgaaagggacggaaaccggtaccgggttacgttaacgttaaacgttaacgtttaacgttaacgtaaactaaaacgtaacctaaaacgtaaccgtaaaccgtaaccgtttaacg

SEQ ID NO: 383350 - DNA, 585 bp, Homo sapiens
  misc_feature: GZ8MTXP02J0OON.51.71.G05.1.454.CMB.2.raw
  modified_base (167)..(167): a, c, t, g, unknown or other
  modified_base (235)..(235): a, c, t, g, unknown or other
  modified_base (278)..(278): a, c, t, g, unknown or other
  modified_base (295)..(295): a, c, t, g, unknown or other
tcagcgatcgtatacacgaccggtgctcgatttagtgtcgtcgcaagagagaggggcacgaccggtgctcgatttagtgtcgtcgcaagagagaggggggggagcctagctgtgctgtgggtccaggaggcagaactctgggtgtctcaccatggcctggatccctntacttctccccctctcactctctgcacaggctctgagcctctatgagctgacacagcccaccctggtntcagtcgtccccaggacagacggcaggatcacctgctctggantgcattcgaccaaacgntagtgtacttagttacgtacagcagaacgccggcccacggcccctagtcgttggtgatgtaataaacgacacgtgaacgacggccctagacgggtactcccgtagacgcgtattcctcgtaggtcctaccgaggtcgaagggtaccaacggctacacgttcggactacgtcgaggtcggacgttccagtcggaccgaaggacgggacgtaacggtccgttaggtaaccttaagtttacgttaacggtaactaaacgtaccgtaaacacggtaaccctaacgtttaaacgg

SEQ ID NO: 383351 - DNA, 619 bp, Homo sapiens
  misc_feature: GZ8MTXP02ISOZE.51.71.G05.1.454.CMB.2.raw
  modified_base (458)..(458): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgctattcgaccaaaccgatatgtcttagttgtacagcaagacgccggccacggcccctgtgttggtgatgtaataaagacacgtagagacgccctagaggactccgtagacgtacgtacttccgtcgtcgcctaccgaggttcgacggggactaaacggtccacgtagttcggacctatacgaggtagacgtccgaggacgagggacggtacgaggctacgtattaaagttnttacgataatacgaaacacgaccacctagtttacggtaacttagtacgttacttaccggtaacgtcggaccgtaaaccgtaacggttccctaaccgggtccgttagggacccaaccggaacccaaccggaccccctaaacccgacgttacgtaccttaccc

SEQ ID NO: 383352 - DNA, 703 bp, Homo sapiens
  misc_feature: GZ8MTXP02IBWVF.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtcccaggacagacggccaggactcactgctcgtggagatgctagttcgaccaaacgtatatgtacttagtacggtaccagacgaagaacggccggccgacggcccctggtggttggtagtagtagtaaagtaaacgacacgtaggaggacggccctacggaggtactcccgagacgcgtacttctcgcgtctacgaggtacgagggaaccgtaaacggtactaccgtagttcggacctacgtacgtaacgggtacggtaccgtacccggaagggaccgaagggacgggaacggtaggaccgtagtaaccgttaaagtttattacggtaactaaataaccgaaacgaacgtaacctaaccgttaaggttaacggttaaccttagttacgttaccggttaaacgacgttaccggtaccgaaacccgtaacggttacccgacccgtaccggttccggaccgtaacccgaaacccggaaaccggacccccaacccgtaccggttacgacccgttaccccg

SEQ ID NO: 383353 - DNA, 734 bp, Homo sapiens
  misc_feature: GZ8MTXP02G1IOB.51.71.G05.1.454.CMB.2.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgctagttcgacccaaacgattagtgtacttagttcggtaaccagcgaagaacggcccggggtccgaacggtcccccgtggttcggttggtagagttagttaaagtaaaagtacctacgtaggaacggaccggtccccttcggaacggggtacctcccgtggaacggtcgactttccgtcgttcggtactccgagggttacgacggggtaaccgaacggtcacgttaagtcgggtaccacgtcgtagttaggacgtccgaggccgaggacggacggtacgccgtagtaacttagtttacgttaggtactaaactaccgaaacgtaacgtaaccgtaacgtacgtttacgggttaactttaggtttacgtaccggtttaccggaaaaccgtttcgggacccgtaaaccgggttaacggtaacccgttaacccgttacccgggtcgggttaaccgaaccgttacccggaaaccggacccctaaccccgtacgtaccgttacccgtaacccg

SEQ ID NO: 383354 - DNA, 666 bp, Homo sapiens
  misc_feature: GZ8MTXP02J2Z3L.51.71.G05.1.454.CMB.2.raw
  modified_base (181)..(181): a, c, t, g, unknown or other
  modified_base (218)..(218): a, c, t, g, unknown or other
  modified_base (223)..(223): a, c, t, g, unknown or other
  modified_base (243)..(243): a, c, t, g, unknown or other
  modified_base (661)..(661): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctggtntcagtcgtcccaggacagacggcaggatcacctgctntgganatgacattcgaccaaacgtntatgtacttagttcgtaccagcagaacgcccggccgacggtcccctggtttcggtttggtacgtattagtaaattaaaagacctaacgtggaacgaccggtcccgtacgacgggtactacccgtgaaccgtcgtatttccgtcgtggtcctacggtagggtacgaacgggaccgtacggtacaacgttacgttcgggacctagttacgacggtacggtacggtcgacgggacgaacggagggtaacggacggcgttacggtacttagttagttacgttaacaacgttaaccaacgtacggtaaacctaaccgtttagttaacggtttacttacgttctttacgtacggtacctcggaaccgtaccgacggtaccaccgtttacggcgtaccgaccgaccgaaccgtcccaaacccgtntaccg

SEQ ID NO: 383355 - DNA, 570 bp, Homo sapiens
  misc_feature: GZ8MTXP02FTYH6.51.71.G05.1.454.CMB.2.raw
  modified_base (223)..(223): a, c, t, g, unknown or other
  modified_base (279)..(280): a, c, t, g, unknown or other
  modified_base (290)..(290): a, c, t, g, unknown or other
  modified_base (304)..(304): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgccaaacgatatgcttatggtaccagcagagccggcagccctgtgtggnntgtataaagnactgagacgccctnagggtctcctgagcgattctctggctcgaggtcaggggaccacggtcactagttcggaccatcagtggacgtccagggcaggaggacgaggctagacttattatgtacaatcaaacgagaacacctagttacggtaactttagtgttacgttacgggaaactcggtaccggaacctaaacgggtcctaacccggtccgtacggggttacccaacggacccccaaaagggaccccctaaaacccccgacgtcgtacccgttaacccg

SEQ ID NO: 383356 - DNA, 720 bp, Homo sapiens
  misc_feature: GZ8MTXP02FR75H.51.71.G05.1.454.CMB.2.raw
  modified_base (221)..(221): a, c, t, g, unknown or other
  modified_base (482)..(482): a, c, t, g, unknown or other
  modified_base (509)..(509): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccacctggtgtcagtcgtccccaggacagacggccaggatcactgctctgganatgctattcgaccaaaccgatatgtacttagttcggtacagacaggaacggcccgggaccacggtccccgtgtggttcggtagtactggtaataaacgactacgtaggaggtacggaccctcggaaggggtaccttccgaggacgtcgtactttccgtcgcggtccttacggaacggttacgacgggggtaccaaaccgggtacacgtacgttcgggacctagtacgaggtcggacgtccggaaggcgaaggacggaaagngggtaccaggtacttaagtttacgttntaacaaagttacgaaacgacgaacctaccgttagtttaccggtttaaattacgttacggtttaccgttacggggtaaaacgttccggtaaccggtaaacccggtaaaccggttaccggttaaccccgttaccgggtaggttaacccgaaccggggtaaccccaaaccgggttacccccaacccccgtagtaccggttaccgttaacccccg

SEQ ID NO: 383357 - DNA, 580 bp, Homo sapiens
  misc_feature: GZ8MTXP02H4RT4.51.71.G05.1.454.CMB.2.raw
  modified_base (223)..(223): a, c, t, g, unknown or other
  modified_base (241)..(241): a, c, t, g, unknown or other
  modified_base (291)..(291): a, c, t, g, unknown or other
  modified_base (448)..(448): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccacctcggtgtcagtcgtccccaggacagacggccaggactcacctgctctgganatgcattcgaccaaacgntatgtcttatcgacagcaagacgccggcgacggcccctgtcgttggtgtntagtaataaagacacgtgagtcggccctgaggctccgtgacgtcgtactcgtcgtcgctcgacggttacagggacctaacgccatacgtcggaccatccgtagcggtacgtcgacggccgaggacggtacgacggtacgtgacttagttattcgtanaacgtacaagacgaactacgtagttaggtacttattcgtaaccgttcgtaaacgtccgactaacgaacggtacctaccggttccgtacggtcaaccggacccgtaacggacccctaccgactcgtaacctcc

SEQ ID NO: 383358 - DNA, 634 bp, Homo sapiens
  misc_feature: GZ8MTXP02GTVTM.51.71.G05.1.454.CMB.2.raw
  modified_base (245)..(245): a, c, t, g, unknown or other
  modified_base (291)..(291): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgctattgaccaaacgntatgcttatggtacagacagaacgccggccacggccctgtgttggngtatgtaataaagactagtgagacggcctgaggctcccgtgaccgacgtattccgtcgtcggtacctcgtacggggtcaacgggggaaccgtaaaccggttccaacgttacgttacgggaccctaaagttcccgaggttacgggtacggttacccgaagggccgaagggaacggaacgggacggtccgttaaggactttaagttacgttagactaaacgtacaaacacgaccacgttaattcggtaactttatacggttcttacggtaaactcgaccgtaacgaacgttaccacccgttcgtaacggtaccacgacccgtaacgacccaaacccgtcttaccg

SEQ ID NO: 383359 - DNA, 690 bp, Homo sapiens
  misc_feature: GZ8MTXP02IRH7I.51.71.G05.1.454.CMB.2.raw
  modified_base (314)..(314): a, c, t, g, unknown or other
tcagcgatcgtatacacgaccggtgctcgatttagtgtcgtcgcaagagagaggggggctgtgggtccaggaggcagaactctgggtgtctcaccatggcctggatccctctacttctcccccctcctcactctctgcacaggctctgaggcctcctatgagctgacacagcccaccctcggtgtcagtcgtccccaggacagacggccaggatccacctgctcgtggacgatgctattcgaccaaaccgtatatgtcttattacggtacagcgagaacggtcccggacccgacggtccccctggtggtttggngtagtgtaaagaaacgactacgtaggaaggacggtcctcggaggtacctaccgtgacgtcgtacttcgtcgtcggcctaccgtggggtacgacgggaacgtaccgtccaacgtagttacggacctataccgaggtcggacgtaccgaggaccgaggacggtaaccggagtacgttagtactttagttacttagtacaactaccgaaacgtacgtaaccgttaacgttacgtttacgtttaacgtttagttacggttacgttaaccggtaacgtaccgtaaaccgtaaccggtaaccggttacccgtacccggttaccggtaaccggtaaccgaacccggtaccccggaacccgtaacccctaacccgtacttaccg

SEQ ID NO: 383360 - DNA, 607 bp, Homo sapiens
  misc_feature: GZ8MTXP02FNJ98.51.71.G05.1.454.CMB.2.raw
  modified_base (223)..(223): a, c, t, g, unknown or other
  modified_base (294)..(294): a, c, t, g, unknown or other
  modified_base (387)..(387): a, c, t, g, unknown or other
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcacctgctctgganatgcattcgaccaaacgtatatgcttattgtacagcagagccggcacgccctgtgtggtgatgtaataaancacgtgaggacgccctgagggactccgtgacgcgtactttctcgtagtcctcgaggtcgacgggacaacggtcacgtagttcggaccatacgnggttacggacgtaccgagggccgaaaggcggaacggaggtctaggtaactttaattaattgtactaataccgaaaacgacgaaacctaccgtagtttacggttaaccttagttacgttacgttacggaacttcggaccgaaaccgtaacggtacgtacccgttacgcgggtaaccaaccggaacccgtaacggaccccaaccccgactttcgaccttacc

SEQ ID NO: 383361 - DNA, 585 bp, Homo sapiens
  misc_feature: GZ8MTXP02FNOBJ.51.71.G05.1.454.CMB.2.raw
  modified_base (374)..(374): a, c, t, g, unknown or other
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctggagatgcaattgccaaacgatatgcttatggtaccagcagaagccggcaggcccctgtgtggtgatgtaataagacactgagacggccctcaggggtactcccgtgaaggcgaactttcgtctggcttacccaggttccaggggactaaaaccggtnactagttcgactactcgagtacggacgtaccgagacgaagacggtacgacggtcgtagtaacttaattacgttagtactaatacaacacgacgtactagttacgttacttagtacgtacgttacggaacgtcgaccgtaacgtaacggtacctaccgtcgtcggtaccgaaccgtacccgaacggacccaacccgtacgtaccgtactacg

SEQ ID NO: 383362 - DNA, 683 bp, Homo sapiens
  misc_feature: GZ8MTXP02JT438.51.71.G05.1.454.CMB.2.raw
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcactgctctggagatgcattcgacccaaacgatatcgtcttagtgtaccagcgagaacgccggccacggcccctgtcgttggtgtatgtaataaagacacgtgagcgccctacgaggtactaccgtgacgtgtaccttctcgtacggtcctccgaggtccgacggggaacctaccgggtaccaacgtagttcggaccctagtaccgtaggttaggacggtacgaacgggccgaaggaacggggtacgaggggtacctaggtaccttaagtttagttagttacaaacgtacaaacgagaacctaccgtagttagttaaccgttattcggttacttaccggtaaacgttcgaccggaaacccgtaacggttaccgtaaccccgttccggttacggggtaaccaacccgggaaccccgtaaaaccccgggaacccctaaacccccggtactaacccggtttccttaaacccccgg

SEQ ID NO: 383363 - DNA, 617 bp, Homo sapiens
  misc_feature: GZ8MTXP02GK84C.51.71.G05.1.454.CMB.2.raw
  modified_base (106)..(106): a, c, t, g, unknown or other
  modified_base (147)..(147): a, c, t, g, unknown or other
  modified_base (219)..(219): a, c, t, g, unknown or other
  modified_base (228)..(228): a, c, t, g, unknown or other
  modified_base (242)..(242): a, c, t, g, unknown or other
  modified_base (281)..(281): a, c, t, g, unknown or other
  modified_base (303)..(303): a, c, t, g, unknown or other
  modified_base (384)..(384): a, c, t, g, unknown or other
  modified_base (518)..(518): a, c, t, g, unknown or other
  modified_base (555)..(555): a, c, t, g, unknown or other
  modified_base (571)..(571): a, c, t, g, unknown or other
  modified_base (579)..(579): a, c, t, g, unknown or other
tcagcgatcgtatacacgaccggtgctcgatttagtgtcgtcgcaagagagaggggcacgaccggtgctcgatttagtgtcgtcgcaagagaggagggggggggancctagctgtgctgtaagggtccaggagcagaactctgggtntctcaccatggcctggactccctctacttcctccccctctcactctctgcacaggctctgagcctctatganctagacacncgcccaccgtggtntcagtcgacccaggacagacgccaggatccactgctcgnggacatgctatcgaccaaacgntatgtactttagtcgtaccagacagaaccgccgggacccacgggccccttggtcggtttaggtagtacgttacggtaaaanaaacggtaccgtacgtaggaaacggtaccgtcccccgttaagaccggggtaaccttccccggtaaggtaccgtacgttaacttcccgttcgtacggtccctaccggagggtaccgacggtaaacgtaccggtanactaggttcactagtcgagtcgacttacagtcgacgngaaggcgtaacgcgtntaacgttnttactgtaactaaatccgaactacaaccgtactttacg

SEQ ID NO: 383364 - DNA, 661 bp, Homo sapiens
  misc_feature: GZ8MTXP02JL0RD.51.71.G05.1.454.CMB.2.raw
  modified_base (235)..(235): a, c, t, g, unknown or other
  modified_base (279)..(279): a, c, t, g, unknown or other
tcagcgatcgtatacacgaccggtgctcgatttagtgtcgtcgcaagagagaggggcacgaccggtgctcgatttagtgtcgtcgcaagagagaggggggggagcctagctgtgctgtgggtccaggaggcagaactctgggtgtctcaccatggcctggatccctctacttctccccctctcactctctgcacaggctctgagcctctatgagctgacacacgcccacctggtntcagtcgtcccagacacgacgcaggactcacctgctacgtgganatgctattacggaccaaaccgatatcgtactttaagttcggtaccagacgaaggaacggcccgggccccgtaaccgggtcccccttggttacggttggtagtacgttgggtaaactaaaacggacgtacgttagggaacgaccggcccgttacgacggggtaacctcccggtgaacgtcgttaactttccgtcgtccggtccgtaccggtacggttaaccggacgggtaaaccgtaacggttacgaaccgttaggttaccggacctaaagttccgtaggacgttacgactagtaggaccgaggacgtacgggtataccggtataaacgtttattacgtaacgtaactaacgtaaccgaacgtaccgtaacgttaacgttacg

SEQ ID NO: 383365 - DNA, 788 bp, Homo sapiens
  misc_feature: GZ8MTXP02JW25U.51.71.G05.1.454.CMB.2.raw
  modified_base (233)..(233): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgacggcctcctatgagctgacacacgcccacccgtcggtgtcagtcgtccccaggacaggaccggccaggactccacctgctcgtgganatgctattcgaaccaaacgatagtgtacttagttacggtaccagacgaaggaacggcccgggaccaccggtcccctggttgttaggtagtacgtagtaaataaacgacgtaactaggacggtaccggtccctacggaagggtaccctccgtaggaacggtcgtacctttcccgtcgtccggacccgttaccggagggttaccggacggggtaaccctaaacgggtaccacgttacggttccggaacccttaaggtacgtaacgggttacggaacccgtcggaaacggcgaaacggggaacgggtacgggaagggtccttaaggtaacttttaaggtttagttaacgtaacgaaacttaacgaaaccgtaaacgtaccgtaaaccgtttaggtttacgggtttaaactttagggttaccgtttaaccgtaacggtaacgtacccggtaaacgtaacccggtaaaccgggtccgttacccggtaccgggtttacgaccgtaacccgaacccggaaccgaacccccgtacccgttacgtaccgtaccgtttaaccccg

SEQ ID NO: 383366 - DNA, 646 bp, Homo sapiens
  misc_feature: GZ8MTXP02FL27C.51.71.G05.1.454.CMB.2.raw
  modified_base (228)..(228): a, c, t, g, unknown or other
  modified_base (250)..(250): a, c, t, g, unknown or other
  modified_base (307)..(307): a, c, t, g, unknown or other
  modified_base (488)..(488): a, c, t, g, unknown or other
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggtctctgaggcctcctatgagctgacacagccaccctcggtgtcagtcgtccccaggacagacggccaggatcactgactcgtggagtntagctagttcgaccaaaccgtntagtgtctttagtcgtaaccagcgaaggacgcccggacacggcccttgtgtttcggnagttagtaactaaagactacgtaggacgtacggtcccgagacgggtacctccggtgaacgtcggtaacctttcgacgtaggcctaacggacggttcgagggtacgtaaacggtctaaacgtgtacggacctaacgtagacgggttacgcgtacggaggtcccgaaggacggtacgacggtntaccgagtttacgttagtcgtaactaaacgtcaaacgacgtaacacgttattacgttactaagtcgtacgtacgtactcgaccggtaactacggacctaccggtcggtacgaaccgtccgaaccgtacccgacccaaccgtcgtactaccgttacccg

SEQ ID NO: 383367 - DNA, 578 bp, Homo sapiens
  misc_feature: GZ8MTXP01B3IN2.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtcagtgtgaggtgcagctggtggagtcgtgggggaggcttggtccagccgtggggggtccctgagactctcctgtgcagcctctggattcacctttagtagctattggatgagctgggtccgccaggctccgagggggaagggggctgggaggtggggtggaccaaacgaagtaaaaggccaaaggagtgggaaagtggaaagacaagtactaatggtaggactcgtgtaggaaagggcccgaattccaaccatcctaccaagacgacaaaccgccaaagagtctacgaacttggtaatcctagaccaaaagtagaacacgccagagaggaacggaggacgacggcgtgtgttagttacgttgtgcgaagacgacgttcccgtcccggttaacgtaag

SEQ ID NO: 383368 - DNA, 524 bp, Homo sapiens
  misc_feature: GZ8MTXP01EPMPQ.21.40.D07.1.454.CMB.2.raw
  modified_base (333)..(333): a, c, t, g, unknown or other
  modified_base (338)..(338): a, c, t, g, unknown or other
  modified_base (407)..(407): a, c, t, g, unknown or other
  modified_base (419)..(419): a, c, t, g, unknown or other
  modified_base (444)..(444): a, c, t, g, unknown or other
  modified_base (454)..(454): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctgggtccgccaggctccgagggagggctgggagtgggngcaanataaagccaagatggaagtgaaagacaatactatgtggactctgtgaagggccattcaccatctcaganacaacgcaaagngctcactgtatctgcaaatgaaacngtcctagagngtcgaggacgacggctggtagttacttcgttggtgcgaaggtacgtaccttccccgtaacggttaataag

SEQ ID NO: 383369 - DNA, 532 bp, Homo sapiens
  misc_feature: GZ8MTXP01BKZCE.21.40.D07.1.454.CMB.2.raw
  modified_base (301)..(301): a, c, t, g, unknown or other
  modified_base (428)..(428): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctatttagaggtgtccagtgtgaggtgcagctggtggagtcgtgggggaggcttggtccagccgtggggggtccctgagactctcctgtgcagcctctggattcacctttagtagctattggatgagctgggtccnccaggctccgaggggaggggctgggagtggggtggccaacataaagccaagatggaagtgaagacaatactatgtggactcgtgtgaaggggccattccaccatctaccagacgacaacgccaaagngctcactgtatctgacaaatgaaacagcctgagagtcgagggacacgggctggtgttattcgttggtggacgaaggacgacttcccccgtaacgggttaatcgg

SEQ ID NO: 383370 - DNA, 523 bp, Homo sapiens
  misc_feature: GZ8MTXP01BLTU2.21.40.D07.1.454.CMB.2.raw
  modified_base (450)..(450): a, c, t, g, unknown or other
  modified_base (459)..(459): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccgagggaggggctgggagtgggtggccaacataaagccaagatggaagtgaaagacaatactatgtggactctgtgaagggccattcaccatctaccagagacaacgccaaagagctcaactgtatctgacaaatgaaacngcctagagngtcgaggacacgggctggtgttattcttggtgcgaagacgacttccccgtcgggttaataacgg

SEQ ID NO: 383371 - DNA, 516 bp, Homo sapiens
  misc_feature: GZ8MTXP01DP470.21.40.D07.1.454.CMB.2.raw
  modified_base (383)..(383): a, c, t, g, unknown or other
  modified_base (448)..(448): a, c, t, g, unknown or other
  modified_base (457)..(457): a, c, t, g, unknown or other
  modified_base (485)..(485): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccgaggggaaggggctgggagtgggtggccaacataaagccaaagatggaagtgaagacaatactatgtggactntgtgaagggccattcaccatctcagagacaacgccaagagctcactgtatctgacaaatgaaacngcctagagnggtcgaggacacgggctggtgttattcngtgcgaagagacttccccgtcggttaatcgg

SEQ ID NO: 383372 - DNA, 675 bp, Homo sapiens
  misc_feature: GZ8MTXP01BXMB7.21.40.D07.1.454.CMB.2.raw
  modified_base (206)..(206): a, c, t, g, unknown or other
  modified_base (255)..(255): a, c, t, g, unknown or other
  modified_base (264)..(264): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggtttcgtgtaggctatttagaaggtgtccagtgtgaggtgcagctggtggagtntggggaggcttggtccagccgtgggggtcccgtgagactctcctgtgcncgctctgtntctacttagtagtctagtgtagtgagtcgtcggtccgccgacggcgtaccggaggggacggggtcggtagggtaggtgggtcggaccgaaacgaaagtaaacgaaccgaaggagtaggtaagtagaaagaacgtaatacgtagtagtaggtacgtacgtaggtaggtaacgggtaccgtacgttactacctactaccgtaccgaacgaacgaaccgaaccgaccgaacgaacgtaccgtaccgtacgttacgttacgttacgtacgtaacgtaaacgtaacgtaaacgacgtaccgtacgtacggtaaggtaacggaacggacggtacggttcgttacgttagttacgtttacgttacggtaaggtacggtaacgtacgtaccgttaccccgttaaccggttaacgtaacg

SEQ ID NO: 383373 - DNA, 591 bp, Homo sapiens
  misc_feature: GZ8MTXP01BGRGF.21.40.D07.1.454.CMB.2.raw
  modified_base (259)..(259): a, c, t, g, unknown or other
  modified_base (368)..(368): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggtttcgtgtagctatttagaaggtgtcagtgtgaggtgcagctggtggagtcgtgggggagcttggtccagccgtggggggtccctgagctctcctgtgcagccctntggattcacctttagagctattgggattgagcgtgggtccgccaggcctccgagggggaagggcgtgggaggtgggtggcgacataagacaagagtaggagtgaagaanaatatagtgtgtacgtgtgtagacggacgtactacacactactacgacgacgaacgaaccgacgaacgacgactacgtacgtacgtactacgtacgtactaacgtaacgaacgacgtacgtacggacggaggtaacggaacggacggtacggttcgtagtagttacgttacgttaggtaagtacgaacgtacgtaccgttacccgttaaccggttaacgtaag

SEQ ID NO: 383374 - DNA, 428 bp, Homo sapiens
  misc_feature: GZ8MTXP01DUFNZ.21.40.D07.1.454.CMB.2.raw
  modified_base (254)..(254): a, c, t, g, unknown or other
  modified_base (271)..(271): a, c, t, g, unknown or other
  modified_base (419)..(428): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtcccctgaccgattctctggctccaattctggcacctcagcctccctggccatcagtgggctccggtcgaggntgaggctgattattacngtgcagcatgtgatgacggcctgagtggtccggtgttcggcggagggaccaggctgaccgtctaggtccagccaaggctcgccccctggtcactctcgtccccaccctctcgagcgacgactgagcgggctgggcaaggcgcagtagnnnnnnnnnn

SEQ ID NO: 383375 - DNA, 742 bp, Homo sapiens
  misc_feature: GZ8MTXP01DD4GF.21.40.D07.1.454.CMB.2.raw
  modified_base (279)..(279): a, c, t, g, unknown or other
  modified_base (305)..(305): a, c, t, g, unknown or other
  modified_base (307)..(307): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggaggtcgtgggggggagtcgttcggtccgacggtccggggtccgggggtcctggacgtccttcctccgtgtcgcncgtcctcgtagtacttctacttagtntnttagtgatgacgtcggtcggtcccgacgacggtccgtacgggaagggggacgggtcggtagggtaggggtcgggggtacgaacccaaagtaaagtaaacgacgaaaggtaagtagggaaagtaggaaagtaactaagttaacgttaggtacggtacggtacgttcggtaggggtacggtaaacgggtcctaaacttcacctataccgaacgaacgaacgaaccgaaacgaccaaagtaccgtccttacgtaaacgttggttaactaccgtaaagaacctaaaagtcggaaaaccgtcggaccggtaagggaacggaggggtaaccggaacgggttacgtacggggttcgttaggtttacgttaacgtttcgggacggaacggtacgtaacgggttaccccctaccggttacccccgttaaggggttaactccggg

SEQ ID NO: 383376 - DNA, 423 bp, Homo sapiens
  misc_feature: GZ8MTXP01A0FAH.21.40.D07.1.454.CMB.2.raw
  modified_base (270)..(270): a, c, t, g, unknown or other
  modified_base (418)..(423): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtggctccggtccgaggatgaggctgattattacngtgcagcatgtgatgacggcctgagtggtccgtgttcggcggagggaccaggctgaccgtctaggtccagccaaggctgccccctggtcactctcgttccccaccctcctccgagcgacgactgagcgggctgggcaaggcgcatagnnnnnn

SEQ ID NO: 383377 - DNA, 530 bp, Homo sapiens
  misc_feature: GZ8MTXP01BM12I.21.40.D07.1.454.CMB.2.raw
  modified_base (489)..(489): a, c, t, g, unknown or other
tcagtcgtcgctcgcacgaccggtgctcgatttagtgatagagcgtaacaacagaggggagagaggagccttagccctggactccaaggcctttccacttggtgatcaacactgagcacagaggactcaccatggaattagggctgagctgggttttccttgttgctattttagaaggtgtccagtgtgaggtgcagctggtggagtcgtgggggaggcttggtccagccgtggggggtccctgagactctcctgtgcagcctctggattcaccttagtagctattggatgagctgggtccgccaggctccgagggaaggggctgggagtggggtggccaaacataaagcaaagatggaagtgagaacataactatgtggactctgtgaagggccgattcacatctcagagacaacgccaaagagctacacgtgtatctagacaaatgaacagcctgagaggtcgaaggacacggcttgtgtattacgnggttgcgagaacgtacctcccgttaccggtaattaacgtcg

SEQ ID NO: 383378 - DNA, 549 bp, Homo sapiens
  misc_feature: GZ8MTXP01CF4R0.21.40.D07.1.454.CMB.2.raw
  modified_base (460)..(460): a, c, t, g, unknown or other
  modified_base (506)..(506): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctgggtccgcaggctccgaggggaggggctgggagtgggtggaccaacataaagccaagatggaagtgaagacaatactagtggtggactcgtgtagaacgggcccaattccaccatctaccagagacaacgccaaagcgctcactgtatctagacaaatgaaacngtccctagagagtcggaagggaccacgggcttggtgttaacttacngggtgacggaagacgaccttcccccgtaacgggttaataacgg

SEQ ID NO: 383379 - DNA, 585 bp, Homo sapiens
  misc_feature: GZ8MTXP01EMECV.21.40.D07.1.454.CMB.2.raw
  modified_base (479)..(479): a, c, t, g, unknown or other
  modified_base (491)..(491): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagcgtgggtccgccaggctccgaggggaggggctgggagtgggtgaccaacataaagccaagataggaagtgaaagacaatactagtgtggactcgtggtagaaggggccctattcgacctatcctaccgaagacaccaacgccaaagacgcctacactggtaactcgtagacaaaagtggaaaccngtcctagaacgnggtaacggaagacgacggttcgttagtacgttacgttcgttggtaacggacgtaacggaccgtacccgttaccccggttaaggttaacgtaacg

SEQ ID NO: 383380 - DNA, 433 bp, Homo sapiens
  misc_feature: GZ8MTXP01C368O.21.40.D07.1.454.CMB.2.raw
  modified_base (421)..(423): a, c, t, g, unknown or other
  modified_base (425)..(433): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtcccctgaccgattctctggctccaattctggcacctcagcctccctggccatcagtgggctccggtcgaggatgaggctgattattactgtgcagcatgtgatgacgctgagtggtcggtgtcggcggagggaccaggctgaccgtctaggtcccaggccaaggcctcgccccctggtcactctcgttccccaccctctccgagccgacgactgacgcgggctgggcaaggcgcatagnnngnnnnnnnnn

SEQ ID NO: 383381 - DNA, 583 bp, Homo sapiens
  misc_feature: GZ8MTXP01A6DLE.21.40.D07.1.454.CMB.2.raw
  modified_base (260)..(260): a, c, t, g, unknown or other
  modified_base (340)..(340): a, c, t, g, unknown or other
  modified_base (477)..(477): a, c, t, g, unknown or other
  modified_base (489)..(489): a, c, t, g, unknown or other
  modified_base (514)..(514): a, c, t, g, unknown or other
  modified_base (534)..(534): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctggtttccttgttgctatttagaggtgtccagtgtgaggtgcagctggtggagtcgtgggggaggcttgggtccagccgtggggggtccctgagactctctgtgcagcctntggattcacctttagtagctattggatgagcgtgggtccgcaggctccgagggggaggggctgggagtgggtgaccaaanagtaaagccaaaggatgggaagtgaaagacaatactatgtggactcgtgtaggaaggggccctaagttccaaccattcctaccgaaggaacgaccaaacgccaaagcgctacgactgtatctagacaaagtgaaacngtacctagaggngtaaccggaaggaccaccggggttnttaggttagttacgttcggnggtaacggacggtaagacggtacccttacccccgttaagggttaatcgg

SEQ ID NO: 383382 - DNA, 423 bp, Homo sapiens
  misc_feature: GZ8MTXP01ETK1D.21.40.D07.1.454.CMB.2.raw
  modified_base (270)..(270): a, c, t, g, unknown or other
  modified_base (416)..(416): a, c, t, g, unknown or other
  modified_base (418)..(423): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggccccaaactcctcatctataggaataatcagcggccctcaggggtccctgaccgattctctggctccaattctggcacctcagcctccctggccatcagtgggctccggtccgaggatgaggctgattattacngtgcagcatgtgatgacggcctgagtggtccggtgttcgggcggagggaccaggctgaccgtcctaggtccagccaaggctgccccctggtcactctcgttccccgccctcctcgagcgacgactgagcgggctggcaaggcgcanannnnnn

SEQ ID NO: 383383 - DNA, 529 bp, Homo sapiens
  misc_feature: GZ8MTXP01B1MOI.21.40.D07.1.454.CMB.2.raw
  modified_base (301)..(301): a, c, t, g, unknown or other
  modified_base (366)..(366): a, c, t, g, unknown or other
  modified_base (421)..(421): a, c, t, g, unknown or other
  modified_base (448)..(448): a, c, t, g, unknown or other
  modified_base (457)..(457): a, c, t, g, unknown or other
  modified_base (479)..(479): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccnccaggctccgagggaggggctgggagtgggtgccaacataaagccaaaggatggaagtgaagacntactatgtggactctgtgaagggccgattcacatctaccagagacaacgccaagngctcgactgtatctagcaaatgaaacngcctgaagngtcgaaggacacgggcttggtnttagttcttggtaaggcgaagacgtacttcccccgtcgggttaataacgg

SEQ ID NO: 383384 - DNA, 435 bp, Homo sapiens
  misc_feature: GZ8MTXP01CZ7HQ.21.40.D07.1.454.CMB.2.raw
  modified_base (267)..(267): a, c, t, g, unknown or other
  modified_base (278)..(278): a, c, t, g, unknown or other
  modified_base (303)..(303): a, c, t, g, unknown or other
  modified_base (415)..(415): a, c, t, g, unknown or other
  modified_base (418)..(420): a, c, t, g, unknown or other
  modified_base (422)..(435): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggccccaaactcctcatctataggaataatcagcggcctcaggggtccctgaccgattctctggctccaattctggcacctcagcctcctggccatcagtgggctccggtcgaggatgaggctgattattacngtgcagcatgngatgacgctgagtgtccgtgtcggnggagggcaggctgaccgtctaggtccagccaggcctcgcccccttggtcactctcgttccccaccctcctccgagcgacgacctgacggcggcctggacaagggcgactaanagnnngnnnnnnnnnnnnnn

SEQ ID NO: 383385 - DNA, 438 bp, Homo sapiens
  misc_feature: GZ8MTXP01CAE4S.21.40.D07.1.454.CMB.2.raw
  modified_base (267)..(267): a, c, t, g, unknown or other
  modified_base (290)..(290): a, c, t, g, unknown or other
  modified_base (424)..(426): a, c, t, g, unknown or other
  modified_base (428)..(438): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcactcagcctcctggccatcagtgggctccggtcgaggatgaggctgattatacngtgcagcatgtgatgacggctgngtggtccggtgtcggcggagggccaggctgaccgtcgtaggtcccaggccaaggcctcgccccctggtcactcctcgttcccctccctcctccgagccgacgactgacgcgggcgtcggcaaggcgacagtagnnngnnnnnnnnnnn

SEQ ID NO: 383386 - DNA, 525 bp, Homo sapiens
  misc_feature: GZ8MTXP01BHN8P.21.40.D07.1.454.CMB.2.raw
  modified_base (342)..(342): a, c, t, g, unknown or other
  modified_base (368)..(368): a, c, t, g, unknown or other
  modified_base (452)..(452): a, c, t, g, unknown or other
  modified_base (463)..(463): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctgggtccgtcaggctccgaggggaggggctgggagtgggtgaccaanataaagccaagatggaagtgaagacntactatgtggactcgtgtagaagggctatcacatctaccagacacaacgccaagacgctacactgtactctgacaaatgaaacngtcctagacgngtcgaggaccaggctgtagttattcttggtgcgtaagacgcttccccgtgggttaataacgg

SEQ ID NO: 383387 - DNA, 536 bp, Homo sapiens
  misc_feature: GZ8MTXP01EXSUR.21.40.D07.1.454.CMB.2.raw
  modified_base (455)..(455): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagcgtgggtccgccaggctccgagggaggggctgggagtgggtggcaacataaagcaagatggaagtgaagacaatactatggtggactcgtgtgaagggccattcacatctaccagacgacaacgccaaagcgctacgactgtactctagacaaatgaaacngtcctagagagtcggaagggacacgggttctgtgttacttcgttggtgacgaagacgaccttccccgtcggttaataacgg

SEQ ID NO: 383388 - DNA, 810 bp, Homo sapiens
  misc_feature: GZ8MTXP01EJ6Y0.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtgggggaggcgttggtccaggccgtggggggtcctcgagactctctcgtgtcacgctctgtagttactaccttacgtagtactagttgtagtgtagcgtcgggttccggcccgacggcgtaccgtacgggggaagggggtacggtcgggtagggtagggggtacggaccgaaaccaaacgtaaaagtaaccgaaagaaagtaaggtaaggtaaggtaaagaacgaacttaaacgtaagtaggttacgggtaacgttaccgttaggttaggggaaacggggtacccggtaactttaccgaaaccgtaaaccgttccttaaccccggaaaggaaacggaaaacccgaaacccgaaccccgtaaaggaaagtcccttacctaaacgttacggttattaccttaggaaaccctaaaaaagtaggaaaaacccgacgtaccccgttaggaaaggttaaaccgggaaccggtaaacggggaacccggtaaacccgggttcgttaggttttaaagggttacgtttaaacctttggggcggggaaacgttaacggggaaaacgttccccgttaccccccggtttaacccggggtttaaagtaaccggg

SEQ ID NO: 383389 - DNA, 779 bp, Homo sapiens
  misc_feature: GZ8MTXP01EMEHF.21.40.D07.1.454.CMB.2.raw
  modified_base (618)..(618): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggagtcgtgggggagtcttggtccagccgtgggggtccctgagactctctgtgcagcctcgtggattcacctttagagtctagttggatggagtcgtcggggtcccgccgagggcctaccggaagggggtaagggggtccgtaggggtaagggttgggggtacggaacccaaaacgaaagtaaaaacgaccccgaaaaggtagtaggggaaaacggtggaaaaacgaaacctaagttaacctaaggttggttacgggtaacccgttgtagggttagggaaaacggggtccctaaagtttccccaacctaacttccctaacccgaaggaaacgaacccaaaccggtacccaaaaggacgtccccttaacgaactttggtaaacttcccgagaaacctaaaaagttcgaaaaacncggtacccttaaggaacggtaacggttaaccgggaaacggttacccgaaccgggggttacgttaaggtttaacggtttaacgttacgggttagggtaaccgggaacgtaacggtaacccgttaccccgtttaccccccgggttaacgggttaacgtaacgg

SEQ ID NO: 383390 - DNA, 430 bp, Homo sapiens
  misc_feature: GZ8MTXP01BDKBV.21.40.D07.1.454.CMB.2.raw
  modified_base (271)..(271): a, c, t, g, unknown or other
  modified_base (419)..(421): a, c, t, g, unknown or other
  modified_base (423)..(430): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtgggctccggtccgaggatgaggctgattattacngtgcagcatgtgatgacggctgagtggtccggtgttcggcggagggaccaggctgaccgtccgtaggtccagccaaggctcgccccctggtcactctcgtccccgccctctccgacgcgacgactgagcgggctggcaggcgcatagnnngnnnnnnnn

SEQ ID NO: 383391 - DNA, 581 bp, Homo sapiens
  misc_feature: GZ8MTXP01ADXJ0.21.40.D07.1.454.CMB.2.raw
  modified_base (297)..(297): a, c, t, g, unknown or other
  modified_base (331)..(331): a, c, t, g, unknown or other
  modified_base (418)..(418): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggtttctgtagctatttagaaggtgtccagtgtgaggtgcagctggtggagtctgggggaggcttggtccagcctggggggtccctgagactctcctgtgcagcctctggattcacctttagtagctattggatgagctgggtccncaggctcgaggggagggctgggagtgggtgcaanataaagccaaagatggaagtgaagacaatactatgtggactctggtgaaggggccattcacatcaccagagacaacgccaaggtacnctcgactgtactcgtagaactaaagtcgaaacacgtccgtagggaacgacggtaacggaaacgggaccgacgggttcgttagggttacgttaacgtttcggttgggtaacggaccggtaaggtaccggtacccgttcccccggttaacgggttaacgtaacgg

SEQ ID NO: 383392 - DNA, 672 bp, Homo sapiens
  misc_feature: GZ8MTXP01EG9XL.21.40.D07.1.454.CMB.2.raw
  modified_base (467)..(467): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcttgttgctattttagaggtgtccagtgtgaggtgcagctggtggagtcgtgggggagcttggtccagccgtgggggtccctgagactctcctgtgcagcctctggattcacttagagctattggatgagcgtgggtccgccaggcctccgaagggggaacgggggctgggaggtggggtagaccaaacaataaagccaaagagtaggaagtgaaagacaagtactagtggtaggtactcgtagtaggaaacggggcctaattccaacctaattccaccgaagaacgaaccaaacggacccaaaggtacnccttacgaaacttggtaaactccgtagaaccaaaaagttcggaaaaaaccctcggtaccgtagggaaacggtaagggtaacggaaacgggttaaccgtaacgggttcgttaagggttacgtttaaacgtttcggttagggtaacggaacggtaacggtaaccggttaccccgttaccccccggttaacgggttaaagtaaccggg

SEQ ID NO: 383393 - DNA, 819 bp, Homo sapiens
  misc_feature: GZ8MTXP01BTAG0.21.40.D07.1.454.CMB.2.raw
  modified_base (262)..(262): a, c, t, g, unknown or other
tcagtcgtcgctcgcacgaccggtgctcgatttagtgatagagcgtaacaacagaggggagagaggagccttagccctggactccaaggccctttccacttggtgatcagcactgagcacagaggactcaccatggaattggggctgagcgtggtttcgtgtaggctatttagaaggtgtcagtgtgaggtgcagcgtggtggagtcgtgggggagcttggtccagccgtggggggtccctgagactctcctgtgcagcctntgattcacttagagctagttggatgagtcgtcggggtcccgaccgagggcctaccggaaggggggaagggggtcgtagggggaagggtttggggggtacgggaaccccaaaacgaaagtaaaaacggaccgtaaaagggaagttagggggtaaaaggtacggaaaaaggaacctaagttaaaccttaaaggtgggttacggggaaccctttcggtaggggttaaggggaaaccgggggtcccctaaagtttcccgaaaccccgttaattccctaaaccccgaaggggtaaaccgaaaccccaaaaccgggaccccaaaagggttacccgtcccttaacggtaacgtttacggttaacttaccgtaacggaaacgtaaaacgtaaacggtaaaccgaaccgtaccggtaacggtaacgggtaacgggtaacgggtaaacgggaaccggtaaccgggttaccggttacggtttacggtttaacgtttacggttacggtaacggtacgggtaacggtaaccggtacccgttaccccggttaacccggttaacggtaacgg

SEQ ID NO: 383394 - DNA, 529 bp, Homo sapiens
  misc_feature: GZ8MTXP01AGG6Y.21.40.D07.1.454.CMB.2.raw
  modified_base (332)..(332): a, c, t, g, unknown or other
  modified_base (338)..(338): a, c, t, g, unknown or other
  modified_base (351)..(351): a, c, t, g, unknown or other
  modified_base (383)..(383): a, c, t, g, unknown or other
  modified_base (428)..(428): a, c, t, g, unknown or other
  modified_base (439)..(439): a, c, t, g, unknown or other
  modified_base (444)..(444): a, c, t, g, unknown or other
  modified_base (447)..(447): a, c, t, g, unknown or other
  modified_base (498)..(498): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggtttcctgttgctattttagaaggtgtccagtgtgaggtgcagctggtggagtcgtgggggaggcttggtccaggccgtggggggtccctgagactctcctgtgcagcctctggattcacctttagtagctattggatgagctgggtccgccaggctccgaggggagggctggagtgggngccaanataaagccaaagntggaaagtgaaagacaatactatggtggactntgtagaaggggccaattcaccatcaccagagacaacgccaaagcnctacgatgtancaganaanagaacacgtcgtagagagtaacgaggacgacgcgtgtgttagttcttgtgngaagacgacgttacccgtccgttaacgtaag

SEQ ID NO: 383395 - DNA, 590 bp, Homo sapiens
  misc_feature: GZ8MTXP01BO8QU.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtccctgagactctcctgtgcagcctctggattcacctttagtagctattggatgagctgggtccgccaggctccgagggaaggggctgggaggtgggtggccaacataaagccaagatggaagtgaaagacaatactatgtggactcgtgtgaagggcgattcactatctaccgagacgacaacgaccaagagcctcgacttgtatctagaccaaagtcgaaactcgccgtaggaacgaggtaaccggaagggaccgtaaacgggcgttagggttagttaacgtttaccgttgggttaacggtcggaacggacggtaccttacccccccggttaacgggttaaccgtaacggg

SEQ ID NO: 383396 - DNA, 599 bp, Homo sapiens
  misc_feature: GZ8MTXP01AWX9B.21.40.D07.1.454.CMB.2.raw
  modified_base (464)..(464): a, c, t, g, unknown or other
  modified_base (508)..(508): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattcacctttagtagctattggatgagctgggtccgcaggctccgaggggagggggcgtgggaggtgggtggaccaaacgataaagccaaaggagtagggaaagtgaaagacaatactagtggtggactcgtagtaggaacggggtccctaattcaaccgtatcctacccgaagaacgaaccaaacggccaaaggacncctacgaacttggttaactcctaggaacctaaaagtcggaaacngtaccctggaacgaggtcgaaggacacgggcttaggtgttaacttcgttgggtcgacgaagacgtaccttccccgtcgggttaataacggg

SEQ ID NO: 383397 - DNA, 626 bp, Homo sapiens
  misc_feature: GZ8MTXP01BNKAV.21.40.D07.1.454.CMB.2.raw
  modified_base (525)..(525): a, c, t, g, unknown or other
  modified_base (536)..(536): a, c, t, g, unknown or other
  modified_base (578)..(578): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagctgggttttccttgttgctattttagaggtgtccagtgtgaggtgcagctggtggagtcgtgggggagcttggtccagccgtggggggtccctgagactctctgtgcagcctcgtggattcacctttagtagtctattggatggagcgtcgggtcccgccgaggcctaccggaagggggaacgggggcgtagggggaggtgggggtacggaccaaacgaagtaaaacgccaaaggagtagggaagtgaaagaacaatactaagtggtaggactcgtagggtaggaacggggtcctaattccgaacctatcctaccgaaggaacgaaccaaacgaccaaagacgtcctacgacttgtaactctagacaaaatcgaaacngtcctaggagnggtaacggaggaccgacgggttcttggtagttaacgtttcgngggtaacgccggtaagccgtacccttcccccgtaacgggttaatcggg

SEQ ID NO: 383398 - DNA, 440 bp, Homo sapiens
  misc_feature: GZ8MTXP01BO0N6.21.40.D07.1.454.CMB.2.raw
  modified_base (271)..(271): a, c, t, g, unknown or other
  modified_base (415)..(415): a, c, t, g, unknown or other
  modified_base (433)..(435): a, c, t, g, unknown or other
  modified_base (437)..(440): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtcccctgaccgattctctggctccaattctggcacctcagcctccctggccatcagtgggctccggtcgaggatgaggctgattattacngtgcagcatgtgatgacggcctgagtggtccggtgttcgggcggagggccaggctgaccgtcctaggtccacggccaaggctcgcccccctggtccactcctcgttccccacccctcctccgacgcgacgacctgacggcgggntcggcaacggcgcatagnnngnnnn

SEQ ID NO: 383399 - DNA, 548 bp, Homo sapiens
  misc_feature: GZ8MTXP01A14DM.21.40.D07.1.454.CMB.2.raw
  modified_base (449)..(449): a, c, t, g, unknown or other
  modified_base (464)..(464): a, c, t, g, unknown or other
  modified_base (475)..(475): a, c, t, g, unknown or other
  modified_base (492)..(492): a, c, t, g, unknown or other
  modified_base (509)..(509): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagtctattggatggagtcgtgggtccgccgaggctccgagggaggggctgggaggtgggtcgaccaaacagtaaagccaaagagtggaagtgaaagacaatactagtgtggactcgtgtgaacgggccattcactatctaccgagacacaacgcaagacgcacatgtanctagacaaatgaacngtcctagacgngtaacgaaggacacggntggtagttacgttacgnggtcgcgaagacgtaccttccccgtcgttaagtaaccgg

SEQ ID NO: 383400 - DNA, 426 bp, Homo sapiens
  misc_feature: GZ8MTXP01CAGIF.21.40.D07.1.454.CMB.2.raw
  modified_base (266)..(266): a, c, t, g, unknown or other
  modified_base (288)..(288): a, c, t, g, unknown or other
  modified_base (417)..(417): a, c, t, g, unknown or other
  modified_base (420)..(426): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggccccaaactcctcatctataggaataatcagcggccctcaggggtccctgaccgattctctggctccaattctggcacctcagcctcctggccatcagtgggctccggtcaggatgaggctgattatacngtgcagcatgtgatgacgctgngtggtccggtgtcggcggagggaccaggctgacccgtcgtaggtcccagccgaaggcctcgccccctcggtccactctccgttccccgcctccgtcgacgcacgctgacgcgggctggcaaggcgacanagnnnnnnn

SEQ ID NO: 383401 - DNA, 430 bp, Homo sapiens
  misc_feature: GZ8MTXP01EML82.21.40.D07.1.454.CMB.2.raw
  modified_base (269)..(269): a, c, t, g, unknown or other
  modified_base (423)..(430): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggccccaaactcctcatctataggaataatcagcggccctcaggggtccctgaccgattctctggctccaattctggcacctcagcctccctggccatcagtgggctccggtcgaggatgaggctgattattacngtgcagcatgtgatgacggcctgagtggtccggtgttcggcggagggaccaggctgaccgtctaggtccagccaaggctcgccccctggtcactctcgttccccaccctctccgagccgacgactgacgcgggctgggacaagggcgcagtagnnnnnnnn

SEQ ID NO: 383402 - DNA, 560 bp, Homo sapiens
  misc_feature: GZ8MTXP01D23W1.21.40.D07.1.454.CMB.2.raw
  modified_base (347)..(347): a, c, t, g, unknown or other
  modified_base (520)..(520): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctctggattcacctttagtagtctattggatgagctgggtcccgcgaggctccgagggggaagggggctgggaggtgggtgaccaaanataaagcaagagtggaatgaagacaatactatggtggactgtggtagaagggcctattcactatctaccagagacaacgccaaagacgctacactgtaactctagacaaagtcgaaacacgtccgtaggaagtaggcgaagggaccacgggttctagggttgttactttacgnggtgacgtaagacgaccttccccgtaacggttaataacgg

SEQ ID NO: 383403 - DNA, 448 bp, Homo sapiens
  misc_feature: GZ8MTXP01A1I4G.21.40.D07.1.454.CMB.2.raw
  modified_base (269)..(269): a, c, t, g, unknown or other
  modified_base (434)..(436): a, c, t, g, unknown or other
  modified_base (438)..(448): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctcctggccatcagtgggctccggtcgaggatgaggctgattattacngtgcagcatgtgatgacggcctgagtggtccggtggttcggcggagggaccgaggctcgaccgtcgtaggtccacgaccgaggcctcgccccctggtcactcttcgtccccaccctcctccgacgccgacgactggacggcgggctgggcgaaggccgcagtagnnngnnnnnnnnnnn

SEQ ID NO: 383404 - DNA, 544 bp, Homo sapiens
  misc_feature: GZ8MTXP01EBY2I.21.40.D07.1.454.CMB.2.raw
  modified_base (336)..(336): a, c, t, g, unknown or other
  modified_base (418)..(418): a, c, t, g, unknown or other
  modified_base (489)..(489): a, c, t, g, unknown or other
  modified_base (509)..(509): a, c, t, g, unknown or other
  modified_base (541)..(541): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaggtgtccagtgtgaggtgcagctggtggagtcgtgggggagcttggtccagccgtggggggtccctgagactctcctgtgcagcctctggattcactttagagctattggatgagctgggtccgcaggctccgaggggagggctgggagtgggtgaccaanataaagccaaggataggaagtgaagacaatactagtggtggactcgtggtagaaggggcctattcacctatcctaccgaganacaacgccaaagtagctacactgtaatctgacaaatgaaacagtcctagacgagtcggaaggacaccgggnttaggtgttaattcgttggngcgaagacggacttcccccgtaacgggttaanaag

SEQ ID NO: 383405 - DNA, 518 bp, Homo sapiens
  misc_feature: GZ8MTXP01AR105.21.40.D07.1.454.CMB.2.raw
  modified_base (302)..(302): a, c, t, g, unknown or other
  modified_base (489)..(489): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtccctgagactctcctgtgcagcctctggattcacctttagtagctattggatgagctgggtccnccaggctccgagggagggctgggagtggggtgcaacataaagcaagatggaagtgaagacaatactatgtggactcgtgtagaagggcgattcaccatcaccagagacaacgccaaagagctcgaacttgtaatctagacaaatgaacagcctagagaggtcgaaggacacggctaggtgttattcngtgcgaagagcttcccctggttaataacg

SEQ ID NO: 383406 - DNA, 425 bp, Homo sapiens
  misc_feature: GZ8MTXP01D8HHK.21.40.D07.1.454.CMB.2.raw
  modified_base (419)..(425): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaaccggcccccaaactcctcatctataggaataatcagcggccctcaggggtccctgaccgattctctggctccaattctggcacctcagcctcctggccatcagtgggctccggtcgaggatgaggctgattatactgtgcagcatgtgatgacggcctgagtggtcggtgtttgggcggagggacaggctgaccgtctaggtccagccaaggctcgccccctcggtcactctcgttccccaccctcctccgagccgacgactgagcgggctggcaaggcgcatagnnnnnnn

SEQ ID NO: 383407 - DNA, 598 bp, Homo sapiens
  misc_feature: GZ8MTXP01B5NYI.21.40.D07.1.454.CMB.2.raw
  modified_base (337)..(337): a, c, t, g, unknown or other
  modified_base (496)..(496): a, c, t, g, unknown or other
  modified_base (557)..(557): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttgggtccagccgtggggggtccctgagactctcctgtgcagcctctggattcacctttagtagctattggatgagcgtgggtccgcaggctccgagggggagggcgtgggagtgggngaccaaacataaagcaagatggaagtgaaagacaatactagtggtggactcgtggtaggaacggggtcctaattccacctatcctaccgaagaacgaaccaaaccgaccaaaaggcgtacctacgaactttggtaactctagacctaaaagtgaaaacncgtcccgtaggaacggtacggtaacggaacggacgacgggttcttaggttgttaatttcgnggtcgacgtaagacgtaccttcccccgttaacggttaatgg

SEQ ID NO: 383408 - DNA, 670 bp, Homo sapiens
  misc_feature: GZ8MTXP01BGANR.21.40.D07.1.454.CMB.2.raw
  modified_base (448)..(448): a, c, t, g, unknown or other
  modified_base (533)..(533): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagctgggttttcctgttgctatttagaaggtgtccagtgtgaggtgcagctggtggagtcgtggggggagcttggtccagccgtggggggtccctgagactctcctgtgcagcctcgtggattcacctttagagctattggatgagtcgtgggtccgccgaggcctaccggaagggggaacgggggcgtggggaggtgggggtacggaccaaacagtaaacgccgaaaggagtagggaagtggaaacgacaatactaagtggtaggtacttcgtagggtaggaacggggcctattcccaactnttccctaccaaggacgaaccgaaacgcccgaaaaggtcgcccttacaacgttgtaactccgtaagaacctaaagtcggaaaaccncgtaccgtaagaacggacggtaacgggaacgggaaccgtcggttcgttaggtttaacgttaacgtttcggttggtaacgggacggtaacggtaacccggttaccccgttacccccggttaacgggttaagtaacggg

SEQ ID NO: 383409 - DNA, 644 bp, Homo sapiens
  misc_feature: GZ8MTXP01ES4A6.21.40.D07.1.454.CMB.2.raw
  modified_base (540)..(540): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtggggggaggctttgggtccaggccggtgggggggtcccctgagactctcctgtgcagcctcgtggtattcacctttagtagtctagttggatggagcgtgggtcccgccgaggcctccggaagggggaagggggtcgtagggggaggttgggggtacggaccaaacgaagtaaaaggccaaaggagtagggaaagtgaaagacaattactagtggtaggtacttcgtggtaggaaacggggtccctaattccaacctatcctaccgaagacgaaccaacgaccaaagacgcctacacttagtaactcgtagacaaaagtcgaaaaccncgtcctaggacgagtaacggaaggaccgacggttgttaggttaagttacgttcgttggtaacgacgaagtacgtacccgttcccccgttaacggttaagtaacg

SEQ ID NO: 383410 - DNA, 756 bp, Homo sapiens
  misc_feature: GZ8MTXP01B5TSS.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggtttctgtgctatttagaggtgtcagtgtgaggtgcagcgtggtggagtcgtgggggaggtcttggtccaggccgtgggggtccctgagctctcctgtgcagcctcgtggattcactttagagtctattggatggagtcgtcggggtcccgccgaggtcctaccggaaggggggaacgggggtcgtagggggtaaggttgggggtacggaaccccaaaagtaaagttaaaacggacccgaaaaggtagttaggggaaaagtgggaaaaaacaactaacgttaaacgttaggttacgggttacggtaaccgttggtacggggtaacgggtaacgggtacccgttaacttacccgaaacccttacgttacccgtaaccgaaacggaaccgaaacccgaaaccggaaccgaaagtacgtaccttaaccgttaacgtttagttaacctacgtaacgaaactaaaagtacgaaaaccgcggtaccgtaggaacggtaacgggtaacgggaacggttaaccgtacgggttcgttaggttacgttaacgttacggttggtaacggacgtaacgtaaccggtccccgttaccccggttaaggttaacgtccg

SEQ ID NO: 383411 - DNA, 435 bp, Homo sapiens
  misc_feature: GZ8MTXP01DCMV8.21.40.D07.1.454.CMB.2.raw
  modified_base (425)..(427): a, c, t, g, unknown or other
  modified_base (429)..(435): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtgggctccggtccgaggatgaggctgattattactgtgcagcatgtgatgacggcctgagtggtccggtgttcggcggagggaccaggctgaccgtctaggtccacgccaaggcctcgccccctggtcactctcgttccccaccctcctcgagccgacgactgacgcgggctagggcaaggcgcatagnnngnnnnnnn

SEQ ID NO: 383412 - DNA, 429 bp, Homo sapiens
  misc_feature: GZ8MTXP01BG1PN.21.40.D07.1.454.CMB.2.raw
  modified_base (269)..(269): a, c, t, g, unknown or other
  modified_base (417)..(419): a, c, t, g, unknown or other
  modified_base (421)..(429): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggccccaaactcctcatctataggaataatcagcggccctcaggggtccctgaccgattctctggctccaattctggcacctcagcctcctggccatcagtgggctccggtccgaggatgaggctgattattacngtgcagcatgtgatgacggcctgagtggtccggtgtcggcggagggaccaggctgaccgtctaggtccagccaaggctcgccccctggtcactctcgttccccacctcctcgagccgacgactgagccgggctggcaaggcgcatagnnngnnnnnnnnn

SEQ ID NO: 383413 - DNA, 520 bp, Homo sapiens
  misc_feature: GZ8MTXP01B9YQV.21.40.D07.1.454.CMB.2.raw
  modified_base (341)..(341): a, c, t, g, unknown or other
  modified_base (402)..(402): a, c, t, g, unknown or other
  modified_base (412)..(412): a, c, t, g, unknown or other
  modified_base (425)..(425): a, c, t, g, unknown or other
  modified_base (450)..(450): a, c, t, g, unknown or other
  modified_base (459)..(459): a, c, t, g, unknown or other
  modified_base (488)..(488): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattcacctttagtagctattggatgagctgggtccgccaggctccgaggggaggggctgggagtgggtggccaanataaagccaagatggaagtgaaagacaatactatgtggactctgtgaagggccattcaccntctaccaganacaacgcaaaganctgactgtatctgacaaatgaaacngcctagagngtcgaaggacacgggctggtgttattacnggtgcgaagagacttccccgtggttaataacg

SEQ ID NO: 383414 - DNA, 617 bp, Homo sapiens
  misc_feature: GZ8MTXP01CAXBO.21.40.D07.1.454.CMB.2.raw
  modified_base (263)..(263): a, c, t, g, unknown or other
  modified_base (510)..(510): a, c, t, g, unknown or other
  modified_base (522)..(522): a, c, t, g, unknown or other
  modified_base (563)..(563): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggaggtcttggtccgaggccgtggggggtccctgagactctcctgtgcngcctctggattcactttagagctattggatggagtcgtgggtcccgccaggctaccggaagggggaagggggcgtggggaggtgggggtcgaccaaacaagtaaaagccaaaggatgggaaagtgaaagacaatactagtgtaggactcgtggtaggaacgggtcctattccaacctattctacccgaaggaacgacaaaccgccaaagtcgctacaacttgtaactcagaactaaaagtgaaaacngtcctaggacgnggtaacggaaggacgacggttcttagggtattaacgttcgngggtcggacggtaacggtacgtaccccttacccccggtaagggttaactaaggg

SEQ ID NO: 383415 - DNA, 548 bp, Homo sapiens
  misc_feature: GZ8MTXP01DB5RJ.21.40.D07.1.454.CMB.2.raw
  modified_base (351)..(351): a, c, t, g, unknown or other
  modified_base (379)..(379): a, c, t, g, unknown or other
  modified_base (474)..(474): a, c, t, g, unknown or other
  modified_base (522)..(522): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtggggggtccctgagactctcctgtgcagcctcgtggattcacctttagagctattggatggagcgtgggtccgccaggcctccggaaggggaagggggctgggaggtggggtgaccaaanataaagcaaaggatggaagtgaaagacntactatggtggactcgtgtgaacgggcattcgacattccacagaacacaacgaccaaaggcgactcaacttgtaactcgtagacaaatggaaacngtcctagagagtcgaaggctaccgggttgttagtagttagttcgttgngagaagactccttcccgtgttaagtg

SEQ ID NO: 383416 - DNA, 623 bp, Homo sapiens
  misc_feature: GZ8MTXP01B3GP1.21.40.D07.1.454.CMB.2.raw
  modified_base (301)..(301): a, c, t, g, unknown or other
  modified_base (337)..(337): a, c, t, g, unknown or other
  modified_base (486)..(486): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggagcttggtccagccgtggggggtccctgagactctctgtgcagcctctggattcacctttagagctattggatgagctgggtccncgaggctccgagggagggctggagtgggtgaccaanataaagcaaagatggaagtgaaagacaatactatggtggactcgtggtaggaacgggccgtattccgaacctatcctacccgaggaacgaccgaaacgcccaaagcgcctacgaacgttgtaactcgtagacctaaagtcggaaaaccngtaccgtaggaacggtacggtaaccgggaacggttaaccgacgggttcgtttacggttagtttaacgtttcggttcgggtaacggacggtaacggtaccgtaccccgttacccccggttaacgggttaacgtaacgg

SEQ ID NO: 383417 - DNA, 577 bp, Homo sapiens
  misc_feature: GZ8MTXP01ERK8V.21.40.D07.1.454.CMB.2.raw
  modified_base (499)..(499): a, c, t, g, unknown or other
  modified_base (510)..(510): a, c, t, g, unknown or other
  modified_base (529)..(529): a, c, t, g, unknown or other
  modified_base (542)..(542): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtggggggtccctgagactctcctgtgcagcctctggattcacctttagtagctattggatggagtcgtggggtcccgccgagggcctaccggaagggggaacgggggcgtggggaggtgggggtcggacccaaagaagtaaaaggccaaaggagtagggaaagtgaaagacaatactagtgtggactcgtgtaggaagggccattccaccatctaccagacgacaacgccaaagagcctacgactgtaactctagacaaagtgaaaccngtcctagacgnggtaacgagacgacggttntgtagttattcgnggcgacgaagacgtaccttcccgtaacgttaatcg

SEQ ID NO: 383418 - DNA, 609 bp, Homo sapiens
  misc_feature: GZ8MTXP01EG5VD.21.40.D07.1.454.CMB.2.raw
  modified_base (304)..(304): a, c, t, g, unknown or other
  modified_base (346)..(346): a, c, t, g, unknown or other
  modified_base (503)..(503): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtggggggagcttggtccaggccgtggggggtccctgagactctcctgtgcagcctctggattcactttagagctattggatgagcgtgggtccnccaggctccgaagggggaggggctgggagtgggtgaccaaanataaagccaaaggataggaagtgaaagacaatactagtggtagtactcgtggtaggaacggggcctattccacctatcctacccgaaggaacgaaccaaacggccctaaaggacgtcctacgaacgttgtaactccgtagaacaaaagtcgaaaacncgtcctaggaagacggtaacggaaggaccgaacgggttgttaggttacgttacgttcgttggaacggacgtaagtaccgtcccgttaccccgtaaggttaagaacg

SEQ ID NO: 383419 - DNA, 579 bp, Homo sapiens
  misc_feature: GZ8MTXP01APBJP.21.40.D07.1.454.CMB.2.raw
  modified_base (302)..(302): a, c, t, g, unknown or other
  modified_base (336)..(336): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcactttagtagctattggatgagctgggtccncaggctccgagggagggctgggagtgggtgcaanataaagccaagatagggaagtgaaagacaatactagtgtggactcgtgtgaagggccgattcacatctaccagagacaacgccaaagacgctacgactgtaactcgtagacaaatacggaaaccacggaccccggaagacggtcggaacggaacgaccgggtcttggttacgtaatttaccgttggttacggaaccggaaggaacgtaacctcccccgttaccggggtaattaacggaaccgg

SEQ ID NO: 383420 - DNA, 640 bp, Homo sapiens
  misc_feature: GZ8MTXP01B4CY8.21.40.D07.1.454.CMB.2.raw
  modified_base (385)..(385): a, c, t, g, unknown or other
  modified_base (528)..(528): a, c, t, g, unknown or other
  modified_base (597)..(597): a, c, t, g, unknown or other
  modified_base (639)..(639): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggagtcgtgggggagtcttggtccaggccgtggggggtccctgacgactctcctgtgcagcctctggattcacctttagagctattggatgagcgtgggtcccgcaggcctccgagggggaggggctgggaggtggggtgaccaaagataaacgcaaaggatagggaagtgaaagaactntaactagtgtaggacttcgtaggtaggaacgggtcctaagttccaacctatcccgtaacccgaaggaacgaacccaaaccggaccaaagggctaccttacaacgttaggttactacgtacggaaaccttaaaagcgtaaaccnggtccctagggaacggtaggtaaccggggaaaggttacccgacgggttctggttacgttagtttacggnggtcggacgtaacgacgtacccgttccccggtaagttaacgng

SEQ ID NO: 383421 - DNA, 557 bp, Homo sapiens
  misc_feature: GZ8MTXP01BY7AH.21.40.D07.1.454.CMB.2.raw
  modified_base (343)..(343): a, c, t, g, unknown or other
  modified_base (405)..(405): a, c, t, g, unknown or other
  modified_base (461)..(461): a, c, t, g, unknown or other
  modified_base (473)..(473): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctgggtcccgccaggctccgaggggaggggctgggagtgggtggccaanataaagccaagagtggaagtgaagacaatactatgtgactcgtgtagacgggcattcaaccntctaccagacgaccaacgccaagacgcctcactgtactctagacaaagtgaaaccngtccgtagacgnggtaacggacggacgcggttcgtggttacttacgttcgttggtaacggcggtaagacgtaccgttcccccgtcgggttaatcgg

SEQ ID NO: 383422 - DNA, 541 bp, Homo sapiens
  misc_feature: GZ8MTXP01DEJ7O.21.40.D07.1.454.CMB.2.raw
  modified_base (336)..(336): a, c, t, g, unknown or other
  modified_base (379)..(379): a, c, t, g, unknown or other
  modified_base (441)..(441): a, c, t, g, unknown or other
  modified_base (457)..(457): a, c, t, g, unknown or other
  modified_base (495)..(495): a, c, t, g, unknown or other
  modified_base (512)..(512): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagctgggttttccttgttgctattttagaagtgtccagtgtgaggtgcagctggtggagtcgtgggggagcttggtccaggccgtggggggtccctgagactctctgtgcagcctctggattcactttagagctatggatgagcgtggtccgcaggctccgaggggagggctgggaggtgggtgaccaaanataaagcaagataggaagtgaagacaatactagtgtaggactntaggtagaacggggctattccactatctaccagacgacaacgacaagtcgctacactgtaanctagacaaatgaaacngtcctaggagaggtaacgaggacacgggttcttgggtnttaattcgttgtcgganaaggcaccttcccccggtggttaagtcgg

SEQ ID NO: 383423 - DNA, 634 bp, Homo sapiens
  misc_feature: GZ8MTXP01A2O79.21.40.D07.1.454.CMB.2.raw
  modified_base (312)..(312): a, c, t, g, unknown or other
  modified_base (356)..(356): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcgttggtccaggccggtggggggtccctgacgtactctcctgtgcagcctctggattcactttagagcttagttggatgacgcgttggggtcccncaggcctaccgagggggaggggctgggaggtggggtcgaccaanataaagccaaagagtgggaaagtgaaagactaatactagtggtcgacttcgtaggtaggaacgggtaccgtattccaacctacgtacctaccgaagaacgaaccaaaccgacccaaagcgactacgactgtaactccgttagaacaaagtagaaaccgagacccgtaggtaacgaggtaaccggagaccggaccggttgttggttagttaacgtttgttacggtaacggacggtaagtaccggtacccgttaccccccgtaagggttaacgtaacggg

SEQ ID NO: 383424 - DNA, 557 bp, Homo sapiens
  misc_feature: GZ8MTXP01DDN10.21.40.D07.1.454.CMB.2.raw
  modified_base (302)..(302): a, c, t, g, unknown or other
  modified_base (337)..(337): a, c, t, g, unknown or other
  modified_base (350)..(350): a, c, t, g, unknown or other
  modified_base (453)..(453): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagagctattggatgagctgggtccncaggctcgagggagggctgggagtgggtgccaaanataaagcaaaganggaagtgaagacaatactatgtggactcgtgtgaagggcgattcaccatctaccagagacaacgaccaaagacgctacaactgtaatctagacaaatgaaacncgtcctagagaggtaacggaaggacgacggttcgttaggtagttaagttcgttaggtaacgacggtaacggacgtaccttccccggttaaccggttaagtaacg

SEQ ID NO: 383425 - DNA, 424 bp, Homo sapiens
  misc_feature: GZ8MTXP01DHFPU.21.40.D07.1.454.CMB.2.raw
  modified_base (269)..(269): a, c, t, g, unknown or other
  modified_base (414)..(414): a, c, t, g, unknown or other
  modified_base (417)..(424): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctcctggccatcagtgggctccggtcgaggatgaggctgattattacngtgcagcatgtgatgacggctgagtggtccggtgttcggcggagggacaggctgaccgtcgtaggtccacgccaaggctcgccccctggtcactctcgttccccgccctctcgacgcgacgctgacgcgggctggcaaggcgcanagnnnnnnnn

SEQ ID NO: 383426 - DNA, 621 bp, Homo sapiens
  misc_feature: GZ8MTXP01ADU6K.21.40.D07.1.454.CMB.2.raw
  modified_base (300)..(300): a, c, t, g, unknown or other
  modified_base (443)..(443): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggtttcctgttgctattttagaaggtgtccagtgtgaggtgcagctggtggagtcgtgggggagcttggtccagccgtgggggtccctgagactctcctgtgcagcctctggattcacctttagagctattggatgagcgtgggtcccncgaggcctccgaggggaagggggctgggaggtggggtgaccaaacgaagtaaagccaaaggagtagggaagtgaaagactaatactagtgtggactgtgtaggacgggcctattcacattcaccagacgacaacgccaaggcnctacgactgtactcgagaactaaagtcgaaacgcgtccgtaaggaacggtacggtaacgggaaacgggttaccgtacgggttacgttagggttaagttaaccgtttacggttgggtaacggacgggtaacggtacccgtaccccggtttaccccgggttaacgggttaagtaaccggg

SEQ ID NO: 383427 - DNA, 529 bp, Homo sapiens
  misc_feature: GZ8MTXP01AQKFJ.21.40.D07.1.454.CMB.2.raw
  modified_base (335)..(335): a, c, t, g, unknown or other
  modified_base (359)..(359): a, c, t, g, unknown or other
  modified_base (418)..(418): a, c, t, g, unknown or other
  modified_base (421)..(421): a, c, t, g, unknown or other
  modified_base (429)..(429): a, c, t, g, unknown or other
  modified_base (447)..(447): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagagctattggatgagctgggtccgcaggctccgagggagggctgggagtggtgcaanataagcaagataggagtgaagacntactagtgtgactcgtgtagaaggggcctattccacatctaccagagacaacgccaagngcncactgtancgtagacaaatcgaaacngtcctgaagcggtcgaagggaccacgggttgtggtagttagttcgttggcgacgaagacgtcccgttacccgtggttaagtg

SEQ ID NO: 383428 - DNA, 589 bp, Homo sapiens
  misc_feature: GZ8MTXP01CD6MW.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggaggcttggtccagccgtggggggtccctgagactctcctgtgcagcctctggattcactttagtagctattggatgagctgggtccgccaggctccgagggggaaggggctgggaggtggggtgaccaaacagtaaagccaaaggatgggaaagtgaaagacaagtactagtggtggactcgtggtaggaacgggcgattcaccatctacagacgacaacgaccaagacgactcgactgtatctagacaaatcgaaacacgtaccaggtttagacggttaacggaaggaccgaacggttcgttagttggttaagttacttgggttaacgccggtaaggacgtaccgttaccccgtaaccggttaacgtaacgg

SEQ ID NO: 383429 - DNA, 604 bp, Homo sapiens
  misc_feature: GZ8MTXP01BING7.21.40.D07.1.454.CMB.2.raw
  modified_base (335)..(335): a, c, t, g, unknown or other
  modified_base (342)..(342): a, c, t, g, unknown or other
  modified_base (382)..(382): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggagcttggtccagccgtgggggtccctgagctctcctgtgcagcctcgtggattcacctttagagctagttggatggagcgtgggtcccgccgaggcctccggaggggagggggctgggnggtgggngaccaaacataaagccaagagtagggaacgtgaagaactntactagtgtggtactcgtgggtagacggggtccaattccacctaatccctaccgagaacgaacgaacgacccaagacgctacgacttgtactcgtagaaccaaatcggaaacctacgtccgtagacggacggtaacggaaggaccgacggttcgttggtagttacgttagttcggtaagacggaacgtacgtacccttcccccggtaaggttaactaacggg

SEQ ID NO: 383430 - DNA, 561 bp, Homo sapiens
  misc_feature: GZ8MTXP01DPFP9.21.40.D07.1.454.CMB.2.raw
  modified_base (342)..(342): a, c, t, g, unknown or other
  modified_base (481)..(481): a, c, t, g, unknown or other
  modified_base (514)..(514): a, c, t, g, unknown or other
  modified_base (524)..(524): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcctgttgctattttagaaggtgtccagtgtgaggtgcagctggtggagtcgtggggggaggcttggtccaggccgtggggggtccctgagactctcctgtgcagcctctggattcacctttagtagctattggatgagctgggtccgcaggctccgagggaggggctgggagtgggtggaccaanataaagccaaaggatggaagtgaagacaagtactagtgtggactcgtgtagaagggtccgattcgacctatcctaccaagacgaacaacgaccaaagacgcctacacgttgtaactcgtagaccaaaagtcggaaaacngtcctagagaggtcgaaggacacgggttgtgtnttaacgttgnggtgacgaagacgtaccgttccccgtcggttaagtcg

SEQ ID NO: 383431 - DNA, 415 bp, Homo sapiens
  misc_feature: GZ8MTXP01C5BAN.21.40.D07.1.454.CMB.2.raw
  modified_base (266)..(266): a, c, t, g, unknown or other
  modified_base (306)..(306): a, c, t, g, unknown or other
  modified_base (407)..(415): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctccaggaacgccccaaactcctcatctataggaataatcagcggccctcaggggtccctgaccgattctctggctccaattctggcactcagcctcctggccatcagtgggctccggtccgaggatgaggctgattattacngtgcagcatgtgatgacggctgagtggtccggtgtcgggnggagggacaggctgaccgtctaggtccagccaggctcgcccctggtcactctcgttcccacctctcgagcgacgactgagcggctggacaggcgacatagnnnnnnnnn

SEQ ID NO: 383432 - DNA, 429 bp, Homo sapiens
  misc_feature: GZ8MTXP01D5ES8.21.40.D07.1.454.CMB.2.raw
  modified_base (420)..(420): a, c, t, g, unknown or other
  modified_base (423)..(429): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcacgcctccctggccatcagtgggctccggtccgaggatgaggctgattattactgtgcagcatgtgatgacgctgagtggtcggtgttcggcggagggacgaggctcgaccgtcctaggtccacgccaagctcgccccctcggtcactcctcgttccccaccctcctcgacgcgcgactgagcggcgtggcgaaggcgacanagnnnnnnn

SEQ ID NO: 383433 - DNA, 627 bp, Homo sapiens
  misc_feature: GZ8MTXP01DMB2O.21.40.D07.1.454.CMB.2.raw
  modified_base (304)..(304): a, c, t, g, unknown or other
  modified_base (340)..(340): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtggggggaggcttggtccagccgtggggggtccctgagactctcctgtgcagcctctggattcacctttagagctattggatgagctgggtccncaggctcgaggggagggctgggagtgggtgaccaanataaagcaagagtaggaagtgaagacaatactagtgtaggactcgtgtaggaagggcctattccactactcctaccgaagacgaaccaaacgacccaaagtcgacctacgtacttaggttaactcgtaacgaacctaaaaagttcggaaaaacccgtcggtaccgtaagggaacgggtaacgggtaaccggaaacgggttaaccgtacgggttcgttaggttacgttaacgttcgttgggtaacgacggtaagaccgtacccgttaccccggtaacggttaagtcgg

SEQ ID NO: 383434 - DNA, 543 bp, Homo sapiens
  misc_feature: GZ8MTXP01C926T.21.40.D07.1.454.CMB.2.raw
  modified_base (338)..(338): a, c, t, g, unknown or other
  modified_base (453)..(453): a, c, t, g, unknown or other
  modified_base (484)..(484): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtccctgagactctcctgtgcagcctctggattcaccttagtagctattggatgagctgggtccgcaggctccgaggggagggctgggagtgggtgaccaanataaagcaagatggaagtgaagacaatactatgtgactcgtgtgaagggcattcacatctacagagacaacgccaagagcctagaacttgtaatcgtagaccaaatcggaaaacngacctaggacgtaggtcgaaggacgaccggnttggtagttaattcgttggtcgacggtaagaggaccttcccccgtaagggaataaccgg

SEQ ID NO: 383435 - DNA, 719 bp, Homo sapiens
  misc_feature: GZ8MTXP01AVJKF.21.40.D07.1.454.CMB.2.raw
  modified_base (355)..(355): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggaggtcgtggggggaggtcttggtccagccgtggggggtccctgagactctcctgtgcagcctctggattcacctttagtagctattggatgagcgtgggtccgccgaggctccggaggggagggggctgggaggtggggtcggaccaaanagtaaagccaagagtaggaagtgaaagacaatactagtgtaggactcgtgtaggaacggggtccgtaattccgaacctattcccgtacccgaaagggaacgaaacccaaaccggacccaaaagggacgtacccgttaccgtaaacgttcgggttaaacttaccgttacggaaacctaaaaagttcggaaaaaccgtcggtaccccgttaagggaaacggtaaacgggttcccggaaacgggggttaacccgtaaaccgggggttctttagggttaagtttaaacgttttaccggttgggtaacggaccgggtaaacggtaacggtaccccgttccccccggttaacggggttaagttaaccggg

SEQ ID NO: 383436 - DNA, 704 bp, Homo sapiens
  misc_feature: GZ8MTXP01DAUH2.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagcgtgggtccgccaggcctccgagggggaaggggcgtgggaggtggggtggaccaaacagtaaagccaaagagtggaagtgaagacaatactatggtaggactcgtggtaggaacgggcccgtaattccgaacctattccctacccgaaggaacgaacccaaaaccgggacccaaaagggacgtaccccttacgtaaaccgtttaggttaaacttcccggttaggaaacccaaaaagttcgggaaaaaccctacgggtacccgttagggaaacggtaacgggttaaccgggaaacggggaccgtaaaccgggggttctttagggttacgtttaaacgttttaccgttgggttaaggaccggtaaaggtacggtaccgtttacccccccggttaacgggttaagtaaccggg

SEQ ID NO: 383437 - DNA, 594 bp, Homo sapiens
  misc_feature: GZ8MTXP01APE5K.21.40.D07.1.454.CMB.2.raw
  modified_base (303)..(303): a, c, t, g, unknown or other
  modified_base (454)..(454): a, c, t, g, unknown or other
  modified_base (490)..(490): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcctgttgctattttagaaggtgtccagtgtgaggtgcagctggtggagtcgtgggggaggcttggtccagcctggggggtccctgagactctcctgtgcagcctctggattcacctttagacgctaagttggatgagctgggtccncaggctccgagggggaggggctagggaggtgggtcggccaaacgataaagccaagatggaagtgaagacaatactatgtggacttcgtagtaggaacgggccgaatttcgaacctatcctacccaaggacgaaccaacgacccaaaggacncttacacgttagtaatccgtagacaaagtggaaacncgtcgtaggacgtaggtaacggaacggacacggttcgttaggtagttacgttcgttcgggtgacggaacgtaccgtaccgttccccgtaagggttaacgtaagg

SEQ ID NO: 383438 - DNA, 567 bp, Homo sapiens
  misc_feature: GZ8MTXP01EXMHZ.21.40.D07.1.454.CMB.2.raw
  modified_base (354)..(354): a, c, t, g, unknown or other
  modified_base (464)..(464): a, c, t, g, unknown or other
  modified_base (472)..(472): a, c, t, g, unknown or other
  modified_base (476)..(476): a, c, t, g, unknown or other
  modified_base (479)..(479): a, c, t, g, unknown or other
  modified_base (481)..(481): a, c, t, g, unknown or other
  modified_base (484)..(484): a, c, t, g, unknown or other
  modified_base (514)..(514): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagcgtggtttctgtgctatttagaggtgtcagtgtgaggtgcagcgtggtggagtcgtgggggagtcttggtccagccgtgggggtccctgagactctcctgtgcagcctcgtggacttcactttagagtctagttggatggagcgtcgggtcccgccgagggcctaccggaagggggagggggctgggaggttgggggcgacccaaanaagtaaagcaaaggagtggaaagtcgaaagactaatacgtagtgtacggactgtaggtacggaacgggcctattccactatccacgaagagaaccaacgccaaaggtccnctacgatntacngananaanagacacgtcgagagagaacgacgacgacgngtgtagttagttgttgtgagaacgacgtaccgttcccgtaacgttaacgtaag

SEQ ID NO: 383439 - DNA, 555 bp, Homo sapiens
  misc_feature: GZ8MTXP01DYGHA.21.40.D07.1.454.CMB.2.raw
  modified_base (265)..(265): a, c, t, g, unknown or other
  modified_base (306)..(306): a, c, t, g, unknown or other
  modified_base (343)..(343): a, c, t, g, unknown or other
  modified_base (465)..(465): a, c, t, g, unknown or other
  modified_base (497)..(497): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtggggggagcttggtccagccgtggggggtccctgagactctcctgtgcagcctntggattcacctttagagtctattggatggagcgtgggtccncaggctcgagggggagggctgggagtgggtgaccaanataaagcaaaggataggaagtgaaagactaagtactagtggtaggactcgtggtagaacgggctatcacatctacagacacaacgcaagacgctacgactgtactctagaacaatgaaaccncgtactaggagacgaaggacggacgacggttntggttattacgttcgttggaacgagaacgtacgtcccgttacccgtaacggttaagtg

SEQ ID NO: 383440 - DNA, 610 bp, Homo sapiens
  misc_feature: GZ8MTXP01DBTE9.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccaggccgtgggggtccctgagactctcctgtgcagcctctggattcacctttagatctattggatgagcgtgggtccgtcgaggctaccggaagggggaggggcgtgggagtggggtgaccaaacagtaaagccaaaggagtaggaagtgaaagaactaagtactatggtaggactcgtgtaggaacggcctattccaacattccacagacgaaccaacgaccaaagacgccttacaacgttgttaactcgtagaacctaaagtcgaaaactcgtacccgttaggaacgtaacgggtaacggaaaggaccgtacgggttcgttaggtcgttaagttcgttggtaacgacgaagtaacgtcccgttccccgtaacggttaagtaacg

SEQ ID NO: 383441 - DNA, 689 bp, Homo sapiens
  misc_feature: GZ8MTXP01D0XC1.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggagcttggtccagccgtggggggtccctgagactctctgtgcagcctctggattcacctttagagtctaagttggatggagcgtcgggtcccgccgagggcctaccggaagggggaagggggtctgggggaggtgggggtgacccaaaagaataaaacggcaaaggataggggaaagttggaaagaactaattaatagttaggtaggaccttgtagggttaggaaacgggggtccctaattaccgacctatcccgtaacaaggaacaaccgaaaccgaccgaaaaggctacctacgtaacttggttaactcctagaaactaaagtacgaaacgcggtacctaggaacgaaggtaaccgggaaagggacccgtaaaccgggttgttaggtttagttaaaaccgtttcggttggttcggtaaccgaagggtaaccgttacccgttccccccgggttaacggttaagttaaccggg

SEQ ID NO: 383442 - DNA, 566 bp, Homo sapiens
  misc_feature: GZ8MTXP01BMYOC.21.40.D07.1.454.CMB.2.raw
  modified_base (335)..(335): a, c, t, g, unknown or other
  modified_base (342)..(342): a, c, t, g, unknown or other
  modified_base (516)..(516): a, c, t, g, unknown or other
  modified_base (538)..(538): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatggagcgtgggtccgcaggctccgaggggagggctgggagtgggngaccaanataaagccaagatagggaatgaaagacaagtactagtggtaggactcgtaggtggaaacggggcctaattccaacctatccctaccgaaggaacgaccgaaacgcccaaagacgccttacgactgtaatcgtagaccaaatcgaaacagtcctagagcgtaaggaggacacggngtgtgttattcgttagtgacgnggacgaccttccccgtgggttaataacg

SEQ ID NO: 383443 - DNA, 561 bp, Homo sapiens
  misc_feature: GZ8MTXP01DXXDC.21.40.D07.1.454.CMB.2.raw
  modified_base (465)..(465): a, c, t, g, unknown or other
  modified_base (498)..(498): a, c, t, g, unknown or other
  modified_base (517)..(517): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggagcttggtccagccgtgggggtccctgagactctcctgtgcagcctctggattcacctttagagtctaattggatgagcgtgggtccgccaggctccgagggggaagggctgggaggtgggtggaccaaagataaagccaagatggaagtgaaagacaatactatggtggactcgtgtagacgggctatcacatcaccagacacaacgccaagacgctacacttgtactacgtagaccaaatcgaaacngccttaggacgtaggccgaaggaccgtacgggnttggtacgttagtttacgnggtaagacgaagcgtaccgttcccccgtaagggttaataacggg

SEQ ID NO: 383444 - DNA, 732 bp, Homo sapiens
  misc_feature: GZ8MTXP01C73NT.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtgggggaggcttggtccagccgtggggggtccctgagactctcctgtgcagcctctggtattcactttagtagcttagttggatggagcgtcgggtccgccgaggccgtaccggaagggggaagggggtcgtagggtaggtgggggtacgaccaaaacgaagtaaaaacggaccaaaaggagtagggaaagtaggaaaacgtaactaataaactagttagggtacggtactcgtggtacgggaaacggggtcctaagttcccaacctaacttcccgtaacccgaaaggaaacggaaacccaaaccggcccaaaaggacgtaccttacaaccgtttaggttaacttacgacgaaacctaaaagtacgaaaccgacgtacccttaggaaacgtaggtaaccgggaaacggacccggtaaccggttcgtttaggttaagtttaaacgtttcggttacgggtaacggtacccggaaggtaacccggtaccccgttaccccccggtttaagggttaacgtaaccggg

SEQ ID NO: 383445 - DNA, 688 bp, Homo sapiens
  misc_feature: GZ8MTXP01DRAOP.21.40.D07.1.454.CMB.2.raw
  modified_base (580)..(580): a, c, t, g, unknown or other
  modified_base (641)..(641): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaggtgtccagtgtgaggtgcagcgtggtggagtcgtggggggagtcgttcgggtccgaggccggttcggggggtccctgacgactctcctgtcgcacgcctcgtggtacttcctactttagtagtcttagttggatggacgtcgtcgggtcccgccaggggcctaccggaagggggacgggggtcgtggggaggttcgggggtacggaacccaaagaaagtaaaacggccgaaaggtaagtaggggaaagtaggaaaacgaactaagttaacgtaagtggtacggtaaccttcgtagggtacgggaacgggtacctacttaccaaccacttcctaacccgaaggaacgaaccaacgaccaaaggacctctacacgttagtactctagaaactaagtacgaaaacncggtcctaggacgacggtaacggaggaaccggtcgttcgtggttaacgttacgtttacggnggtcgacgtaaggtaccgtaccttcccccggttaaggttaaccgtgg

SEQ ID NO: 383446 - DNA, 633 bp, Homo sapiens
  misc_feature: GZ8MTXP01BT0WM.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatggagtcgtggggtcccgccgaggctaccggagggggagggggcgtgggaggtgggggtggaccaaacaataaacgccaaaggagtagggaagtgaagacaatactagtggtggactcgtggtaggaacggggtccgtattccaacctattccctacccgaagacgaacccaaaccggaccaaaggacgcctacaacgttgtaactcgtagaaccaaagttacgaaacacgtacccgtaggaacggtacggtaaccggaaagggaccacgggttcgttaggtgttaacgtttacgttggtggacgtaaggacgtaccttcccccgtaacgggttaataaccgg

SEQ ID NO: 383447 - DNA, 534 bp, Homo sapiens
  misc_feature: GZ8MTXP01DN7XB.21.40.D07.1.454.CMB.2.raw
  modified_base (303)..(303): a, c, t, g, unknown or other
  modified_base (338)..(338): a, c, t, g, unknown or other
  modified_base (364)..(364): a, c, t, g, unknown or other
  modified_base (502)..(502): a, c, t, g, unknown or other
  modified_base (507)..(507): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctgggtccncaggctccgaggggagggctggagtgggtgccaanataaagccaagatggaagtgaagacntactatgtggactcgtgtagaagggccgattcacctatctaccagagacaacgaccaagacgctacgaacttgtaatcctagaccaaatgaaaactgcctagagagtccgaggacacggttgtgtgttacttgttagngacgngagcttcccccgtaagggttaataagg

SEQ ID NO: 383448 - DNA, 577 bp, Homo sapiens
  misc_feature: GZ8MTXP01EY31B.21.40.D07.1.454.CMB.2.raw
  modified_base (365)..(365): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagctgggttttccttgttgctattttagaaggtgtccagtgtgaggtgcagctggtggagtcgtggggaggcgttggtccgagccgtgggggtccgtgagactctcctcgtcgtacgtacgtccgtcgtacggtacgtttaccgttaaccgtttaacgtacgtacgttagttaggtagtacgcgcgtcggtccgccgacgcgtcgacgggagggcgtggnggtgggtcgacaacaagaagacgaagagtagagtagacgacatacgtagtagtcgtacgtcgtagtacggacggaccgtacgtaccacctactaccgtaccgaacgaacgaaccgaaccgaaccgaacgacgttaccgtaccgtaacgttacgttacgttacgtaacgtaacgtaaacgtaacgaaccgaacgtaaccgttaacggtaacgg

SEQ ID NO: 383449 - DNA, 615 bp, Homo sapiens
  misc_feature: GZ8MTXP01C3ERT.21.40.D07.1.454.CMB.2.raw
  modified_base (265)..(265): a, c, t, g, unknown or other
  modified_base (429)..(429): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggaggtcgtgggggaggcgttggtccagccgtgggggtccctgagactctctgtgcagcctntgattcacttagtagctattggatgagtcgtgggtccgccgaggctaccggagggggagggcgtgggaggtggggtacgaccaaacagtaaacgacgaaggagtgggaagtgaagactaagtactagtggtgactcgtggtaggaacgggcctattccaacctnttccgaccgaagaacgaaccaaacgaccaaaggcgaccttcgacttgtacttcgagaacccaaaagtcgaaacgcgtcctaggacgtaggtccgggaaaggttaccgacgggttctttagggtagtttaacgttcggttaggtcggacgtaacggacgtacccgttccccgttaacgggaatcggg

SEQ ID NO: 383450 - DNA, 627 bp, Homo sapiens
  misc_feature: GZ8MTXP01DS6R8.21.40.D07.1.454.CMB.2.raw
  modified_base (258)..(258): a, c, t, g, unknown or other
  modified_base (265)..(265): a, c, t, g, unknown or other
  modified_base (578)..(578): a, c, t, g, unknown or other
  modified_base (593)..(593): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtgggggaggtcttggtccagccgtggggggtccctgagactctctgtncagcctntggacttcacctttagtagtctaattggatggagcgtgggtcccgccgaggcctaccggaagggggaacgggggcgtagggaggtgggggtcgacccaaagataaagccaaggagtaggaagtagaaagactaataacgtagtaggtacgacttcgtagggtaggaaacggggtccctaattccccaactaagtccctaaccgaaaggaacgaaccgaaaccgaccaaaaggcgtcctaacgtaacgttgtaaactccgtagaaacctaaagtcggaaaactgcctaggacgaggtaacgaggacacgggttntgttagttagttcgnggaagacgaagactcccgttcccgtaagaagtcg

SEQ ID NO: 383451 - DNA, 698 bp, Homo sapiens
  misc_feature: GZ8MTXP01B8Z5V.21.40.D07.1.454.CMB.2.raw
  modified_base (650)..(650): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggaggcttggtccagccgtggggggtccctgagactctcctgtgcagcctctggtattcacctttagagtctagttggatggagtcgtcgggtcccgccgaggcctaccggaagggggaacgggggcgtagggggaggtgggggtacggaccccaaaagaagtaaaacggaccgaaaggtagtaggggaaagtaggaaaagtaacctaagttaaccttaagttgggtacggtacctttcggtaggtacgggaaacgggtaacccgtatttacccaacctattccctaaccgaaggaaacgaacccgaaaccgacccgtaaaagcgtcccttacgtaaccgttgtaactcgtacgaaaccaaagtcgaaaactcggtccttaggaacggtaggtaaccggaaggaccggtacggttcttaggtgtttaactttacgnggtcggaacgaacggtacgtcccttcccccgtaagggttaataaccgg

SEQ ID NO: 383452 - DNA, 586 bp, Homo sapiens
  misc_feature: GZ8MTXP01ADK8W.21.40.D07.1.454.CMB.2.raw
  modified_base (356)..(356): a, c, t, g, unknown or other
  modified_base (371)..(371): a, c, t, g, unknown or other
  modified_base (412)..(412): a, c, t, g, unknown or other
  modified_base (442)..(442): a, c, t, g, unknown or other
  modified_base (478)..(478): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggaggcttggtccaggccgtggggggtccctgagactctcctgtgcagcctctggattcacctttagtagctattggatgagcgtgggtccgcaggctccgagggggagggctgggagtgggtcgcaaacataaagcaaagntaggaagtgaagacntactatgtgggactcgtggtgaaacggggcctattcaaccnttcctaccgagacgaaccaaacgccaaagngctacgactgtaatcctagacctaaagtcgaaacgngtcccgtaggaacggaggtccggaagggaccgtaaccgggttgttaggttagttagttcgttggtcgacggtaagaccgtacccgttcccccggttaaggttaagtcg

SEQ ID NO: 383453 - DNA, 684 bp, Homo sapiens
  misc_feature: GZ8MTXP01BP15Q.21.40.D07.1.454.CMB.2.raw
  modified_base (259)..(259): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcngcctctggattcacctttagtagtctattggatgagcgtcgggtccgccaggcctccgaagggggacgggggctggggaggtggggtcggaccaaacgaataaaggaccaaaggatagggaagtgaaacgaactaagtactaagtggttaggtactcgtaggtagggaaacggggtccctaatttcccaactacttccgtaacccgaaaggaacgaaacccaaaccggacccaaaaggcgtacccttacgggtaaccttaggttaaactcccgttaaggaacccaaaagttcgaaaaccctgacccgtagaacgggagtaacgggaaacgggttacaaccggggttcgttaggttagttacgttacggttcggtaacggacggtaacgtacggtaccccttccccggtaacgggttaagtaacgg

SEQ ID NO: 383454 - DNA, 586 bp, Homo sapiens
  misc_feature: GZ8MTXP01D559J.21.40.D07.1.454.CMB.2.raw
  modified_base (346)..(346): a, c, t, g, unknown or other
  modified_base (526)..(526): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcctgttgctatttagaggtgtccagtgtgaggtgcagctggtggagtcgtgggggagcttggtccagccgtggggggtccctgacgactctcctgtgcagcctcgtggattcacctttagagtctattggatgagcgtgggtccgtcagggctccggaagggggaggggctgggagtggggtgaccaanaataaagcaaaggatagggaatggaaagactaatactagttggtacggacttcgtgggtagggaacggggccctaattccaacctatcctaccgagaacacaacgtccaaagcgctacatgtaatcctaagacctaaagtgaaacgcgccgtagacgaggtaacggaggacgacgggttntagttagttacgttgttcggtaagacgaagtacgtaccgttccccgtaaggttcgtaacg

SEQ ID NO: 383455 - DNA, 703 bp, Homo sapiens
  misc_feature: GZ8MTXP01BZB91.21.40.D07.1.454.CMB.2.raw
  modified_base (536)..(536): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtgggggaggcttggtccagccgtggggggtccctgagactctcctgtgcagcctcgtggattcacctttagtagtctattggatggagcgtcggggtcccgccgaggcctccggagggggaacgggggcgtgggaggtgggggtcggaccaaacgaataaagaccaaaggagtagggaagtgaaagacaatactagtggtaggactcgtggtaggaacggggccctaattccacctatcctaccgaaggacgaacccaacgccgaaaggacgtaccctacaacttggttaacttccgtacggaaacctaaaagttcggaaaacccncggtaccccgttaagggaacggtaacgggtccggggaaacgggttacccgtaaccggggttcgttaggggtttaagtttaacgtttaaccggttggggttcgggaaccgggtaacggtaacggttaccccggttacccccccggttaacggggttaaagtaaccggg

SEQ ID NO: 383456 - DNA, 623 bp, Homo sapiens
  misc_feature: GZ8MTXP01CWWCP.21.40.D07.1.454.CMB.2.raw
  modified_base (521)..(521): a, c, t, g, unknown or other
  modified_base (575)..(575): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggaggcgttggtccagccgtggggggtccctgagactctctgtgcagcctctggtattcacctttagagtctagttggatgagcgtgggtccgccgaggcctaccgaagggggaagggggctgggaggtgggggtacggaccaaagagtaaaagccaaaggatgggaaagtgaaagacaatactagtggtaggactcgtggtaggaacgggtcctaattccaacctatccctaccgaagaacgaaccgaacgaccaaagacgtcctacgtacgtagttaactcgtagaaccaaaagtcgaaaaccngtcctaggaaggacggtcggaaaggactacgggcttaggtgtttaaactttcgnggtaacggacgtaaggacgtaccgttcccccgtaagggttaataacgg

SEQ ID NO: 383457 - DNA, 696 bp, Homo sapiens
  misc_feature: GZ8MTXP01BPU4F.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggaggcttggtccaggccgtggggggtccctgagactctcctgtgcagcctctggtattcacctttagtagctattggatggagcgtgggtccgccaggcctccgagggggagggggcgtgggaggtggggtcggaccaaagaataaagccaaaggagtaggaagtgaaagaactaatactaagtggtacggacttcggtagtagggaaacgggggtcctaattcccgaacctaagtccctacccgaaggaaccgaaccgaaacccggaccaaaggacgtaccttacaaccgtttggtaacttaccgttagaaaccctaaaagtcggaaaaccgacggtcccgttaagggaaacggtacgggttaacgggaaacgggttacccggtacggggttacttgggtaaggtttaacgttcgttagggtggaccggtaaggaacccggtacccgttacccccccggttaagggttaacgttaacggg

SEQ ID NO: 383458 - DNA, 655 bp, Homo sapiens
  misc_feature: GZ8MTXP01CAX6P.21.40.D07.1.454.CMB.2.raw
  modified_base (570)..(570): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgcagcgtggtggagtcgtgggggaggtcgttggtccgaggtccggtgggggggtccctggacgtacctctcctgtcgcacgtcctcgtggtacttcacctttagtagtcttagttggatgacgtcgtcgggtcccgccgaggccgtaccggaggggaggggcgtgggaggtgggtcgaccaaacgaagtaaagaccgaaggagtaggaagtgaaagactaatactagtgtgactcgtgtaggacgggtcctattccgaacctattcccgaccgaaggacgaaccaacggaccaaagcgcccttacacgttgtaactcgtaggaactaaaagtcggaaacctgtccgttaggaacgtggtaacggagggttaacccncgggttattaggttacgtttaacttccggttggccgaacggtgtaaccggtcccctttaccccggttaaggttaagtaacccggg

SEQ ID NO: 383459 - DNA, 694 bp, Homo sapiens
  misc_feature: GZ8MTXP01BAR2N.21.40.D07.1.454.CMB.2.raw
  modified_base (262)..(262): a, c, t, g, unknown or other
  modified_base (306)..(306): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctatttagaggtgtccagtgtgaggtgcagctggtggagtcgtgggggagcgttggtccaggccgtgggggtccctgagactctcctgtgcagcctntggtattcacttagtagtctagttggatggagcgtcgggtcccnccgaggcctaccggagggggaacgggggcgtaggggaggttcgggggtacggacccaaagaagtaaaagacccgaaaggagtagggaaagtgaaacgaactaataactagtggtcggacttcgtaggtacggaaacggggcctaattccgaaccctattaccctaccgaaacgtacgaaccgaaacccgaccgaaaggcgacccttactacgttagtactaccgtagaaccaaagtcgaaaactcggtacccgtaggaaacggtacggtccgggaaacgggacccgtaccgggttcgtttaagggttagttaacgtttaaccggttgggttaaccggacggtaacggtacgtaccccgttccccccggtaagggttaacgtaaccggg

SEQ ID NO: 383460 - DNA, 634 bp, Homo sapiens
  misc_feature: GZ8MTXP01AUH6D.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagtctagttggatgagcgtgggtccgcgaggctccgaggggaagggcgtgggagtgggtgaccaaacagtaaagcaagagtggaagtgaagacaatactagtggtaggactcgtggtaggaacgggccgtaattccaaccgattccctacccgaggaacgaaccgaaaccgacccaaagacgtcctacgtaccttggtaactcgtagaacctaaagtacgaaacacggtcccttagggacggtaacggtcgggaacggaccggaaaccggttcgttaggttagttacgtttacgttacggttcggacggtaacggtacgtaaccgttccccccgtaagggttaacgtaaccggg

SEQ ID NO: 383461 - DNA, 633 bp, Homo sapiens
  misc_feature: GZ8MTXP01AH5X5.21.40.D07.1.454.CMB.2.raw
  modified_base (527)..(527): a, c, t, g, unknown or other
  modified_base (583)..(583): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggaggcgttggtccaggccgtggggggtccctgagactctcctgtgcagcctctggattcacctttagagctattggatgagcgtgggtcccgcgaggctccggagggggaggggctgggaggtggggtcgaccaaacgataaagccaaaggagtagggaagtgaaagacaatactagtggtggacttcgtaggtaggaaacggggtccctaattccaaccctaattcccgtaacccgaaggaacgaaccgaaaccgcccaaaaggacgtcctactacgttgtaactccgtagaacctaaaatcggaaaaccncgtccgtaggaacgaggtaacggaacggacgacggttgttaggtagttacgttcgnggtaacggacgtaacggtaccgtaccccgttccccgtaacggttaagtcg

SEQ ID NO: 383462 - DNA, 641 bp, Homo sapiens
  misc_feature: GZ8MTXP01EIIM4.21.40.D07.1.454.CMB.2.raw
  modified_base (256)..(256): a, c, t, g, unknown or other
  modified_base (259)..(259): a, c, t, g, unknown or other
  modified_base (261)..(261): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctccgtngcncnctctgtcgtcacttagtagtcgtattggatgaggccgtcgggtccggccgacggacggtaccggagggaagggggcgtggggtaggtcgggtaggaccaaacgaagtaaaacgacaaaggaagtaggaagtaagaagaactaataacgtagtagtaggtacgtcgtaggtcgaaggtccgactacaccactactaccacgaacgacaacgaccgaacgacgacgtcgtacttcgtacgtacctaacgtacgaaactacgaaaccgtaacgaccgtacggaaggaacggtaacggaacgggacgttacggtacgttacgttacgttacgttacgtgtagtaacggacgtaccgttaccgttaaccccgttaaccggtaacg

SEQ ID NO: 383463 - DNA, 646 bp, Homo sapiens
  misc_feature: GZ8MTXP01D0L3D.21.40.D07.1.454.CMB.2.raw
  modified_base (264)..(264): a, c, t, g, unknown or other
  modified_base (468)..(468): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtgggggagcttggtccagccgtggggggtccctgagactctcctgtgcagcctntggattcacctttagagctattggatgagcgtggtccgccaggctccgaggggaggggctgggaggtggggtgaccaaacgagtaaagccaaaggagtaggaagtgaaagactaagtactaagtggtaggacttcgtaggtagaaacggggcctattaccaactacgttcctacccgagaacgaaccgaaacgaccaaaggacncctacacttgtaatccgtagaactaaagtacgaaaccacgtccctaaggacgtaacggtaacgggaaacggttaaccgaaccggggtttcgttacggttaacgtttaacgttcggttgggtaacggaccggtaacggtaaccgtaccccgttacccccggttaaggttaacgtaacgg

SEQ ID NO: 383464 - DNA, 658 bp, Homo sapiens
  misc_feature: GZ8MTXP01C3HSU.21.40.D07.1.454.CMB.2.raw
  modified_base (259)..(259): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagctgggttttcctgttgctattttagaaggtgtccagtgtgaggtgcagcgtggtggagtcgtgggggaggcgttggtccagccgtggggggtccctgagactctcctgtgcngcctctggtattcacctttagtagtcttattggatggagcgtcgggtccgccaggcctaccggagggggaagggggcgtagggaggtggggtacggaccaaacagtaaagccaaaggagtaggaaagtggaaagacaagtactagtggtaggactcgtagggtacgggaaacggggcctaattaccgacctacgttccctaccgaagaacgaaccgaaaccggacctaaagacgtcctactacttgtaactcgtagaacctaaagtcgaaacgacgtccgtaggaacgtacgggtaacggaacgggaccgtaacgggttcgttagggttagttaacgtttcgttggtcgggacgtaaggtaccggtaccttacccccggttaaggttaacgtaaccggg

SEQ ID NO: 383465 - DNA, 604 bp, Homo sapiens
  misc_feature: GZ8MTXP01CGWYY.21.40.D07.1.454.CMB.2.raw
  modified_base (353)..(353): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcccttgttgctattttagaaggtgtccagtgtgaggtgcagctggtggagtcgtgggggagcttggtccagccgtggggggtccctgagactctcctgtgcagcctctggattcacctttagagctagttggatggagtctgggtcccgccgaggctccggaaggggaggggctggggagtggggtcggaccaaanaagtaaagccaaagagtaggaagtgaaagactaatactagtgtaggactcgtgtaggacgggtcctattcacctatctaccgaagacgaacaaccgaccaaagcgcctacgacgttagtactcgtagaacctaaagtcggaaactacgtccgtaggacggaggtcggaaggttccgaacgggttcttagggtagttaacgttcgttgggtgacgaagtacggaccttcccccggtaaggttaagtaaccgg

SEQ ID NO: 383466 - DNA, 658 bp, Homo sapiens
  misc_feature: GZ8MTXP01BMLU4.21.40.D07.1.454.CMB.2.raw
  modified_base (544)..(544): a, c, t, g, unknown or other
  modified_base (561)..(561): a, c, t, g, unknown or other
  modified_base (653)..(653): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctctgtgcagcctcgtggtacttcacctttagtagtctagttggatggacgcgtcggggtccccgccgagggccgtaccggagggggtaacgggggcttgggggaggttcgggggtacggacccaaaacgaagtaaaacggaccgaaaggtagtagggaaggtagaaacggaactaattaactagttcggtacgggacttcggtagggttaggaacgggggtaccacttaccaaccgtattcccgtacccgaagaagaacccaaaccgacctaaagacgcctacgacttgtaacctntagacaaagtcgaaacncggtaccttaggacgaggtaacggaacggttaccgacggttgttagtagttagttcgttggtgacgaacgacgtaccttccccggtgttaanaacgg

SEQ ID NO: 383467 - DNA, 563 bp, Homo sapiens
  misc_feature: GZ8MTXP01CFLJP.21.40.D07.1.454.CMB.2.raw
  modified_base (264)..(264): a, c, t, g, unknown or other
  modified_base (474)..(474): a, c, t, g, unknown or other
  modified_base (508)..(508): a, c, t, g, unknown or other
  modified_base (524)..(524): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgcagctgggtggaggtcgtggggggaggcttgggtccaggccgtggggggtccctgagactctctgtgcngcctctggattcacctttagtagctattggatgagcgtgggtccgccaggcctccgagggggagggggctgggaggtgggtggaccaaacgagtaaagccaaagagtaggaagtgaaagacaatactagtgtggactcgtgtggaacgggccattcaccatcaccagacacaacgcaagacgctacactgtatctagacaaagtgaaacngtaccgtagagaggtcggaacggacaccgggttnttggtgttacgttcgnggtaagcgtaagcgtacccttccccggttggttaagtcg

SEQ ID NO: 383468 - DNA, 653 bp, Homo sapiens
  misc_feature: GZ8MTXP01BJYBP.21.40.D07.1.454.CMB.2.raw
  modified_base (296)..(296): a, c, t, g, unknown or other
  modified_base (540)..(540): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggaggtcgtggggggaggtcgtttgggtcccgaggccggtgggggggtccctggacgactctcctgtgcagcctcgtggattcactttagtanctattggatgagcgtcgggtccgccgaggcctaccggaagggggagggggcgtgggaggtgggggtacgaccgaaacaagtaaaacggaccgaaaggtagtagggaaagtagaaagaactaagtactaagtggtacggtacttcgtaggtaggaacgggtcctattccaacctagtcctacaaggacaacaacgaccaaagtcgcctacgacgttgtaactcgtagaacctaaagtcgaaaacngtaccgtagaaggacggtaacggaacggacctcgggttcttaggtacgttaaagtttccgagggttcgacggaacgtacgtaccccttcccccggtaagggttaataaccggg

SEQ ID NO: 383469 - DNA, 647 bp, Homo sapiens
  misc_feature: GZ8MTXP01CYJSZ.21.40.D07.1.454.CMB.2.raw
  modified_base (261)..(261): a, c, t, g, unknown or other
  modified_base (359)..(359): a, c, t, g, unknown or other
  modified_base (522)..(522): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggaggtcgtgggggaggcgttggtccaggccgtggggggtccctgagactctctgtgcngcctctggattcactttagtagtctattggatgagcgtcgggtccgccgaggccgtaccggaagggggaggggcgtgggaggtgggggtggaccaaanaataaagaccaaagagtggaagtgaaagacaatactagtggtaggactcgtgtagggaacgggtcctaattccgaacctatacccgtaccaaggaacgaaccaaaccggccaaaggacgtcctacgtaaccttgtaactacgtagaaccaaagtcgaaaaccncggtctagggaacgtacgggaaccggaaagggacctaacggggctttagggttacgttaaacgtttcgttagggttaaggaccggaagtacggtacccctttcccccggtaaggttaagtaaccg

SEQ ID NO: 383470 - DNA, 610 bp, Homo sapiens
  misc_feature: GZ8MTXP01C595R.21.40.D07.1.454.CMB.2.raw
  modified_base (509)..(509): a, c, t, g, unknown or other
  modified_base (523)..(523): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatggagcgtggggtccgccaggctccggagggggaagggggctgggaggtggggtgaccaaacataaagccaaggagtggaagtgaagacaagtactagtgtgggactcgtaggtggaaacgggtcgtaattccgaacctactaccgtacccgaaaggacgaaaccgaacgacccgaaaggaccgctactactgttaatcctagaacaaaagtgaaaacncggtcctaggaagnggtaaccggaaggaccgacgggcttaggttcgttaagtttcgttaggtgacgaagtacgacccgttcccgtccggttaataaccggg

SEQ ID NO: 383471 - DNA, 623 bp, Homo sapiens
  misc_feature: GZ8MTXP01D59UJ.21.40.D07.1.454.CMB.2.raw
  modified_base (260)..(260): a, c, t, g, unknown or other
  modified_base (278)..(278): a, c, t, g, unknown or other
  modified_base (284)..(284): a, c, t, g, unknown or other
  modified_base (286)..(286): a, c, t, g, unknown or other
  modified_base (313)..(313): a, c, t, g, unknown or other
  modified_base (318)..(318): a, c, t, g, unknown or other
  modified_base (335)..(335): a, c, t, g, unknown or other
  modified_base (356)..(356): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggtttcgtgtagctatttagaaggtgtcagtgtgaggtgcagctggtggagtcgtgggggagtcttggtccagccgtggggggtccctgagactctcctgtgcagcctntggattcactttagagtntatgangngcgtcggcgcgcgcgcggagggagggngtggnggtggtacgacaacaanaagacgagagagagagaaganaatatagtgtgtacgtgtgtaggacggacgtactacactactactacgacgacgaacgaaccgacgaacgacgactacgtacgttacgttactacgtacgtaacgtaaacgtaacgtaaacgtaacgtaccgtaacggtaacggaacggtaacggtaacgggaccggtacggttacgttacggttacggtttacgtttacggttacggtaacggtacggtaaccggtaaccgtaccccgttaccccgttaaccggttaacgtaacgg

SEQ ID NO: 383472 - DNA, 564 bp, Homo sapiens
  misc_feature: GZ8MTXP01CFNDX.21.40.D07.1.454.CMB.2.raw
  modified_base (264)..(264): a, c, t, g, unknown or other
  modified_base (333)..(333): a, c, t, g, unknown or other
  modified_base (341)..(341): a, c, t, g, unknown or other
  modified_base (413)..(413): a, c, t, g, unknown or other
  modified_base (424)..(424): a, c, t, g, unknown or other
  modified_base (499)..(499): a, c, t, g, unknown or other
  modified_base (517)..(517): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagtcttggtccagccgtggggggtccctgagactctcctgtgcagcctntggattcacctttagagtctagttggatgagcgtggtccgcaggctccgagggagggctgggagtgggngaccaaanagtaaagccaaagagtaggaagtgaaagacaatactagtgtgactgtgtagaaggctaatcacatcacaganacaacgcaagngctacactgtaactcgtagaaaccaaagtagaaaccgcgtccgtaggacgaaggtaacggaacggaccgtacggngttggtagttaagttcgnggtaagacgaagtacgtacccgttccccgtaacggttaataaccggg

SEQ ID NO: 383473 - DNA, 541 bp, Homo sapiens
  misc_feature: GZ8MTXP01ASOW2.21.40.D07.1.454.CMB.2.raw
  modified_base (304)..(304): a, c, t, g, unknown or other
  modified_base (335)..(335): a, c, t, g, unknown or other
  modified_base (341)..(341): a, c, t, g, unknown or other
  modified_base (433)..(433): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttgggtccaggccgtggggggtccctgagactctcctgtgcagcctctggattcacctttagagctattggatgagctgggtccnccaggctcgaggggaggggctgggagtgggngccaanataaagcaaagatagggaagtgaaagacaagtactagtgtggactcgtgtggaagggccgattcaccatcaccagagacaacgccaaagtanctcgaactgtaatcctagacaaagtagaacagcctagagagtaacggaacggacgacggcgtgtggttattattgtgcgaagagacttacccgtccgttaacgtaacg

SEQ ID NO: 383474 - DNA, 593 bp, Homo sapiens
  misc_feature: GZ8MTXP01DL5LG.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgcagctgggtggagtcgtgggggagcttggtccagccgtggggggtccctgagactctcctgtgcagcctctggattcactttagagctattggatgagcgtgggtcccgcaggcctaccggaggggaaggggctgggaggtggggtgaccaaacataaagcaaggatgggaatgaaagacaagtactagtgtgactcgtggtaggaacgggccgtattcacctattccaccgaagagaaccaacgaccaaagacgtcctacaacttgtactaccgtagaacctaaagtagaaaccgtagccgtagaacggtgtaacggaaggacgacggttcgtaggttgttaattacgttgtaaggacgaaggtactccgttacccccgttaacgggttaataacgg

SEQ ID NO: 383475 - DNA, 702 bp, Homo sapiens
  misc_feature: GZ8MTXP01BZLV0.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagtctagttggatgagcgtgggtccgccgaggctccggaggggaggggcgtgggaggtggggtcgaccaaacgaagtaaagccgaaaggagtagggaagtgaaagactaatactagtgtaggtactcgtgggtacggaaacggggtccctaagtttccaacccgtattacccgtaacccgaagggaacgaaaccccgaaaccggaccccgaaaaggaccggtacccttacgtaacgtttacgttaaacttacccggtaacgaacctaaaagttcgaaaaccgcgtacccgtagggaacggtcggtaaccgggaacgggacgtaccgggttcgtttagggttacgtttacgttacggttggttaacggaccggtaacggtaacggtccccgttacccccggttaacgggttaacgtaaccggg

SEQ ID NO: 383476 - DNA, 608 bp, Homo sapiens
  misc_feature: GZ8MTXP01ETE4O.21.40.D07.1.454.CMB.2.raw
  modified_base (301)..(301): a, c, t, g, unknown or other
  modified_base (348)..(348): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtggggggtccctgagactctcctgtgcagcctctggattcacctttagagctatggatgagcgtgggtccnccgaggctccggaggggagggggctggggaggtggggtcgaccaaanaagtaaagaccgaagtagtaggaagtgaaagactaagtactagtgtagtactcgtgtaggacgggctatccactatctaccgagacaaccaccgacgaaagcgtcctacgtaacgttgtactccgtagaacctaaagtacgaaacgtcgtccgtaaggacggacggtaacggaacggaccgccggttagttggtacgttaacgttggttcggtaacgacggtaagtaccgtacccttcccccggtaaggttaataacggg

SEQ ID NO: 383477 - DNA, 731 bp, Homo sapiens
  misc_feature: GZ8MTXP01B0W47.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggccagccgtgggggtccctgagactctcctgtgcagcctcgtggacttcacctttagtagtctagttggatggagtcgtcggggtcccgccgagggctacccggaagggggaacgggggtcgtgggggaggtcggggggtacggaccctaaacgaagtaaaacggaccgaaaggagtaggggaagtggaaagaactaattaacgtaagtggttagggacttcgtagggtacggaacggggcctaattaccactacttccgtaccgaaggaacgaacccgaacgacccaaaagggctccctactaaccgtttggtaacttccgaaggtaaccaaaagttaccgaaaccgaggtacccctagggaaacggtacggttaaccgggaacgggaacccgggtaccggggttcgtttaacgggttaacgtttaaccgtttcggttacggggtaacggtacggtaacggttacccggtaccccgtttacccccgggttaagggttaacgtaaccggg

SEQ ID NO: 383478 - DNA, 535 bp, Homo sapiens
  misc_feature: GZ8MTXP01BKPW3.21.40.D07.1.454.CMB.2.raw
  modified_base (468)..(468): a, c, t, g, unknown or other
  modified_base (478)..(478): a, c, t, g, unknown or other
  modified_base (495)..(495): a, c, t, g, unknown or other
  modified_base (506)..(506): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcgttggtccagccgtggggggtccctgagactctcctgtgcagcctctggattcacctttagagctagttggatgagctgggtccgccaggctccgaggggaggggctgggagtgggtgaccaacataaagccaagatggaagtgaagacaatactatgtgactctggtgaaggggccattccgactatcctacccgagacgaaccaaccgcctaaaggcgactcgactgtactctgacaaagtgaaacngcctagacgngtcgaaggcacgggttntgtgttattgngtgcgaagcgccttcccgtaagttaagcg

SEQ ID NO: 383479 - DNA, 617 bp, Homo sapiens
  misc_feature: GZ8MTXP01CGZHK.21.40.D07.1.454.CMB.2.raw
  modified_base (300)..(300): a, c, t, g, unknown or other
  modified_base (337)..(337): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtcctgagactctctgtgcagcctctggattcacctttagagctattggatgagcgtgggtcccncgaggctccgaggggagggctgggagtgggcgacaanataaagccaagataggaagtgaaagacaatacttaagtggtaggactcgtagtacgggaaaggggtcccaatttcccgaacctattcccgtacccaaggaacgaaccgaaacgcccgaaagacgtcctacacttggtaactccgtagaacctaaagtcggaaaactcgccctaggaacgacggtaacggaaaggacctaccggggttgttaggttagttacgttcgttggaacggacgaacgtaccgtacccgttaccccggttaacggttaagtaacgg

SEQ ID NO: 383480 - DNA, 632 bp, Homo sapiens
  misc_feature: GZ8MTXP01CJJO6.21.40.D07.1.454.CMB.2.raw
  modified_base (502)..(502): a, c, t, g, unknown or other
  modified_base (510)..(510): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagcttattggatggagcgtcgggtccgccgaggcgtaccgagggggagggggcgtggggaggtgggggtacggaccaaacgtaagtaaaaggaccaaggagtagggaaagtgaaagactaatactaagtgtacggactcgtgtacggaacggggcctaattccaaccgatccgtaccgaagacgaaccgaaccgaccaaaagcgtcctacaacgttgttacncgtagaanaaatgaaacctcggcctaggaacggaggttaaccgggaaaggacgtacgggttacgttggttaagttacgttacgttggtcgacggtaagacgtacccttcccccgtaacgttaagtaacgg

SEQ ID NO: 383481 - DNA, 441 bp, Homo sapiens
  misc_feature: GZ8MTXP01CFWN9.21.40.D07.1.454.CMB.2.raw
  modified_base (265)..(265): a, c, t, g, unknown or other
  modified_base (287)..(287): a, c, t, g, unknown or other
  modified_base (302)..(302): a, c, t, g, unknown or other
  modified_base (311)..(311): a, c, t, g, unknown or other
  modified_base (379)..(379): a, c, t, g, unknown or other
  modified_base (427)..(430): a, c, t, g, unknown or other
  modified_base (432)..(441): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgtattctctggctcaattctggcactcagcctcctgccatcagtggctcggtcgaggatgaggctgtattatacngtgcagcatgtgatgacgctgngtggtccgtgtcggnggacggacnggctgaccgtctaggtcccacggccaggcctcgacccctaggtctcgttcgtccccaccctcctccgngtccgacgctgggacggtcgggactacgggacaacggggcacaagcgnnnngnnnnnnnnnn

SEQ ID NO: 383482 - DNA, 634 bp, Homo sapiens
  misc_feature: GZ8MTXP01AVDM2.21.40.D07.1.454.CMB.2.raw
  modified_base (264)..(264): a, c, t, g, unknown or other
  modified_base (512)..(512): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctntggacttcacctttagagtctagtggatgagcgtgggtccgcgaggctccggaagggggacgggcgtgggaggtgggggtcgaccaaacagtaaagccgaaaggtagtagggaagtgaaagacaagtactagtggtggtactcgtaggtaggaacggggtcctaattccaacctatcctaccgaagaacgaccaacggccaaaggcgtcctacgacgtgttaactccgtagaaccaaagtcgaaaccncgtcccgtagaacggaggtcccggaagggacccgtaacgggttcgttaggtacgtttaacgttcggttggtaacggtccgaaggtaccgtacccgttcccccgtaaggggttaactaacggg

SEQ ID NO: 383483 - DNA, 573 bp, Homo sapiens
  misc_feature: GZ8MTXP01D8B1V.21.40.D07.1.454.CMB.2.raw
  modified_base (347)..(347): a, c, t, g, unknown or other
  modified_base (516)..(516): a, c, t, g, unknown or other
  modified_base (543)..(543): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagctgggtttccttgttgctatttagaggtgtccagtgtgaggtgcagctggtggagtcgtgggggagcttggtccagccgtgggggtccctgagactctcctgtgcagcctctggattcaccttagtagctattggatgagtcgtgggtcccgccgaggcctaccgaagggggaagggcgtgggagtggggtagcccaaanagtaaaagccgaaaggatagggaaagtcggaaagactaataactagtgaggtactcgtggtagaacggggccctattaccaccaattccgtaccccgaagtacgaaccaaacggcccaaagacgccttacgacttagtaatccagacaaagtgaaacctgcctggaagngtgaagccagggcttgtgttattcggngtgcgaagacgaccttcccgtcgttaagcg

SEQ ID NO: 383484 - DNA, 674 bp, Homo sapiens
  misc_feature: GZ8MTXP01BHPRU.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggagtcgtgggggagtcttggtccagccgtgggggtccctgagctctctgtgcagcctctggattcacctttagagctattggatgagcgtgggtcccgccaggctaccgaaggggaggggctgggaggtggggtcggaccaaacgagtaaaagccaaaggagtagggaaagtggaaacgacaagttactagtggtacggtacttcgtaggtacggaaacggggccctaattccaaccattccgtacccgaaagaacgaaccaaaccgacccaaagacgtccttacaacgtttgtaacttccgagaaacctaaaagtcggaaaccgacgtccccgtaggaaacggtacggtaaccgggaaggttaacccgtaacggggttccttagggttacgttaaacgtttccgttggtaacggaccggtaagaccgggttaacccttccccccggttaaggggttaataacccggg

SEQ ID NO: 383485 - DNA, 623 bp, Homo sapiens
  misc_feature: GZ8MTXP01DZB4O.21.40.D07.1.454.CMB.2.raw
  modified_base (300)..(300): a, c, t, g, unknown or other
  modified_base (344)..(344): a, c, t, g, unknown or other
  modified_base (483)..(483): a, c, t, g, unknown or other
tcagtcgtcgctcgcacgaccggtgctcgatttagtgatagagcgtaacaaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctctgtgcagctcgtggattcacttagagctagtggatggagcgtgggtccncaggctccgagggggaggggctagggagtgggtacgacctaaanagtaaagccaagagtaggaagtgaagacaatactagtggtcgactcgtaggtggaacggtcgtattcactatcgtaccgaagacaccaacgaccaagtacgctacgactggttactcgtagaacaaagtcggaaaaccncgtaccgtaggtaacggtacggtaacgggtaacggttaccgtacggttcgtttaggttacggttaacgtttcggacgggtaacgggaacgtaaccggtaaccggtccccgttaccccgggttaacgttaacggtaaccgg

SEQ ID NO: 383486 - DNA, 673 bp, Homo sapiens
  misc_feature: GZ8MTXP01ADZ2S.21.40.D07.1.454.CMB.2.raw
  modified_base (571)..(571): a, c, t, g, unknown or other
  modified_base (633)..(633): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggagtcggtgggggaggtcgttgggtccaggtccggtcggggggtccctggacgtactctcctgtcgcagtcctcgtggtacttcctacctttagtagtcttagttggatggagtcgttcgggtcccgtcgacgggccgtaccggaagggggtaacgggggtcgtagggggtagggtcgggggtacggaacccaaacgaaagtaaaaggacccgaaaggagtagggaaagtagaaacggaactaatacgtagttggtacggtacttcgtaggtacgggaaacgggcctaattccgaacctatccgtaccgagacgaaccaacgcaaagcgctacgactgtactcgtaagactaaaagtcgaaacgngtaccgtaggacggtaggaaccggaagggaccgtacggttcttaggttacgttaagtttcgnggtcgacgaaggactacccgttccccgtaagggttaagcg

SEQ ID NO: 383487 - DNA, 696 bp, Homo sapiens
  misc_feature: GZ8MTXP01BBDM5.21.40.D07.1.454.CMB.2.raw
  modified_base (413)..(413): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtgggggaggtcttggtccaggccgtggggggtccctgacgactctcctgtgcagcctcgtggtacttcacctttaggtatcgttaattgggatggagcgtcggggtccgccgaggccgtccggaagggggaacggggtcgtggggaggtgggggtacggaccgaaacaagtaaaggcccgaaaggagtagggaaagtggaaanacaattacgtagtgtggacttgtaggtaggacggggtctaacttccgacctagtcccgtaaccgaaggaacgtaacccgaaacgacccaaaggacgtccctacggaaacgtttaggttaccttacgaacggtaaacctaaaggttaacgaaaacctcggtacccgtaggaacggtaacggtaaccgggaaacgggacgtaacccggttgttcgttaaggttacgtttaccgttggtccggacgtaaggtaacccgccttacccccggtgggttaaactccggg

SEQ ID NO: 383488 - DNA, 580 bp, Homo sapiens
  misc_feature: GZ8MTXP01EO4AZ.21.40.D07.1.454.CMB.2.raw
  modified_base (346)..(346): a, c, t, g, unknown or other
  modified_base (478)..(478): a, c, t, g, unknown or other
  modified_base (493)..(493): a, c, t, g, unknown or other
  modified_base (536)..(536): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtggggggtccctgagactctcctgtgcagcctctggattcacctttagagtctattggatgagcgtggtccgcaggctcgagggagggctggagtggtgcaacataaagccaaganaggaagtgaagacaatactaatgtggtactcgtggtagaacggggtccaattccgaacctatcctaccgaagacgaaccaaacgccaaagacgtcctacactttgtaactccgtagaacaaagtcgaaaacngtaccctaggaacgngtaaccggaagggttaccacgggttctggtagttacgttacgngggtaacgcggaagcggacccttccccggtaaggttaatccggg

SEQ ID NO: 383489 - DNA, 659 bp, Homo sapiens
  misc_feature: GZ8MTXP01CIKPB.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagtcctcgtggtattcacctttagagtctattggatgagtcgtgggtcccgccgaggcctaccggagggggaggggcgtgggaggtggggtcgaccaaacaagtaaagaccgaaaggagtaggaaagtggaaagacaagttactaagtggtaggacttcgtaggtacgggaaacggggtccctaatttaccgaaccctattaccctaccgaaaggaacaacccgaaacgaccaaaggcgtcctacgacgttgtaactcgtagaacctaaagtcgaaaccgagtcccgtaggaaggacggtcccggaaaggaccgtaaccgggttcgttaggttacgttacgttacggttggtaacggacggtaacgtaccgtccccgttaccccggtaaggttaacgtaacgg

SEQ ID NO: 383490 - DNA, 706 bp, Homo sapiens
  misc_feature: GZ8MTXP01BSG2Y.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgcagcgtggtggagtcgtggggggaggtcgtttggtccgaggtcccggtcgggggggtccctggacgtacctctcctgtcgcagccctcgtggacttcacctttagtagtcttagttggactggagtcgtcgggtcccgtccgacggtccgtaccggaagggggaacgggggtcgtaggggaggttgggggtacggaccaaacgaaagtaaaacgacccgaaaggagtagggaagtaggaaacgaactaagtactagtggtacggtacgtcgtgtaggaacgggtccgtaattccgaacacgttctaaccgaacgacgaaccaacgacccaaggactcctacgacgttagttaactaccgtagaaaccgtaaaatggaaaacccacggtcccgttaaggaaggttaccgggaacgggaacgaaccgggtacggttcgttagggttagtttaacgttcggttgtaaggacggtaagtaccggtaccgttcccccgtaagggttaacgtaacgg

SEQ ID NO: 383491 - DNA, 743 bp, Homo sapiens
  misc_feature: GZ8MTXP01BASDV.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagcgtgggtcccgccaggcctccggaagggggaagggggcgtggggaggtgggggtacggaccaaacgaataaaggccaaaggtataggggaaagtgaaagacaatactagtggtggactcgtgtaggaacggggtccgaattccgaacctattcccacccgaaaggaacgaaaccgaaaccggaccctaaaaggcggtacccttacgggaacccgtttggttaaaccttccgtaaggaaaccctaaaaagttcggaaaaaccctcggtccccgttaaagggaaacgggaaacgggttaacccggggaaacgggaacccggtaaacccggggggttactttacggggtttaacgtttaacggttttaccggttacggggttaaccggggaaccggtaaaggtaacccggtaccccgtttacccccgggttaacggggttaaacgtaacggg

SEQ ID NO: 383492 - DNA, 698 bp, Homo sapiens
  misc_feature: GZ8MTXP01AWG4E.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggaggtcgttggtccaggccgtggggggtccctgacgactctcctgtgcagcctctggacttcacctttagtagtctagttggatggagtcgtcgggtcccgccgaggccgtaccggaagggggaacggggcgtgggagggtcggggtacggaccaaacgaagtaaagaccgaaaggagtagggaaagtggaaagaactaatactagtgtgtactcgtgtacgggaacgggtcctaacttccgaacctacttcccgtaaccgaaggaaaccaacccgaaaccgacccgaaagtccgtactaccgacgttagtactaccgtagaacctaaagtcgaaacgacgtcctaggaacggtcggtaaccgggaacggaccgtacgggttccgttagggttaacgttacgtttcggttacgggtaacggtacccgggaaggtaacccggttcccccgttacccccgggttaacgggttaaagtcccgggg

SEQ ID NO: 383493 - DNA, 542 bp, Homo sapiens
  misc_feature: GZ8MTXP01A5ZGD.21.40.D07.1.454.CMB.2.raw
  modified_base (268)..(268): a, c, t, g, unknown or other
  modified_base (284)..(284): a, c, t, g, unknown or other
  modified_base (311)..(311): a, c, t, g, unknown or other
  modified_base (339)..(339): a, c, t, g, unknown or other
  modified_base (345)..(345): a, c, t, g, unknown or other
  modified_base (352)..(352): a, c, t, g, unknown or other
  modified_base (379)..(379): a, c, t, g, unknown or other
  modified_base (433)..(433): a, c, t, g, unknown or other
  modified_base (462)..(462): a, c, t, g, unknown or other
  modified_base (471)..(471): a, c, t, g, unknown or other
  modified_base (486)..(486): a, c, t, g, unknown or other
  modified_base (502)..(502): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaggtgtccagtggtgaggtgcagctggtggagtcgtggggggagtcttggtccaggccgtggggggtccctggacgactctcctgtgcagcctntggattcacctttagngtctagttggatggagcgtgggtcccncgaggctaccggaggggaggggctgggngtgggngaccaanaataagcaagagtaggagtgaaagacntactagtgtgactcgtgtaggaggcctatcacatctacgagacacacgacaagngtcacactgtactcgagacaatgaaaccngtcgagagngaacggagacgtcgngtagtagttacgttgngtaacgacgaacgtacgtacccgttcccgtggttaagtcg

SEQ ID NO: 383494 - DNA, 650 bp, Homo sapiens
  misc_feature: GZ8MTXP01EZNY0.21.40.D07.1.454.CMB.2.raw
  modified_base (442)..(442): a, c, t, g, unknown or other
  modified_base (577)..(577): a, c, t, g, unknown or other
tcagtcgtcgctcgcacgaccggtgctcgatttagtgatagagcgtaacaacagaggggagagaggagccttagccctggactccaaggcctttccacttggtgatcaacactgagcacagaggactcaccatggaattagggctgagcttgggttttccttgttgctattttagaaggtgtccagtgtgaggtgcagctggtggagtcgtgggggagcttggtccagccgtggggggtccctgagactctcctgtgcagcctctggattcaccttagagcttagttggatgagcgtggggtcccgccgaggcctaccgagggggaacggggctgggaggtgggggtcggacccaaacaagtaaagacaaaggtagtaggaaggtgaagaacaatctaagtggtaggactcgtggtaggaacggggccctattccaaacctntacctaccgaagaaacggaaccaaccggacccaaagcgtacctcaacggttagtaacttccgtaggaaacctaaaagtcggaaacctacgtcccgtagggaacgacgggtcggaaacgggtaccgaccggggttnttagggttattaacgttacgttggttacggaacgagtaaccgtacccgttccccggttacgtaagttcgaacg

SEQ ID NO: 383495 - DNA, 602 bp, Homo sapiens
  misc_feature: GZ8MTXP01BG6GQ.21.40.D07.1.454.CMB.2.raw
  modified_base (254)..(254): a, c, t, g, unknown or other
  modified_base (390)..(390): a, c, t, g, unknown or other
  modified_base (443)..(443): a, c, t, g, unknown or other
  modified_base (546)..(546): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggttttcctgttgctatttagaaggtgtccagtgtgaggtgcagctggtggagtcgtgggggagcttggtccagccgtggggggtccctgagactctcctgtncagcctctggattcacctttagagtctattgggatgagtcgtggggtccgtcaggcctaccggaagggggaagggggctggggaggtgggggtcggaccaaagagtaaaaggccaaaggatagggaagtgaagacntactatgtgactgtgtagaggctatcacatcaccagacacacgacaaggtacnctacgacttagtactcgagaactaaagtacgaaacctcgtaccgtaggaacggacggtaacggaacgggaccgtacgggttgttaggttacgttaacgttcgnggtaacggacgtaacggtacccgtaccccgttaccccggttaaggttaacgtaacg

SEQ ID NO: 383496 - DNA, 590 bp, Homo sapiens
  misc_feature: GZ8MTXP01C8MJO.21.40.D07.1.454.CMB.2.raw
  modified_base (535)..(535): a, c, t, g, unknown or other
  modified_base (550)..(550): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggaggtcgtgggggagcgttggtccagccgtggggggtccctgagtctctcctgtgcagcctgtggtattcactttagagctagttggatgagcgtgggccgcgaggctaccggagggggagggcgtgggaggtgggtagaccaaagataaagccaaagagtggaaagtgaaagactaattactagtggtagactcgtgtacgggaaagggcctaattccaacctattaccaccgaagacgaaaccaaacgaccaaagcgtctacacttagtactacgtagaaactaaatacggaaactagccgtagaacgaggtcgaagggacacgggttntagtacgttagttgnggtaagacgtaagacgtaccttaccccgtaaggttaagcg

SEQ ID NO: 383497 - DNA, 570 bp, Homo sapiens
  misc_feature: GZ8MTXP01A5VUQ.21.40.D07.1.454.CMB.2.raw
  modified_base (502)..(502): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggggaggcttggtccaggccgtggggggtcccctgagactctcctgtgcagcctctggattcacctttagtagctattggatgagcgtgggtccgccgaggctccgaggggaagggggctgggaggtgggtggccaaacgataaagccaaagagtggaagtgaagacaagtactaatgtggactcgtgtgaaacggggccgaattccaaccattcctacccaagacgaacaaacgcccaaagacgcctacaactaggtatcctagaccaaaatggaaacagtcctagacgngtcggaaggacacggcgttaggtgttattcgttggtaagcgaagagacttccccgtcgttaagtaacg

SEQ ID NO: 383498 - DNA, 588 bp, Homo sapiens
  misc_feature: GZ8MTXP01BUHJG.21.40.D07.1.454.CMB.2.raw
  modified_base (413)..(413): a, c, t, g, unknown or other
  modified_base (493)..(493): a, c, t, g, unknown or other
  modified_base (532)..(532): a, c, t, g, unknown or other
  modified_base (556)..(556): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtgggagtcgtggggggaggtcttggtccaggccgtggggggtccctgagctctcctgtgcagcctcgtggacttcacctttagtagtctagttggatgagtcgtgggtcccgccaggcctaccggaagggggaagggcgtgggaggtggggtgaccaaacgaagtaaagccaaaggagtaggaagtgaagacaatactatggtgactcgtgnggaacgggccattcacatctaccagacgacaacgaccaagacgctacgacttgtaacttcgtagaactaaacgtgaaacncgtacctaggaaccgaaggtaaccggaaggaccgtacgngttgtagttagttcgttgtaacgngaacgactccgttccccgtaacgttaagaacg

SEQ ID NO: 383499 - DNA, 511 bp, Homo sapiens
  misc_feature: GZ8MTXP01CRW18.21.40.D07.1.454.CMB.2.raw
  modified_base (367)..(367): a, c, t, g, unknown or other
  modified_base (442)..(442): a, c, t, g, unknown or other
  modified_base (453)..(453): a, c, t, g, unknown or other
  modified_base (467)..(467): a, c, t, g, unknown or other
  modified_base (472)..(472): a, c, t, g, unknown or other
  modified_base (480)..(480): a, c, t, g, unknown or other
  modified_base (484)..(484): a, c, t, g, unknown or other
  modified_base (495)..(495): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggtttccttgttgctattttagaaggtgtccagtgtgaggtgcagctggtggagtcgtgggggaggcttggtccagccgtggggggtccctgagactctcctgtgcagcctctggattcacctttagtgctattggatgagcgtgggtccgccaggctccgaggggagggcgtgggaggtgggtgccaacataaagccaagatggaagtgaagacntactatgtgactctgtgaagggccatccacatctacagagacaacgcaagagctcgatgtatctgacaatgaacngtcctagacgngtcgagacgacggntggtnttagttcnggtnacgtgagtccnccctcgggttaataag

SEQ ID NO: 383500 - DNA, 571 bp, Homo sapiens
  misc_feature: GZ8MTXP01DGONC.21.40.D07.1.454.CMB.2.raw
  modified_base (171)..(171): a, c, t, g, unknown or other
  modified_base (188)..(188): a, c, t, g, unknown or other
  modified_base (241)..(241): a, c, t, g, unknown or other
  modified_base (245)..(245): a, c, t, g, unknown or other
  modified_base (264)..(264): a, c, t, g, unknown or other
  modified_base (266)..(266): a, c, t, g, unknown or other
  modified_base (276)..(276): a, c, t, g, unknown or other
  modified_base (302)..(302): a, c, t, g, unknown or other
  modified_base (307)..(307): a, c, t, g, unknown or other
  modified_base (320)..(320): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagagactcacatggaattgggctgagctggttttcctgtgctatttagagtntccagtgtgagtgcagntggtgagtgtgggggagtcttggtccagccgtgggggtccctgagctctctgngacngtctgtgtactcacttagntntagtgtgtgngcgtcggtcgcgcgcgacgaggaggngtggnggtggacgacaanaagaagacgagagagagagaagataatatagtagtagtagtcgtagtaggacgtacgtactactactacgtacgtacgaacgaacgaacgaacgaacgaacgacgtactacgtactagtacgtacgtacgtaacgaagaacgaacgacgtacgagacgaggtaacggaacggacgtacgttacgtacgttagttacgttacgttacgtaagacgtaacgtacgtaccgttaccgtaaccgttaacgtaacg

SEQ ID NO: 383501 - DNA, 521 bp, Homo sapiens
  misc_feature: GZ8MTXP01C0ENE.21.40.D07.1.454.CMB.2.raw
  modified_base (378)..(378): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcactttagagctattggatgagctgggtccgcaggctccgagggaaggggctgggagtgggtggccaacataagccaagatggaagtgaagacaatactatgtggactcngtgaagggccgagttcaccatctacagagacaacggcaagagctcgactgtaatctgcaaatgaaacagccctgagaggtaacgaggacgacggcgtgtgttagttcttgtgcgaagagacttccccgtcggttaacgtaacg

SEQ ID NO: 383502 - DNA, 732 bp, Homo sapiens
  misc_feature: GZ8MTXP01B6KA4.21.40.D07.1.454.CMB.2.raw
  modified_base (616)..(616): a, c, t, g, unknown or other
  modified_base (682)..(682): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagtcgttggtccagccgtgggggtccctgagtactctcctgtcgcacgcctcgtggtacttcacctttagtagtctagttggatggagtcgtcgggtcccgccgaggccgtaccggaagggggtaacgggggtcgtaggggagggtgggggtacgggacccaaagaagtaaaacggacccgtaaaaggagtaggggaaagtggaaaaggtaacctaagttaacgttagtgggttacggtaaccgttcgttagggtacgggaaacgggggttcccctaaatttaccccaacccgtattcccgtaacccgaaaggaacccgaaacccgaaccggaaccccgtaaaaggcgtccctttaacccacgtttaggtacttaccgagaaacctaaaagtggaaacccncggtacctagggaacgtcggtaacggaacggttaccgtacgggttcttagggttattaacgttcgngggtaacgacggaagtacccgtcccgttaccccggtaagttaagtaacgg

SEQ ID NO: 383503 - DNA, 695 bp, Homo sapiens
  misc_feature: GZ8MTXP01B26W2.21.40.D07.1.454.CMB.2.raw
  modified_base (297)..(297): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggaggcgtttgggtccgaggccggtcgggggggtcccctggacgtacctctcctgtcgcagcctgtggtattcaccttagtanctagttggatgagcgtgggtccgccaggctaccgaggggaagggcgtgggaggtgggtgaccaagaataaagaccaaaggagtaggaagtgaaagaacaatactagtggtagactcgtggtaggacggggtcctaattccaaccgtacttccgtacccgaaaggaacgaacccgaaacgacccgaaaggacgtacccttacaacgttaggtaactacgttacggaaacctaaagttacggaaaacctagtaccccgttaggaaaccgggtaggttaacgggaaacgggttaacctaaacggggttcctttaaggtttaccgttaagtttcccgttagggttaaccggacgtaaggtaacggtacccctttcccccggttaagggttaacgtaacccgg

SEQ ID NO: 383504 - DNA, 558 bp, Homo sapiens
  misc_feature: GZ8MTXP01BTJUB.21.40.D07.1.454.CMB.2.raw
  modified_base (376)..(376): a, c, t, g, unknown or other
  modified_base (469)..(469): a, c, t, g, unknown or other
  modified_base (519)..(519): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtggggggtccctgagactctcctgtgcagcctctggattcacctttagagtctattggatgagcgtgggtccgccgaggctaccgagggggaaggggctgggaggtgggtgaccaaacagtaaagcaagagtaggaagtgaagacntactatgtggactcgtgtagacgggccattcactatctaccgagacgacaacgccaaggtcgctcacgttgtactcgtgaacaaagtgaaacncgtcctggaagtggaacggaaggcgaacgggttgtaggtattacgttcgngtggacgaacgtacgtcccttcccggtaacgttaagtcg

SEQ ID NO: 383505 - DNA, 719 bp, Homo sapiens
  misc_feature: GZ8MTXP01CX06W.21.40.D07.1.454.CMB.2.raw
  modified_base (564)..(564): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagcgtgggtggagtcggtgggggaggtcgttggtccgaggccggtcggggggtccctgacgtactctccgtgtcgcacgcctcgtggtacttctaccgtttagtagtctagttggatggacgtcggtcgggtccgccgagggtccgtaccgggaaggggggacggggtcggtagggggtagggtcgggggtacggaaccctaaagaaagtaaacgacgaaaggtagtagggaagtaggaaaagactaattaacgtagttagggtacgtacgtcgtagggaggaacggggtcctaacttaccactattacccgaccgaagaacgaaccgaaaccgcgtaaacgagtccctacgtaacgtgtttaaccnccgtaagaacctaaaagtcgaaaccgcgtaccgtaggaacggtggaaccgggaacgaccggtacggttcgtttagggtcgtttaaacgttggttacggggtgacgggtaacgtaccggtaccccgttccccgggttaaggttaacgtaaccgggg

SEQ ID NO: 383506 - DNA, 672 bp, Homo sapiens
  misc_feature: GZ8MTXP01ERJ50.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttgggtccagccgtggggggtccctgagactctcctgtgcagcctctggattcacctttagagtcttagtgtatggacgtcggtcgggtcccgtcgacggtccgtaccggaagggggacggggtcgtaggggtaggggtggggtcggaacccgaaacgtaaaagtaaacgaactagtagtagtaggtaaggtaggaacgaaacgtaacttaacgttaagttaggttacggtaaccgttacggttagggtaacgggtaacgggtaccgtaacgttacccgaacccgtacttcctacccggaacggtaacgtaaaccgaaacccgaacccgaaacggaacgtacctacctacgttagtacttaccgtcgaactaaagttaacgaaacgaacgtaccgtagaggacggttacgggaacggacggaaccggtcgtaggttagttaacgttaacgtgg

SEQ ID NO: 383507 - DNA, 524 bp, Homo sapiens
  misc_feature: GZ8MTXP01EQLD9.21.40.D07.1.454.CMB.2.raw
  modified_base (269)..(269): a, c, t, g, unknown or other
  modified_base (344)..(344): a, c, t, g, unknown or other
  modified_base (505)..(524): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtgggctccggtcgagatgaggctgattattacngtgcagcatgtgagtcgacggccgtggtaggttgggttccgggtcggttcgggcggaggggaccgaggccgtcgnacccggtccctagggtcccaaggcccctaaagggccccttcggtcccccctccgggttcctaccttccctccgttccccctacccccgtacccgtcccggacggaccgtaccggaaccgtcggggacgcgggggccgtacgggccgaacggcgcgataggnnnnnnnnnnnnnnnnnnnn

SEQ ID NO: 383508 - DNA, 703 bp, Homo sapiens
  misc_feature: GZ8MTXP01CV6X1.21.40.D07.1.454.CMB.2.raw
  modified_base (607)..(607): a, c, t, g, unknown or other
  modified_base (667)..(667): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggagtcttggtccaggccgtggggggtccctggagactctcctgtgcagcctcgtggtattcacctttagtagctagttggatgagtcgtcggggtcccgtccgaggccgtaccggaagggggaagggggtcttagggggaggttgggggtcggaacccaaaacgtaagtaaaaggacccgaaaaggtaagttaggggaaaagttggaaaacggtaacctaagttaacctaagttagggtacgggtacctcgttagggtacgggaaaccggggtcccgtaactttccaaccctaagttacccaccgaaacggaacgaaccgaaacccggtacccaaaggacgtccctacgtaacgttagttactccgttagaaacctaaagtcgaaaacccgngtcccgtaggaacgtacggtaacggaacggacgacgggttcttaaggtcgttaagttcgnggtgcgtaagcgtaccttccccgttggttaatcggg

SEQ ID NO: 383509 - DNA, 641 bp, Homo sapiens
  misc_feature: GZ8MTXP01BUBGC.21.40.D07.1.454.CMB.2.raw
  modified_base (289)..(289): a, c, t, g, unknown or other
  modified_base (452)..(452): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagtcttgggttttccttgttgcttattttagaaggtgtccagtgtgaggtgcagcgtggtggagtcgtgggggagtcttggtccagccgtggggggtccctgagactctcctgtgcagcctctggtacttacacctttagtanctagttggatgagtcgtgggtcccgccgaggcgtaccggaagggggaggggcgtgggaggtggggtacgacccaaagagtaaaagccgaaagagtaggaaagtgaaagaactaagtactagtggtacggactcgtaggtaggaacgggcctaatccacgtatntacctaggacaacaacgacctaaagacgtcctacgacttagtacttccgtagaaaccaaatacgaaactacgtcccgttaaggaacgtacggtaacgggaacggaaccgtccggttgttaggttagttaacgttacgttgggtcgacggaagaccggtacccttccccggttaagggttaataaccggg

SEQ ID NO: 383510 - DNA, 634 bp, Homo sapiens
  misc_feature: GZ8MTXP01EOTCQ.21.40.D07.1.454.CMB.2.raw
  modified_base (523)..(523): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggaggcgttggtccagccgtggggggtccctgagactctctgtgcagcctcgtggtattcacctttagtagtctagttggatgagcgtcgggtcccgcaggctaccggaaggggacggggtcgtagggaggtggggtcggaccaaacgaagtaaagccgaaaggagtagggaagtgaaagactaagttactagtggtagtacttcggtaggtaggaacggggcctattccaacctatccctaccgagaacgaaccgaaccgccaaagcgtcctacgacttggtactccgtagaactaaagtcgaaacgngtcccgtaggaacgtggtaacggaaggttaccgacggttcgtagttacggttaactttcgttgggtccgaggaacggtactacccgttcccccgttaacggttaagtccgg

SEQ ID NO: 383511 - DNA, 684 bp, Homo sapiens
  misc_feature: GZ8MTXP01APCQ3.21.40.D07.1.454.CMB.2.raw
  modified_base (270)..(270): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtggggggaggtcgttggtccaggccgtggggggtccctgacgactctcctgtgcagcctntggtattcacctttagtagtctagttggatgagcgtcgggtcccgaccgaggcctaccggaagggggaagggggtcgtagggggagggttcgggggtacggacccaaaacgaaagtaaaagaccgaaaggagtagggaaagtgaaagactaatactagtgtaggactcgtaggtaggaaacggggtcctaattccaaccctatcccgtaaccgaagaacgaacccgaaaccggaccaaaggacgtcctacacgttgtactcgtagaacaaaagtcgaaaccgcgtaccgtaggaacgtacgggtaaccggaaggaccgtacgggttcgttaaggttacgttaacgtttggttacggtaagggaccgtaacggtaaccccgttaccccgttaccccggttaagggttaatccggg

SEQ ID NO: 383512 - DNA, 773 bp, Homo sapiens
  misc_feature: GZ8MTXP01B4TPY.21.40.D07.1.454.CMB.2.raw
  modified_base (263)..(263): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctntggtacttcacctttagtagtctagttggatggagtcgtcgggtcccgccgagggcctaccggaagggggacgggggcgtaggggtaggtcgggggtcggacccaaacgaaagtaaaacggaccgaaaggtagtaggggaaagtaggaaaacggaacctaagttaaacttagttgggttacggtaccttcggttgggtaacgggaacgggggtccctaactttcccgaacctaacgttccctaaccccgaagggaaccgaaaccgaaaccggaccgaaaggacgtcccttacgtaaccgttaggttaacctcgttaagaaaccgtaaaagttacggaaaaccgtacggtcccgtaaggaacgggtacgggtaaacccgggaacgggaaccggtacccggggttgtttaggggttaactttaacggttttccggttagggtaaccgggacggtaacgggtaacccggtaccccgtttacccccccggttaacgggtttaagtaacccgggg

SEQ ID NO: 383513 - DNA, 691 bp, Homo sapiens
  misc_feature: GZ8MTXP01BW9FR.21.40.D07.1.454.CMB.2.raw
  modified_base (282)..(282): a, c, t, g, unknown or other
  modified_base (577)..(577): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagtcgttgggttttccttgttgtcttattttagaaggtgtccagtgtgaggtgcagcgtggtggaggttcggtgggggaggtcgttgggtccaggccggtggggggtccctggacgtactctcctgtcgcagcctntggtattcaccgtttagtagtctagttggatggagtcgtgggtcccgaccgaggccgtaccggagggggacgggggtctgggacggtggggtacgaccaaacgagtaaaaggcccaaaggagttaggggaaagtgaaaacgactaattacgtaagtggtacgggtacttgtagggtaggaacggggtccctaattacccgacctactccgtacccgaaggaacgaaccaaaccggaccaaaggtcgtacctacggtacttaggttacctacgtacgaaactaaagtcgaaaccgngtcccgtaggaagtcgggtaacggaacggaccgtaccgggttgttaggttacgttacgttcgttggtaacgacgtaacgacccgttaccgttccccggtaaggttaacgtaacg

SEQ ID NO: 383514 - DNA, 619 bp, Homo sapiens
  misc_feature: GZ8MTXP01D86B9.21.40.D07.1.454.CMB.2.raw
  modified_base (261)..(261): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcctgttgctattttagaggtgtccagtgtgaggtgcagctggtggagtcgtgggggagcttggtccagccgtggggggtccctgagactctcctgtgcagcctntggattcacctttagtagctattggatggagtctggggtccgccaggcctccggagggggaaggggctgggaggtgggggtggacccaaagagtaaagccaaaggagtagggaaagtcggaaagaacaattactagtggtagggaccttgtggtaggaagggggtccaattcaacctattcctacccgagacgaacaaaccgccaaaggacgcctacgaacttgttaactccgtagaccaaaagtgaaacagtccctagaaggtagtaaccggaagggaccaacggggttctgggttattaacgttcgttgggtaagacgaaggtacggacccttccccggtaacggttaagtaacgg

SEQ ID NO: 383515 - DNA, 655 bp, Homo sapiens
  misc_feature: GZ8MTXP01ADTJK.21.40.D07.1.454.CMB.2.raw
  modified_base (524)..(524): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggtcttggtccaggccgtggggggtccctgagactctcctgtcgcagcctcgtggattcacctttagtagctattggatggagcgtgggtcccgcgaggcctaccggaggggagggggcgtgggaggtgggggtcgaccaaacgaagtaaacggaccaaaggagtagggaaagtggaaagaactaatacgtagtggtacggtaccttggtgtacgggaaacgggtcccgtaatttcccgaacctagtcccgtacccaaggtaacgaaccgaaaccgacccgaaagacgtcctacgtaacgttgttacnccgttaacgactaaagtccgaaaacgcgtacccgtaggaacggtcggaacggaacggacgtacggttcgtgttacggttattcggaggtcggcgaacggtacgtcccgttaccccgtcgggttaatccggg

SEQ ID NO: 383516 - DNA, 671 bp, Homo sapiens
  misc_feature: GZ8MTXP01C6DLR.21.40.D07.1.454.CMB.2.raw
  modified_base (269)..(269): a, c, t, g, unknown or other
  modified_base (511)..(511): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtgggaggtcgtggggggaggcgttggtccagccggtggggggtccctgagactctcctgtgcagcctntggattcacctttagtagctattggatgagcgtgggtccgccaggctaccgagggggaaggggcgtgggaggtggggtggaccaaacagtaaacgccaaaggagtggaaagtgaaagacaataactagtggtagtactcgtaggtaggaaacggggcctaattaccacctaattcccaccgaagaacgaaccaaacggacctaaaggacgtccctacggtaacttggtaacttccggtaaanaaacgtaaaagtacggaaaaccgtcgtaccgtagggaacggtacgggtaacggaacgggaccgtacggttgtttagggttaacgtttaacgttcggttacgggtaaggacggtaacggtaaccggtaccccgttaccccggttaagggttaacgtaaggg

SEQ ID NO: 383517 - DNA, 600 bp, Homo sapiens
  misc_feature: GZ8MTXP01DBN17.21.40.D07.1.454.CMB.2.raw
  modified_base (298)..(298): a, c, t, g, unknown or other
  modified_base (364)..(364): a, c, t, g, unknown or other
  modified_base (558)..(558): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagctgggttttcctgttgctattttagaaggtgtccagtgtgaggtgcagctggtggagtcgtgggggagcttggtccagccgtgggggtccctgagctctcctgtgcagcctctggattcactttagagtctattggatgagcgtgggtccncaggcctacgaggggagggctgggagtgggtgaccaacataaagccaagagtaggaagtgaagacntactagtgtaggactcgtggtagaacggggcctattccgacctatccctaccgaggtacgaaccaaaccggccaaaagggctcccttacgaaacctttggtaacttccgtagaaccctaaaagttccgaaaactcgacccgttaggaacgacggtaacggaagaccgacgggttcttggtaagttacttttcgngtaacggacgaagtcgtaccgttcccccgtgttaagtaacgg

SEQ ID NO: 383518 - DNA, 645 bp, Homo sapiens
  misc_feature: GZ8MTXP01BRYOS.21.40.D07.1.454.CMB.2.raw
  modified_base (414)..(414): a, c, t, g, unknown or other
  modified_base (576)..(576): a, c, t, g, unknown or other
  modified_base (583)..(583): a, c, t, g, unknown or other
  modified_base (603)..(603): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggaggtcttgggtccaggccggttcgggggggtcccctggagactctcctggtgcagcctcgtggtacttccacctttagtagtcttagttggatggagtcgtcgggtcccgccgaggccgtaccggaagggggacgggggcgtggggaggtggggtcgacctaaagataaacgccgaaagagtaggaagtgaaagaacngtactagtggtagactcgtgtacgggaacggggccctaattccgaacctatccgaccgaagacgaaccaaccgaccaaagacgcctacggaacttgggtaactcgtaacaactaaaagtcgaaaacctcgtacccgtaggaacgacggtaacggaaggaccncgggttnttaggttagttaactttcgnggtgacgtaaggaactccgttccccgtaacggttaagtccgg

SEQ ID NO: 383519 - DNA, 670 bp, Homo sapiens
  misc_feature: GZ8MTXP01CB6X5.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggagtcgtgggggaggtcgttggtccaggccgtcggggggtccctgacgtactctctgtgcagcctcgtggtattcactttagtagtctagttggatggagtcgtcgggtccgcgaggcctccggagggggagggggtcgtggggaggtggggtacgaccaaacgaagtaaagaccgaaaggagtagggaagtagaaagtaactaatacgtagtggtggacttcgtaggtaggaacggggtcctacttccaacctctccgtaacccgaagaaacgaaccgaaaccgaccaaaggtcgtacccttacgtaacgtttgttactaccgtagaaacctaaaagtacgaaacgacgtccgtaggaacggtacggtaacgggaacggacgtacgggttcgtttaggtacgtttaacgttacgttgtggacgtaagtccgtacccgttccccggtaacggttaagtaacggg

SEQ ID NO: 383520 - DNA, 682 bp, Homo sapiens
  misc_feature: GZ8MTXP01ADUJI.21.40.D07.1.454.CMB.2.raw
  modified_base (270)..(270): a, c, t, g, unknown or other
  modified_base (286)..(286): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtcagtgtgaggtgcagcgtggtggagtcgtggggggagtcgttggtccaggccggtggggggtccctgacgtactctcctgtgcagcctntggtattcactttagnctagtgatggagcgtggtccgccaggcctacggaagggggacggggcgtagggaggtggggtggaccaaagaataaaggccgaaagagtagggaagtgaaagtaactaattacgtaagttggtacgggaacttcggtggttaaggggaaccggggtcctaatttcccgaacccttaaatccctaaccgaaaggaacgaacccgaaacggtacccaaaggactcctaacgacttaggtattacccgaagaacctaaaagtcgaaaaccgcgccgtagggaaacgacgggtaagggaaccggacggacccggggtttcgttaggtttaacgttacgttcggttaggaacggtaccgtaacggtaacccgtccccgttacccggttaacggttaagtcg

SEQ ID NO: 383521 - DNA, 697 bp, Homo sapiens
  misc_feature: GZ8MTXP01BJQCC.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgttgggttttccttgttgctattttagaaggtgtccagtgtgaggtgcagcgtggtggagtcgtgggggaggtcttggtccagccggtcgggggtccctgagctctcctgtcgcagcctcgtggtacttcctacctttagtacgtctattggatgagtcgtcgggtccgcgaggccgtaccggaagggggacggggtcgtggggtaggttgggggtacggaacccaaacgaagtaaacgaccgaaaggtagtagggaagtagaaagaactaagttaacgttagtggtaggtacgttcgtagggtagggaacggggtcctaacgttccaaccgtacttcccgtaaccgaaggaacgaaaccgaaaccgacccgaaagacgtacccttacggaacgtttagtacctacgtacgaaactaaagtccgaaacgcgtccgtaggaacggtaggtaaccgggaagttaacggaccggttgttaggttagttaacgtttcgttagggtggtaccgaaggtacgtacccgttcccccgtaagggttaactaacggg

SEQ ID NO: 383522 - DNA, 593 bp, Homo sapiens
  misc_feature: GZ8MTXP01DRZHL.21.40.D07.1.454.CMB.2.raw
  modified_base (310)..(310): a, c, t, g, unknown or other
  modified_base (532)..(532): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgtagcgtggtggagtcgtgggggagcttggtccagccgtgggggtccctgagactctcctgtgcagcctcgtggtattctaccttagagcttagttggatgacgcgtggggtcccnccgaggcctccggaagggggaaggggctgggaggtggggtcggaccaaacaataaagacaagagtaggaagtgagaacaataactagtggtagtactcgtggtaggaacgggccctattaccgactatcctaccgaagacaaccgaacgccaaagcgtactccaacgttgtactctagaacaaatgaaccagcctaggagtacggtcggaacgacacgggtnttggtattagttgttggttacgaacggtagaaccgtaccctccccggttaggtaagcgtcg

SEQ ID NO: 383523 - DNA, 657 bp, Homo sapiens
  misc_feature: GZ8MTXP01AJWUH.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagagctattggattgagcgtcggggtcccgcgaggctccgagggggaagggggcgtgggggtaggtcggggtacgaccaaacgtaaagtaaagaccgaaagtagtagggaagtaggaaacgaactaatacgtagtggtacggtacttgtagtagggaacggtccgtattaccactaactccgaccgagacgaccaaccgactaaagcgtaccacgtacgtagttaactctacggaaactaaacgtacgaaacgccgtaccggtagacgggttacggtaacggacggggttaaacgtcggttcgttaagggttctttaacgttacggttggtccggaggaacgtacggtaccccttccccgggttaaccgggaaatccggg

SEQ ID NO: 383524 - DNA, 720 bp, Homo sapiens
  misc_feature: GZ8MTXP01BFH7R.21.40.D07.1.454.CMB.2.raw
  modified_base (259)..(259): a, c, t, g, unknown or other
  modified_base (419)..(419): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcacatggaattggggctgagctgggttttccttgttgctattttagaaggtgtccagtgtgaggtgcagcgtggtggagtcggtgggggagtcgttggtccgagccgtgggggtccctgagctctctgtgcngtcctgtggtattcacctttagtagcttagttggatggagcgtcggggtcccgccgtacgggccgttaccggaagggggaacgggggtcgtagggggtagggttcgggggtacgaccctaaacgaaagtaaacgaccgaaaggagtagggaagtagaaanactaattaactagtacgtaggacttcgtgtagggtaaacgggcctaacttccaacgtattcccaccgaaaggaacgaaccgaaaccgaccgtaaaggacgtaccctaacgtacgtttacggttaactccgttaaagaaccctaaaagtacggaaaccgcggtaccggttaggaacggtaacgggtaacccgggaaagggttacccgtcccgggttagttaggttagtttaaccggttgttaggggtcaacgggtaagtaacccgttaccccgttacccccgtaagggttaacgtaaccggg

SEQ ID NO: 383525 - DNA, 570 bp, Homo sapiens
  misc_feature: GZ8MTXP01ALVZ2.21.40.D07.1.454.CMB.2.raw
  modified_base (264)..(264): a, c, t, g, unknown or other
  modified_base (361)..(361): a, c, t, g, unknown or other
  modified_base (470)..(470): a, c, t, g, unknown or other
  modified_base (487)..(487): a, c, t, g, unknown or other
  modified_base (509)..(509): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgttgggttttccttgttgcttattttagaaggtgtccagtgtgaggtgcagcgtggtggagtcgtgggggagtcgttggtccaggccgtgggggtccctgagactctcctgtgcngtcctgtggattcacctttagtagtcttattggatgagcgtcggtcccgcgaggctaccggaagggggacgggcgtgggaggtgggtacgaccaaanaagtaaagccaagagtaggaagtgaaagacaatactagtgtagactcgtggtacgagggctattcacctatcctacgagaacacaacgccaaagcgtactactatgtancgtagactaaagcaacngtctaggatggaacgacggacncgttcgtagtagttacgttcgttgtgacgaacgtacgccttaccccgtggttaactaacgg

SEQ ID NO: 383526 - DNA, 597 bp, Homo sapiens
  misc_feature: GZ8MTXP01BRQXQ.21.40.D07.1.454.CMB.2.raw
  modified_base (484)..(484): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagctctcctgtgcagcctctggattcacctttagtagctattggatggagcgtgggtcccgccgaggctccgagggggaggggctgggaggtggggtcgaccaaacgagtaaagccaaagagtaggaagtgaagacaatactagtgtgtactcgtgtggaagggcctattccacctagtctaccgagacgaacaaccgaccaagacgtccactacgttgtaactcgtagacaaatgaaacngcctaggacgaggtccggaaggaccacggggttcttagggttacgttaaagtttcgttaggtcgggcggtaacggtacgtacccgttccccccggtaagggttaataaccggg

SEQ ID NO: 383527 - DNA, 626 bp, Homo sapiens
  misc_feature: GZ8MTXP01B2MKN.21.40.D07.1.454.CMB.2.raw
  modified_base (485)..(485): a, c, t, g, unknown or other
  modified_base (523)..(523): a, c, t, g, unknown or other
  modified_base (562)..(562): a, c, t, g, unknown or other
  modified_base (579)..(579): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggaggtcttggtccagccggttggggggtccctggagactctcctgtgcagcctctggacttcacctttagatctattggattggagtcgtcggggtcccgccgaggcctccggaagggggaacgggggtcttggggaggtgggggtacggaccaaacaagtaaaaggccaaaggagtgggaagtgaaacgactaatactagtgtaggactcgtgtaggaacggggccctagttccaacctatcctaccgagacgaaccaacgccaaagngcctacgaacttgtaactcagtaccaaaagtcgaaacncgtccgtagaaggcggtaacggaaggaccaaccgggttnttggtagttacgttcgnggtcgacggaacgtacgtcccgttaccccgtaacggttaacgtaacg

SEQ ID NO: 383528 - DNA, 708 bp, Homo sapiens
  misc_feature: GZ8MTXP01EQBW5.21.40.D07.1.454.CMB.2.raw
  modified_base (254)..(254): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctccngtgcagcctctggattcacctttagtacgtacgtagtgtagtgacggtcggtccggtcccggaccggacggtaccggtaccgggacgggggagggggtacggtagggtagggtacggggtacggcaaacccgaaagtaaaaggacgaaaggaagtaaagggtaaaggtaaggaaagaacgtaaacgtaacttaagttaggtagggtaacgttacgttaggttagggaaacggggaccggtacgttacctaaccgtaactacctaccgacgaacgaaaccgaaaccgaacccgaaacgggaacgacctacctacgtacgttaacgttccgtacgaacgaaacgtaacgaaacgaacgaccgtaacggaacggaggtacggaacggaacgaaccggttcgttggttagttaagttacgttcggtcggtacggacggtaacgttaaccgtaaccccg

SEQ ID NO: 383529 - DNA, 643 bp, Homo sapiens
  misc_feature: GZ8MTXP01D9V7I.21.40.D07.1.454.CMB.2.raw
  modified_base (257)..(257): a, c, t, g, unknown or other
  modified_base (359)..(359): a, c, t, g, unknown or other
  modified_base (517)..(517): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcngcctcgtggtattctacttagtatctattggatgagtcgtggtccgcgaggccgtaccggaaggggaacgggggtcgtgggtaggtggggtacgaccgaaanaagtaaacgacgaaaggtagtaggaagtgaaagactaagtactagtgtagacctgtgagaacgggctagttacacctagttccacgtaagacgaaccgaacgaccgaaagaccgtactacgtacttagtactcgtaacgaacgtaaatcgaaaaccgngtacccgtaggaacgtagggtaaccgaacgggttacgtacccgggttattggttaacgttaagtttccgttaggtaacggtacgaaggtaccgtacccgttccccggttaacgttaagttaaccgg

SEQ ID NO: 383530 - DNA, 592 bp, Homo sapiens
  misc_feature: GZ8MTXP01BI4XN.21.40.D07.1.454.CMB.2.raw
  modified_base (343)..(343): a, c, t, g, unknown or other
  modified_base (410)..(410): a, c, t, g, unknown or other
  modified_base (485)..(485): a, c, t, g, unknown or other
  modified_base (549)..(549): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggtttccttgttgctattttagaaggtgtccagtgtgaggtgcagctggtggagtcgtgggggaggtcttggtccagccgtggggggtccctgagactctcctgtgcagcctcgtggtattcacctttagagtctattggatgagcgtgggtcccgcaggctcggaggggagggctgggagtgggtgacaanagtaagcaagagaggaagtgaaagacaatactagtgtgactgtggtagaacgggctatccgaaactnttccataagcaaaccgaagcccaaggacgtcccacgtaacgtgttaactcgtacgaaacaaagtacgaaacccgngtcccgtagggagtaccggaaggtaacgggaactaccgggttgttagtacgttacgttcgcggnggacgaacgttacccgtcccgttaccccggtaaggttaagtcg

SEQ ID NO: 383531 - DNA, 615 bp, Homo sapiens
  misc_feature: GZ8MTXP01DEJTX.21.40.D07.1.454.CMB.2.raw
  modified_base (268)..(268): a, c, t, g, unknown or other
  modified_base (284)..(284): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggtttttccttgttgctattttagaaggtgtccagtgtgaggtgcagctgggtggagtcgtgggggagtcttggtccagccggtggggggtccctgagtctctcctgtgcagcctntggattcactttaganctattggatgagcgtgggtccgcgaggctacgagggggaggggctgggaggtgggtacgaccaaacgagtaaagccaaggagtgggaagtgaagacaagtactagtggtaggacttcgtaggtagggaacgggtccgtatttcgacctatacctaccgaagacggaaccaaaccggccgaaagacgtcctacgtaacgttcgttaactccgtaagaacctaaaagttcgaaaacgcgtaccgtaggaacggtaggtaacggaggaaccgtacggcttaggtgttaagttcgttgtggacgaagtacgccgttccccgtgttaacgtaacgg

SEQ ID NO: 383532 - DNA, 605 bp, Homo sapiens
  misc_feature: GZ8MTXP01EMSFH.21.40.D07.1.454.CMB.2.raw
  modified_base (271)..(271): a, c, t, g, unknown or other
  modified_base (370)..(370): a, c, t, g, unknown or other
  modified_base (515)..(515): a, c, t, g, unknown or other
  modified_base (526)..(526): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgcttattttagaaggtgttcagtgtgaggtgcaggctggtggagttcgtggggggaggtcttgggtccaggccgtggggggtccctgagactctcctgtgcagcctntggattcacctttagtagtctattggatggagcgtggggtcccgccgaggcctccggaagggggaagggggctgggggaggttgggggtggacccaaanaagtaaagaccaaaggatgggaaagtgaaagactaatactagtgtcggactgtggtaggaagggcctattcacctatcctaccgaagacaacgaacgccaaaagtcgcctacggaacttgtaactcgtagacaaaagtgaaaccngcctagaaggngtaaccggaaggaccaccgggttgttagtagttagttcgttgtgacgaagacgtaccgttccccggttcggttaatcgg

SEQ ID NO: 383533 - DNA, 663 bp, Homo sapiens
  misc_feature: GZ8MTXP01DKXHQ.21.40.D07.1.454.CMB.2.raw
  modified_base (271)..(271): a, c, t, g, unknown or other
  modified_base (288)..(288): a, c, t, g, unknown or other
  modified_base (312)..(312): a, c, t, g, unknown or other
  modified_base (366)..(366): a, c, t, g, unknown or other
  modified_base (549)..(549): a, c, t, g, unknown or other
tcagtcgtcgctcgcacgaccggtgctcgatttagtgatagagcgtaacaacagaggggagagaggagccttagccctggactccaaggccttttccacttggtgatcagcactgagcacagaggactcaccatggaattggggctgagcttgggttttccttgttgcttattttagaggtgtccagtgtgaggtgcagcgtgggtggagtcggtgggggagtcgttggtccaggccgtggggggtccctgacgactctctgtgcagcctntggtattcactttaganctattggatgagcgtcgggtcccnccgaggcctaccggagggggaagggggctggggaggtggggtacggacccaaanagtaaagaccgaaaggataggggaagtgaaagaacgtaatacgtagtggtcgggaccttgtgggtagggaaacggggtcctaactttccaacctacttacccacccgaaggaacgaaaccgaaaccggaccaaagacgccttacgtaacgttgtaaatccgtagaaactaaactgaaaaaccncgtacccgtaggaaacggtacggtaacggaaacggaccgtaccggttgttaggttagttaacgttgttcggtaaggacgaaggtacgtcccttacccccggtgttaacgaacgg

SEQ ID NO: 383534 - DNA, 597 bp, Homo sapiens
  misc_feature: GZ8MTXP01DLI4B.21.40.D07.1.454.CMB.2.raw
  modified_base (480)..(480): a, c, t, g, unknown or other
  modified_base (513)..(513): a, c, t, g, unknown or other
  modified_base (546)..(546): a, c, t, g, unknown or other
  modified_base (565)..(565): a, c, t, g, unknown or other
  modified_base (595)..(595): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggaggtcgttggtccagccggtggggggtccctgacgactctcctgtgcagcctctggtattcacctttagtagtcttattggatggagtcgtcgggtcccgccaggcctaccggagggggacggggcgtagggaggtgggggtacgaccaaacaagtaaagacgaaaggagtagggaagtgaaagactaatactagtggtagtactcgtgtacgggaacgggtcctattaccaacattccaaccagacaacaacgaccaaagcnctacgacttgtactcgtagaacaaatcgaaacncggtctaggaacgaggtaacggaggacgcgttnttgtacttagttcgttggngacgaagccgtacttccccgtaaggttaancg

SEQ ID NO: 383535 - DNA, 655 bp, Homo sapiens
  misc_feature: GZ8MTXP01AGGKP.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggagtcgtgggggagtcttggtccaggccgtgggggtccctgagtctctctgtgcagcctcgtggtattccacctttagacgtcttagttggatgagtcgtcgggtcccgcgaggcctaccggagggggacggggcgtgggaggtcggggtacgaccaaacgaagtaaagccaaagagtaggaagtgaaagaactaagtactagtggtaggacttcgtaggtacggaacgggtccgtaattaccaacctacttccgacgagaacgaaccgaacgacccgaaagacgtacctactacgttagttactcgtagaacctaaagcgaaaccgacgtaccgtaggaaacggtcggtaacggaacggaccggtaacggttccgttaggttagttacgtttacgcgggtaagaccgaaggtacctacccgttcccccggtaaggttaacgtaacggg

SEQ ID NO: 383536 - DNA, 586 bp, Homo sapiens
  misc_feature: GZ8MTXP01DIXJJ.21.40.D07.1.454.CMB.2.raw
  modified_base (303)..(303): a, c, t, g, unknown or other
  modified_base (345)..(345): a, c, t, g, unknown or other
  modified_base (419)..(419): a, c, t, g, unknown or other
  modified_base (425)..(425): a, c, t, g, unknown or other
  modified_base (442)..(442): a, c, t, g, unknown or other
  modified_base (455)..(455): a, c, t, g, unknown or other
  modified_base (467)..(467): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctggttttctgttgctatttagaagtgtccagtgtgaggtgcagctggtggagtcgtggggggagcttggccaggccgtggggggtccctgagactctcctgtcgcagtcctgtggtattcactttagagtcttagttggatgagcgtgggtccncgaggctacggaggggagggctgggagtgggtagacctaaanataaacggacaaaggtagtggaaacgtgaaagactaatacgtagtggtagtactgttggagacgggctatcacntaccanagacaacacgacctaancgctacgtaagtntaacttccgaanaactaactaacgaacgacgtacgtagaggacggtaacggaacggacgacgttacgttagttagttaacgttcgttagtaagtacgaacgacgtaccgttacccgtaacgttaacgtaag

SEQ ID NO: 383537 - DNA, 700 bp, Homo sapiens
  misc_feature: GZ8MTXP01CT0W1.21.40.D07.1.454.CMB.2.raw
  modified_base (279)..(279): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggacctcaccatggaattggggctgagctgggttttcttgttgctattttagaggtgtccagtgtgaggtgcagctggtggagtcgtgggggaggtcttggtccagccgtggggggtccctgagactctcctgtgcagcctctggattcactttagnctattggatgagcgtcgggtccgccaggctaccgagggggaggggctgggagtgggggtcgaccaaacgagtaaaacgcctaaaggagtagggaaagtggaaacgactaattactagttcggtaggtacctcgtaggtagggaacggggtccctaattccactaattcccgtaccaaggacgaaacccgacgacccgtaaaggacgtaccttacgtaacgttggtttaacttccgtaacggaaaccaaaagtcgtaaaacccgcggacccgttaaggaaacggtgggtaaccccgggaaggaaaccccggtccggggaaccgttttgggtaacccgtttaagtttaccggttggggttcgaacccgggttaaggaaacccgtccccggtttaccccctaaccgggggtttaaagtcccggg

SEQ ID NO: 383538 - DNA, 569 bp, Homo sapiens
  misc_feature: GZ8MTXP01CUJSJ.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcctgttgctattttagaaggtgtccagtgtgaggtgcagctggtggagtcgtggggggaggcttggtccagccgtggggggtccctgagactctcctgtgcagcctctggattcacctttagtagctaattggatgagctgggtccgcaggctccggaggggacggggcgtgggaggtgggtcggaccaaacagtaaagccaaaggagtaggaaagtgaaagacaatactaagtggtagactctggtaggaacgggcgtacttcgaccagtcctacgagacgacaacgccaagacgacctcacttgtactactagacaaatcgaaacacgtcctaggacgaggtcgaagggacacgggcttaggtgttagttacttgtgacgaagacgtcttaccccgtcggttaataacgg

SEQ ID NO: 383539 - DNA, 670 bp, Homo sapiens
  misc_feature: GZ8MTXP01DLWRB.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggaggtcgtggggggaggtcgttggtccaggccgtcggggggtccctggagactctcctgtgcagcctctggacttctacctttagtagtctagttggatggagtcgtcgggtccgcgacggccgtaccggaagggggaacgggggtcgtcgggggtaaggtgggggtacggacccaaacgaagtaaaaggacccgaaaggagtagggaaagtgaaagactaagtacgtatggtaggactcgtggtacgggtaacgggccgtaattccaaccgtattccgtaccgaagaacgaaccgaaaccgacccaaagacgtcccgtataaccttggttaactccgtagaaccaaagtacgaaaactcgaccgttaggaagcgggtaacggaacggaccgtaacggttcgttagttaggttacttacgttggtaagacgaacgacgtcccgttaccccgtggttaacgtaacgg

SEQ ID NO: 383540 - DNA, 589 bp, Homo sapiens
  misc_feature: GZ8MTXP01C80PT.21.40.D07.1.454.CMB.2.raw
  modified_base (264)..(264): a, c, t, g, unknown or other
  modified_base (305)..(305): a, c, t, g, unknown or other
  modified_base (353)..(353): a, c, t, g, unknown or other
  modified_base (500)..(500): a, c, t, g, unknown or other
  modified_base (550)..(550): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagtcttggtccagccgtggggggtccctgagactctcctgtgcagcctntggattcactttagagtctagttggatggagcgtcgggccnccgaggctaccggagggggagggcgtgggaggtggggtcgacctaaanataaagccaaggatagggaagtgaaagactgtactagtggtaggactcgtggtaggaacgggcctaattccaactacttccaaccgaagtacgaaccaacgacctaaagagcctacgtacgttgtaatccgtagaacaaatgaaacncgctaggacgaggtaaccggaggaccgtaggttcttgggtattagttcgnggtccggagtggacgtaccttccccgttcgggaatcggg

SEQ ID NO: 383541 - DNA, 495 bp, Homo sapiens
  misc_feature: GZ8MTXP01BG6HO.21.40.D07.1.454.CMB.2.raw
  modified_base (197)..(197): a, c, t, g, unknown or other
  modified_base (252)..(252): a, c, t, g, unknown or other
  modified_base (270)..(270): a, c, t, g, unknown or other
  modified_base (435)..(435): a, c, t, g, unknown or other
  modified_base (473)..(475): a, c, t, g, unknown or other
  modified_base (477)..(495): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtcccctgaccgattcnctggctccaattctggcacctcagcctcctgccatcagtgggctccggtcgaggntggaggctgtattatacngtgcagctatggtgagtcggacggtcctggtaggttcgggtccgggttggttccgggcgggacgggacccagggcgtcggaccgtcgtacgtccaccggtccgaggcctcccgcccccgtcggtccacctctccgttcccccaccctccgtccgaacgcgaccgngtcggacggccgggagtcggacgaagggcgacgagtgnnngnnnnnnnnnnnnnnnnnnn

SEQ ID NO: 383542 - DNA, 519 bp, Homo sapiens
  misc_feature: GZ8MTXP01ABYG5.21.40.D07.1.454.CMB.2.raw
  modified_base (298)..(298): a, c, t, g, unknown or other
  modified_base (332)..(332): a, c, t, g, unknown or other
  modified_base (446)..(446): a, c, t, g, unknown or other
  modified_base (463)..(463): a, c, t, g, unknown or other
  modified_base (470)..(470): a, c, t, g, unknown or other
  modified_base (478)..(478): a, c, t, g, unknown or other
  modified_base (480)..(480): a, c, t, g, unknown or other
  modified_base (484)..(484): a, c, t, g, unknown or other
  modified_base (492)..(492): a, c, t, g, unknown or other
  modified_base (494)..(494): a, c, t, g, unknown or other
tcagtcgtcgctcgcacgaccggtgctcgatttagtgatagagcgtaacgaacagaggggagagaggagccttagccctggactccaaggcctttccacttggtgatcagcactgagcacagaggactcaccatggaattggggctgagctgggttttcctgttgctattttagaaggtgtccagtgtgaggtgcagctggtggagtcgtgggggagcttggtccagcctgggggtccctgagactctcctgtgcagcctctggattcacctttagagctattggatgagctggtccncaggctcgagggagggctggagtgggtgaccaanagtaaagccaaagatggaaagtgaaagacaatactaagtgtagggactcgtgtgaacggggtccaattcaaccattcctacgtagagacaacggccaaagcgtctcaatgtaanctagaccaatgaaaccngctgagngcgagacngntgtnttagttcngngcgaagacgtcttcccgtgttaatg

SEQ ID NO: 383543 - DNA, 659 bp, Homo sapiens
  misc_feature: GZ8MTXP01B1ZHD.21.40.D07.1.454.CMB.2.raw
  modified_base (569)..(569): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtgggggagcgttggtccaggccgtgggggtccctgagactctcctgtgcagcctctggtacttcacttagagctattggatgagctcgggtccgccgaggctccggagggggaggggctgggaggtgggtcggaccaaacgaagtaaacgccgaaaggagtagggaaagtagaaaacgtaactaacgtaagtaggtcggtacgtacgtacggtgggtaaacgggaccggtcttaacctacccgaacttacgttacccgaacggaacgaaaccgaaaccgaccgttaaaccgaaggtaccgtacccttacgtaacgttagtaaccgtaacgtaaaagtaaacgaacgaactacccggttntaagggacgtacggacggaacgacgttacggtgttagtacttcgttacgttggacgtaagactaacgtccctcggttacgtgaacgtcgg

SEQ ID NO: 383544 - DNA, 702 bp, Homo sapiens
  misc_feature: GZ8MTXP01ER2O5.21.40.D07.1.454.CMB.2.raw
  modified_base (614)..(614): a, c, t, g, unknown or other
  modified_base (633)..(633): a, c, t, g, unknown or other
  modified_base (645)..(645): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggagtcggtgggggaggtcgttgggtcccgaggccggttcggggggtcccctggacgtacctctcctggtcgcaggcccttcgtggtacttctaacctttagtagtctagttggatggagtcgtgggtcccgccgaggccgtccggaagggggacgggggtcgtgggagggttggggtcggaccaaacgaaagtaaacgaccgaaaggagtaggggaaagtaggaaaacgtaactaagttaactaaggtggtacggtaaccttcggtagggtaagggtaacgggtccctaattccccaacttactccgaaccgaaggaacgaacccaaaccgaccgaaaggacgccctacgaacgttggttaaacgccgggaaactaaagtacgaaacgacggtccgtaggaggtacgnggaacggacgttccgggtnttggtaaagttnttaaacggttgttacggaacgagaacgtacccctcccggttacgttaagaacgggcg

SEQ ID NO: 383545 - DNA, 660 bp, Homo sapiens
  misc_feature: GZ8MTXP01CHG4P.21.40.D07.1.454.CMB.2.raw
  modified_base (552)..(552): a, c, t, g, unknown or other
  modified_base (620)..(620): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagctggttttctgttgctatttagaagtgtcagtgtgagtgcagcgtggtggagtcgtgggggagtcgttggtccgaggtccggtggggggtccctaggacgtacttcgtcctggtcgcagtcctcgtggtacttcaacctttagacgcttagttggatggagtcgtcgggtcccgcgagggctaccggaagggggacggggcgtaggggaggtcgggggtacgaacccaaaagaaagtaaaacggccgaaaaggagttagggaaagtggaaaagaacctaagtaacgtagtggtaggtaacttcgtaggtaacggaaacgggcctaattccaaaccgtattccaaccgaaggaacaaaccgaaccggactaaaggctacctacaacgttaggtaacttccggaaanaaacaaacgtacgaaacgcgtacgagaacgacggaacggaacggacgtcgttgtagttattacgttgngaacgaggtaacgaccgtacccgttcccgtaagttgaagg

SEQ ID NO: 383546 - DNA, 639 bp, Homo sapiens
  misc_feature: GZ8MTXP01E2VY4.21.40.D07.1.454.CMB.2.raw
  modified_base (259)..(259): a, c, t, g, unknown or other
  modified_base (368)..(368): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagtcttgggttttccttgttgcttattttagaaggtgtccagtgtgaggtgcagctggtggagtcgtgggggagtcttggtccaggccgtgggggtccctgagctctcctgtncagcctctggtattcacttagtagctagtggatggagtcgtcgggtcccgccgaggccgtaccggagggggtaacgggggcgtggggaggtgggggtacgacccaaaanaagtaaagccgaaaggagtagggaaagtgaaagacaagttactagtggtgactcgtaggtagggacgggtccctaattaccaaccacttacccgtaccgaagaacgaaccgaaccgaccaaagacgtctacgtactgtactcgaacgaactaaagacgaaactcgccgtaggaacggtaggtaacggaacggaccgtacgggttgttaggttagttacgttgttcggcggacgtaacgaccgtacccgttccccgttaacggttaagtcgg

SEQ ID NO: 383547 - DNA, 556 bp, Homo sapiens
  misc_feature: GZ8MTXP01ASM9M.21.40.D07.1.454.CMB.2.raw
  modified_base (340)..(340): a, c, t, g, unknown or other
  modified_base (482)..(482): a, c, t, g, unknown or other
  modified_base (525)..(525): a, c, t, g, unknown or other
  modified_base (527)..(527): a, c, t, g, unknown or other
  modified_base (553)..(553): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctctggattcaccttagtagctattggatgagctggtccgcagctccgaaggggaagggctagggagtgggtagaccaaanaataaaaggcaaagagtaggaagtgaaagaacaatacgtatggtggactcgtgtagaaaggggccctatcaacctatctaccaagaacgacaaacggaccaaagacgctaccaatgtaatccgtagaacaaattcgaaaccngtaccagagagtaacgaggacaccggttgtagttattagttcngngacgaagactccttccgtcggttaanaag

SEQ ID NO: 383548 - DNA, 797 bp, Homo sapiens
  misc_feature: GZ8MTXP01EYGUS.21.40.D07.1.454.CMB.2.raw
  modified_base (275)..(275): a, c, t, g, unknown or other
  modified_base (386)..(386): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagtcttgggttttccttgttgcttattttagaaggtgtccagtgtgaggtgcagcgtggtggagtcgtgggggagcgttggtccgaggccggttggggggtccctgacgactctccgtgtcgcagcctntggattcacctttagagtctagtggatgagcgtcgggtcccgcgaggtccgtaccggaagggggaacgggggcgttagggggaggttcgggggtacggaaccccgtaaaanaaagttaaaacggaccgaaaaggtagttaaggggaaaggttaggaaaacgggaaccctaagttaaccgttaaaggttcggtacgggtaaccttcggtagggttacggggaaaccgggtaccgtaacttacccgaaacgtacttacccgaaccgaaacggaacgaaacccgaaaccggaaccccgaaaggtaaaccgtcctaccggtaaccgttaggttaacttccgtaacgaacgtaaaacgttacgaaaaccgtacggccgttaagggaaccggttaagggtaaccgggaacggttaaaccggacccggggttattagggttaaccgttaacggtttcgttagggtaaccggtacggaaagtacccgggtaccccttaccccccgggttaagggtttaacgtaacccggg

SEQ ID NO: 383549 - DNA, 626 bp, Homo sapiens
  misc_feature: GZ8MTXP01CWHEU.21.40.D07.1.454.CMB.2.raw
  modified_base (326)..(326): a, c, t, g, unknown or other
  modified_base (339)..(339): a, c, t, g, unknown or other
  modified_base (438)..(438): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattcacctttagtagctattggatgagctgggccgccaggctcgaggggaggggctgggngtgggtgaccaanataaagccaagatggaagtgaaagacaatactatgtaggactcgtggtcggaacgggccgtattaccacctattccctaccgaagacgaaaccgaaccnccgaaagacgtcctacgaactttggttaacttctagaaccgtaaaagtcggaaaaccgaggtccctaagggaaggaacgggttaaccggaagggttaccggaccggggttcttagggtagtttactttaacgttcgggtaagtacgaaggtacgacccttccccgttaaccggggttaattaaccggg

SEQ ID NO: 383550 - DNA, 747 bp, Homo sapiens
  misc_feature: GZ8MTXP01AUFAD.21.40.D07.1.454.CMB.2.raw
  modified_base (680)..(680): a, c, t, g, unknown or other
  modified_base (706)..(706): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggaggtcggtggggggagtcgtttggtccgaggtcccggttcggggggtccctggacgtaccttctccgtgtcgccacgtcctcgtggtacttcaccgtttagtagtcttagttggatggacgtcgtcgggtcccgccgacggccgtaccggaagggggacggggtcgtagggggtagggttcgggggtacggaacccaaacgtaaagtaaaacggaccgaaaggtaaggtagggaaacgtagaaacgaacctaataacgttagttaggtacgggtacttggttacgggtacgggaaaccggggtcccttaattcccaaccctattcccaacccggaaagacgaacccgaaaccgacccgaaagacgtccctaacgtacgtttacgtaacttccgaaagaaccgtaaaagttaccgaaaacggtcgtaacccggtagggaaccgggtaggtaaccgggaacgggaccgtaccggngtttagtacgttaacgttcgttaggngacggaacgtaacgccccgttacccgtcgggttaataacgg

SEQ ID NO: 383551 - DNA, 597 bp, Homo sapiens
  misc_feature: GZ8MTXP01A020K.21.40.D07.1.454.CMB.2.raw
  modified_base (279)..(279): a, c, t, g, unknown or other
  modified_base (454)..(454): a, c, t, g, unknown or other
  modified_base (545)..(545): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtcagtgtgaggtgcagctggtggagtcgtgggggagcttggtccagccgtgggggtcctgagactctcctgtgcagcctcgtggattcacctttagtanctattggatgagtcgtgggtccgccgaggctaccgagggggaaggggcgtgggaggtgggtgaccaaacaagtaaagccaaaggagtaggaagtgaaagacaagtacgtatggtaggactcgtaggtaggaacggggcctaatcaccgaatctaccagacgaccaaacgcaaganctacgactgtatctgaacaaagtacgaaactcgcctaggaaggcggtaacggaaggaaccgcgggttacttggttacgttaacgtttacgnggtcggaccgttaaggaccgtacccttccccccggtaagggtttaagaacgg

SEQ ID NO: 383552 - DNA, 631 bp, Homo sapiens
  misc_feature: GZ8MTXP01D5EM3.21.40.D07.1.454.CMB.2.raw
  modified_base (521)..(521): a, c, t, g, unknown or other
  modified_base (560)..(560): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggagcttggtccaggccgtgggggtccctgagactctcctgtgcagcctctggattcacctttagtagtctagttggatggagcgtgggtccgcgaggcctaccggaagggggaacggggtcgtgggtaggtcgggggtggacccaaagataaaagcccaaaggataggaagtcgaaagactaagtactagtgtaggacttcgtggtagaacggggcctagttccaacctagtcctaccgaagacggaccaacgaccctaaagacgtctacgacttgttaatccgtagaaacctaaagtcgaaaacncgtccgtaggaaggacggtaacgaaggttacgacggttnttgggtaatttacgttacgttgggccgtagaacggtacgtaacccgttccccgtaagggttaataaccggg

SEQ ID NO: 383553 - DNA, 676 bp, Homo sapiens
  misc_feature: GZ8MTXP01CWWSV.21.40.D07.1.454.CMB.2.raw
  modified_base (266)..(266): a, c, t, g, unknown or other
  modified_base (271)..(271): a, c, t, g, unknown or other
  modified_base (276)..(276): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggtttttccttgttgcttattttagaaggtgtccagtgtgaggtgcagctggtggagtcgtgggggaggtcgttggtccaggtccgtgggggggtccctgagctctcctgtgcngcctntggtntcaccttagtgctattggatggagtcgtgggtcccgcgaggctccggaggggagggggctgggaggtggggtcggaccgaaactagtaaaaggccgaaaaggtagtagggtaaggtagaaaacgaaccaattaactagttgggtaggacgttcgtgggtaggaacgggggtcccgtaattcccaaccgtactacctacccgaaaggaacgaacccaaaccggaccccaaaggaggtacccttaccgacgttaggttactaccgtagaaccgtaaattacgaaaccaggtacccgtaggaacggacggttaacgggaaacggttaccgacggttacgtggttacgttagttacgttggtaacgcgtaacggcgtaccttcccccggtaagttaagtaacgg

SEQ ID NO: 383554 - DNA, 590 bp, Homo sapiens
  misc_feature: GZ8MTXP01D4UQL.21.40.D07.1.454.CMB.2.raw
  modified_base (361)..(361): a, c, t, g, unknown or other
  modified_base (552)..(552): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggccagccgtgggggtccctgagactctctgtgcacgctctggacttcacctttagagtctagttggatggagtcgtcgggtcccgccaggtcctccggagggggtaagggggcgtgggacggtgggggtacggaccaaanagtaaagccaaaggagtaggaacgtgaaagacctaagtactagtgtgggactcgtaggtagaagggcctattcacatctacgagacgacaacgccgaagacgctacgactggtatacgtagaactaaagtgaaacgtacgccgtaggacgtaggccgaagggttacaccgggttgtaggtagttagttcgngtgacgtaacggacgtaccttccccgtaagttaagtcg

SEQ ID NO: 383555 - DNA, 631 bp, Homo sapiens
  misc_feature: GZ8MTXP01EACVM.21.40.D07.1.454.CMB.2.raw
  modified_base (482)..(482): a, c, t, g, unknown or other
  modified_base (497)..(497): a, c, t, g, unknown or other
  modified_base (583)..(583): a, c, t, g, unknown or other
tcagtcgtcgctcgcacgaccggtgctcgatttagtgatagagcgtaacaacagaggggagagaggagccttagccctggactccaaggccctttccacttggtgatcagcactgagcacagaggactcaccatggaattggggctgagtcttgggttttccttgttgcttattttagaggtgtccagtgtgaggtgcagcgtggtggagtcgtgggggagtcgttggccaggccgtggggggtccctgacgtactctcctgtcgcagcctcgtggtacttccacctttagacgtcttagttggatggagtcgtgggtcccgcgaggcctacggaagggggtagggcgtgggaggttggggacgaccaaagaagtaaagccaaaggatagggaagtcgaaagactaagtactagtggtagactcgtaggtagaacgggctattccactagttccaaccgagaacaccaaacgccaaagtacncctacggacttatancctaagacaaaagtcgaaaacctgcccgtaagggagacggtaacggaacggctaaccggttgttagttaaccgttaatttaccggngggtaacgacggtaacgtacccgtacccttccccggtaagttaagtcg

SEQ ID NO: 383556 - DNA, 667 bp, Homo sapiens
  misc_feature: GZ8MTXP01AKVFV.21.40.D07.1.454.CMB.2.raw
  modified_base (561)..(561): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggaggtcgttcggtccgacggtcccggtcggggggggttcccctaggacgtaccttccgttcccgttggtcgccacgtccccttcgtggtactttccgtacctttaaggtagtctagttggatggacgtccggtcggggtccccgccgacgggtccgtaccgggaaggggggaacgggggtcggtagggggagggttcgggggtacggaccaaacgtaaagtaaaacggacgaaaggagtagggaaagtgaaagacaatactagtgtcggactcgtgtagggacggtctatccgaactctctaccaagacgaacaaccgtacaaagcctactccatgtactcgtaanaacaagagaaacgcgtacgtaggacgtcggaacggcggacgcggttgtaggttattacgttcgttggtcggagaacggtaccgtcccgttacccggtaagaagtcg

SEQ ID NO: 383557 - DNA, 669 bp, Homo sapiens
  misc_feature: GZ8MTXP01AH11B.21.40.D07.1.454.CMB.2.raw
  modified_base (286)..(286): a, c, t, g, unknown or other
  modified_base (556)..(556): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggaggtcttggtccagccggtggggggtccctgacgactctcctgtgcagcctcgtggattcacctttagngcttagttggatgagtcgtcgggtccgcgacggctaccgagggggacgggggctaggggaggtggggtcggaccaaacgaaagtaaacggaccgaaaggagtaggggtaaagtcgaaaagactaatacgttagtggtacggtacttcgtagggtacgggaacggggtccctattacccgaaccgtattaccctaccgaagaccgaaccgaaccgaccaaagaccgtactactacgttagttactacccgtagaaccaaagtcgaaaaccncgtccgtaggaacgtcggttaacggaacttacggcggttccgttagggttactttacgttcgttaggtaacgagtaagccggtacccttccccgggtaacgttaagtaaccgg

SEQ ID NO: 383558 - DNA, 623 bp, Homo sapiens
  misc_feature: GZ8MTXP01B8ACJ.21.40.D07.1.454.CMB.2.raw
  modified_base (511)..(511): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggagtcttggtccaggccgtggggggtccctgacgactctcctgtgcagcctctggattcactttagtagctattggatgagcgtggtccgccaggctccgaggggagggctgggagtgggtgaccaaacagtaaaagccaaaggagtagggaaagtgaaagaacaatactatggtaggactcgtaggtaggaaacggggccctaattcccaaccgtattcccgtaaccgaaggaacgaaaccaaaccgaccaaagacgcctacgaacttgtaactcgtagaccaaaatcgaaaacncgtactaggacgacggtaacggaacgaccgtacggttcgttaggtacgttaacgttcgttggtaacgacggtaacggtaccgtacccgttacccccggttaaggttaagtcg

SEQ ID NO: 383559 - DNA, 664 bp, Homo sapiens
  misc_feature: GZ8MTXP01DV2W7.21.40.D07.1.454.CMB.2.raw
  modified_base (279)..(279): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagtcttggtccagccgtggggggtccctgagactctcctgtgcagcctctggattcactttagngtctagttggatggagtcgtcgggtcccgccgaggtccgtaccggaagggggaacgggggtctagggggtaaggtcgggggtcggaccaaacgaagtaaaagccaaaggagtagggaaagtggaaacgtaacaattacgtaagtggtaggtacctggtaggtaggaaacggggtcctaagtttccaacctacttacccgtaccgaaggaacgaaccgaaaccggaccgtaaaggacgtcctacgtacgttagttactccgtagaaacctaaagtcgaaaactcgtaccgtaggaaacggtacggtaacggaaggacgacggttgtgttacgttagttaccgttgtggacgaagtacgtacccttcccggtaacgttaagtaacgg

SEQ ID NO: 383560 - DNA, 792 bp, Homo sapiens
  misc_feature: GZ8MTXP01BB3DA.21.40.D07.1.454.CMB.2.raw
  modified_base (739)..(739): a, c, t, g, unknown or other
tcagtcgtcgctcgcacgaccggtgctcgatttagtgatagagcgtaacaacataggggagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcggtgggggagtcgttggtccaggccggtcggggggtccctgagtacctctcgtgtcgcacgtcctcgtggtacttaccgtaaccgttttaggtacgtacgttagttggtatggacggtccggttccggggtccccgccgaacggtcccgtaccgggaagggggacggggtcgtagggggtacggttgggggaccgaccgtaaaagaagtaaaacggacccgaaaggtagttaaggggaaacgtgaaaagtaaccgtaagttaaccgttaggtgggttacggtaccgttcggtagggtaaacggggtaaccggggtaccctaattcccaaacctacttaccgtaaccccggaaggaaaccgaaacccgaaacccggaccgttaaaagggcgttacccccttaggggtaactttacggttaaacctcgttaacggtaaaccaaagttaccgaaacgtcggaaaccgttaggaacgtcggggtaaccgaaaggttcccgaagggttccttaagggtacgttactttccgggnggtaacgacggtaaccgtaacggttaccccttcccggttaacgttaagtaacg

SEQ ID NO: 383561 - DNA, 430 bp, Homo sapiens
  misc_feature: GZ8MTXP01EZ3PZ.21.40.D07.1.454.CMB.2.raw
  modified_base (270)..(270): a, c, t, g, unknown or other
  modified_base (419)..(430): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggccccaaactcctcatctataggaataatcagcggccctcaggggtcccctgaccgattctctggctccaattctggcacctcagcctccctggccatcagtgggctccggtccgaggatgaggctgattatacngtgcagcatgtgatgacgctgagtggtccggtgttcggcggagggacaggctgaccgtccgtaggtccagccaaggctcgccccctggtcactctcgtccccgccctcctcgagcgacgactgagcgggcgtggcaagggcgcagtagnnnnnnnnnnnn

SEQ ID NO: 383562 - DNA, 795 bp, Homo sapiens
  misc_feature: GZ8MTXP01C56RN.21.40.D07.1.454.CMB.2.raw
  modified_base (258)..(258): a, c, t, g, unknown or other
  modified_base (722)..(722): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcctgttgctattttagaaggtgtccagtgtgaggtgcagctggtggagtcgtgggggagcgttggtccagccgtggggggtccctgagtactctcctgtcncagcctgtggattcactttagatcttagtggatgagcgtgggcccgccaggcctaccggaagggggaacgggggtcgtaggggtagggtcgggggtacggaacccaaaacgtaagtaaaacggaccgaaaaggtaagtggggaaaaggttgaaaacggtaaactaacgttaaacgttagttacggggtacggtaccgttcgttagggtaacggggtaaaacggggtcccgtaaacgtttacccgaacccttaagttacccctaacccgggaaaacggtaaaccggaaaccccgaaaacccggggaaccccaaaagggtaaccgggtacccctttacggggtaaacccgtttagggttaaaccttaccggaacggtaaaccctaaaagttaccggaaaaccgtcggtacccgttaggaacggtaacggttaaccgggaaacgggaccgtacggggctttagggtntttaacgttccggttaggtcggaaccggtaaggaccggttacccttccccgggtaacgggttaagtaaccggg

SEQ ID NO: 383563 - DNA, 646 bp, Homo sapiens
  misc_feature: GZ8MTXP01CZ9C3.21.40.D07.1.454.CMB.2.raw
  modified_base (261)..(261): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtggancctctggattcaccttagagctattggatgagcgtgggtccgccgaggctccgagggggaacggggctggggagtgggggtacggaccaaacgaataaaggcaaaggataggaagtgagaacataactatggtggactcgtggtaggaacggggccctaattccaaccctatcctacccgaaggaacaaccgaaccgaccaaagacgtcctacaacggttgttatacctaggaacctaaagtcggaaaccaggtcccgtaggaacggtacggtccgggaagggaaccgaccggggtctttagggtacgtttaacgtttacgttggttagggaaccggtaagtaacgtaccccgttcccccgttacggggttaattaacggtccgg

SEQ ID NO: 383564 - DNA, 587 bp, Homo sapiens
  misc_feature: GZ8MTXP01EOUBD.21.40.D07.1.454.CMB.2.raw
  modified_base (479)..(479): a, c, t, g, unknown or other
  modified_base (486)..(486): a, c, t, g, unknown or other
  modified_base (493)..(493): a, c, t, g, unknown or other
  modified_base (544)..(544): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcgttggtccagccgtgggggtccctgagctctcctgtgcagcctctggattcacctttagtagtctattggatgagtcgtcgggtcccgccgaggcctaccgaagggggaacgggggtcgtgggaggtgggggtacggaccaaacgaataaagccgaaaggagtagggaagtggaaagactaatactagtgtggactcgtgtaggagggcctatcacatctaccagacacaacgccaaagtacgctacagttgtattcgaanaacaaancgaaacngtcgtaggacgacggtaacgaacggcgtacggttgttagtattacgttcgnggtaagacgtaaggacgtacccgttcccggtaagttaagtcgg

SEQ ID NO: 383565 - DNA, 625 bp, Homo sapiens
  misc_feature: GZ8MTXP01BGDZR.21.40.D07.1.454.CMB.2.raw
  modified_base (264)..(264): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggtttccttgttgcttattttagaaggtgtccagtgtgaggtgcagctggtggagtcgtgggggaggtcttggtccagccgtgggggtccctgagactctctgtgcagcctntggtattcacctttagtagctagttggatggagtcgtcgggtcccgccgagggccgtaccggaagggggaacgggggcgtagggggaggtgggggtcggaccaaacgaagtaaagccgaaaggagtaggaagtgaagactaatactagtgtagactcgtggtacggaagggcctattccgactatcctaccgaagacgaaccaaccgacaaaggctacctacgaaccttgtaactcgtaacgactaaaagtcgaaaacgcggtaccttaggaacgagtcgggaaagcaccgggttgtgttaattcgttcgttggtaacgacggtaacgtacgtcccgttaccccgtaacggttaagtaacg

SEQ ID NO: 383566 - DNA, 454 bp, Homo sapiens
  misc_feature: GZ8MTXP01B5MNA.21.40.D07.1.454.CMB.2.raw
  modified_base (266)..(266): a, c, t, g, unknown or other
  modified_base (417)..(417): a, c, t, g, unknown or other
  modified_base (441)..(443): a, c, t, g, unknown or other
  modified_base (445)..(454): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctccaggaacggccccaaatcctcatctataggaataatcagcggccctcgaggggtccctgaccgattctctggctcaattctggcacctcagcctcctggccatcagtgggctccggtcgaggatgaggctgattattacngtgcagcagtgtgatgacggctgaggtggtccggtgttcgggcggagggaccaggctggaccgtcgtaggtccacgcgaaggcctcgcccctcgtctacctctccgtccccacccttccgtaccgcgccgacgactcgggacgccggggtntacgggacgaacggccgacagagnnngnnnnnnnnnn

SEQ ID NO: 383567 - DNA, 744 bp, Homo sapiens
  misc_feature: GZ8MTXP01AE0CU.21.40.D07.1.454.CMB.2.raw
  modified_base (323)..(323): a, c, t, g, unknown or other
  modified_base (623)..(623): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaggtgtccagtgtgaggtgcagcgtggtggagtcggtgggggaggcgttggtccaggtccggtcggggggtccctgacgtacttctccgtgtgcacgtcctcgtggtattctactttagtagtctagtggatgagtcgtcgggtccncgacggcgtccggaagggggtacgggggcgtgggaggttcgggggtacgaacccgaaagtaagtaaaacggacccgtaaaaggaggttaagggaaaggtacgaaaacggtaactaacgtttaaacgtagtgggtacggtacgtacgtaagtacgggaaaccgggtcctaacttaccgaccctaatccctaaccgaaggaacgtaaacccgaaccgggaccctaaagggaccttcctaccggggtaactggttaactccgtaacgaaactaaagtcgaaaactcggtacgtaaggaacggnggtaaccggaagggttaccgtaccgggttgtttagggtaacgttttacttccgggttgggtaacgacccgggtaagtaaacccgtcccgttaacccccggtaagggttaagtaacccgggg

SEQ ID NO: 383568 - DNA, 675 bp, Homo sapiens
  misc_feature: GZ8MTXP01ASUXC.21.40.D07.1.454.CMB.2.raw
  modified_base (330)..(330): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggagtcggtgggggagtcgttcggtccgaggccggtcgggggtccctgacgtactctccgtgtgcacgtcctcgtaggtacttctaccttagtagtcttagttggatggacgtcgtcgggtcccncgaggccgtacggaggggagggcgtgggaggtgggacgtaccaaacgagtaaacgacgaaagtagtaggaagtgaaagactaatactagtgtagactcgtgtacggaacgggcgtacgtaccactactcgtacccgaagtaacgaaccgaaaccgaccgaaacgtaccgtactaaccgtacgttaggtaactaccgtacgaaactaaagtaccgaaacgtacggtaccgtaggacggtaacggaacggtaaaccggacggtacccggttacgttaggttacgttagttacgttcggaaggtacgaagtacccgtacccggttaccccgtaaggttaacgtaacgg

SEQ ID NO: 383569 - DNA, 696 bp, Homo sapiens
  misc_feature: GZ8MTXP01CFEF2.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagcgtgggtggagtcggtgggggagtcgttggtccgaggtcccggtcggggggtccctggacgtaccttctccgtgtcgcagtcctcgtggtacttctaacctttagacgtcttaagttggatggacgtcgtcgggtcccgcgaggccgtaccggagggggtacggggcgtaggggaaggtcgggggtacgaccaaaagaagtaaaacgccgaaaggtagtagggaaagtgaaagaactaagtactaagtggtaggactcgtaggtacggaacgggtcctaagttacccacgtactccgtaacgaaggaacaacccgaacgaccaaaggtacgtacctcaacgtttagtactacgtaagaactaaagtcgaaaccgagtcccgtagaaacgggtaggaacccggaaggttccgaaacgggttcgttaggttagttaaccgttcgttaggtcgaaccgaacgtaccgtacccgtttccccggtaaggttaagtaaccggg

SEQ ID NO: 383570 - DNA, 714 bp, Homo sapiens
  misc_feature: GZ8MTXP01B6T4V.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagagactcaccatggaattggggctgagcgttgggttttccttgttgcttattttagaaggtgtccagtgtgaggtgcagcgtgggtggagtcggtggggggaggtcgttggtccgacggtcccgggttcggggggtcccctggacgtacctccgtcctgtcgccagtccctcgtggtacttctacctttagagtcttagttggatggaggtccgtcggggtcccgccgaggccgtaccggaagggggaacgggggtcgtaggggagggttcgggggacggtacccaaagaaagtaaacggaccgaaaggagtagggaaagtacgaaagtaactaagttactagtgggtacgactcggtggtacgggaacgggcctaacttaccgaacctatacccgtaacgagaacgaaccgaacgacgaagacgccttacgtacgtgttaccttacgacgtaaacaaacgtgaaaacccgtcgtccggtaaggtacgacgggtaaccggaacggaccgtacggttcgttaggttaacgtttacgttgttacggtcgaacgtcggtaaccgtcccgttacccccggttggttaacgttaacggg

SEQ ID NO: 383571 - DNA, 669 bp, Homo sapiens
  misc_feature: GZ8MTXP01AGXVC.21.40.D07.1.454.CMB.2.raw
  modified_base (319)..(319): a, c, t, g, unknown or other
  modified_base (482)..(482): a, c, t, g, unknown or other
  modified_base (513)..(513): a, c, t, g, unknown or other
  modified_base (528)..(528): a, c, t, g, unknown or other
  modified_base (534)..(534): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggaggtcgtgggggagtcttggtccagccggtgggggtccctgacgtactctcctgtgcacgtcctgtggacttcacctttagtatcttattggatgagtcgtcggggtccccncgaggcctaccggaagggggaacgggggctaggggaacgggttcgggggtcggaaccccaaagtaaataaaacggaccgaaaggagtaggggaaagtgaaacgaacgtaatactaagtggtacggtactcgtaggtacggaaaccgggcctattccaacgtanccgtaccgaagacgaaccacggtacaaggcncctacgtactgtacnccgtanaactaaacgacgaaacgcgtacgtaggaacgtacggaaccgaacggttacgtacgggttatttacgttacgttaacgttcggaggtaaccgaggtaacgtacccgttaccccggttcccggtaacgttaacgtcg

SEQ ID NO: 383572 - DNA, 780 bp, Homo sapiens
  misc_feature: GZ8MTXP01CNFRU.21.40.D07.1.454.CMB.2.raw
tcagtcgtcgctcgcacgaccggtgctcgattttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagcgtgggtggaggtcggtggggggaggcgtttgggtccaggtccggtggggggtcccctgacgtacctctcctgtgcacgtcctcgtggtacttccacctttagtagtctagttggatgagcgtcgggtccgccgacggccgtaccggagggggaacgggggtcgtaggggtaagggtcgggggtacggaccgtaaacgtaaagtaaaacggacccgaaaagggagtaggggaaagtaggaaacgaacctaagttaactaagttcgggtaggtacgttcgtagggtacgggaaacggggtccgtaacgttaccaccgtacttaccgacgtaaacggaacgaaccgaaacccgacgaaacggacgtaccgttacgtacgttaaggttactaccgttacgaaaccgtaaacgttacggaaaaccgtcggtacccgtagggtaaacggacgggttaacccgggaaacgggttaccgtaccggggttcgttagggtttacggtttaacgtttacccggttggttaacgggaccgtaacggtacccggtaccgttaccccccgttaacgggttaacgttaaccggg

SEQ ID NO: 383573 - DNA, 776 bp, Homo sapiens
  misc_feature: GZ8MTXP01B3LFQ.21.40.D07.1.454.CMB.2.raw
  modified_base (274)..(274): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgcagcgtggtggaggtcgtggggggagtcttggtccaggtccggtggggggtccctgagtactctcctgtcgcagtcctntggacttctaccgtttagtagtcttagttggatgagtcgtcgggtcccgccgaggcctaccggagggggaacgggggtcgtaggggtaggtcgggggtacggaccaaacgtaataaaacggccgaaaggtacgttagggaaaggttggaaaacgtaaccgtaattaaccgttaggttggtacggggtaaccttcggttacgggtacggggtaaacgggggtcccttaacgtttacccgaaaccgttacctacccgttaacccgaagggaaccgaaacccgaaacccgaccccgaaaggacgtacccttacggtaacgtttaggtaccttccgttaagaaacgtaaaacgttacggaaaaccctcggtcccgttaaggaacggttacggaacggggtaaacgggttacccgacgggttccttacgggttagtttaaacgtttccgttaggtccggaccgtaaacggtccgtacccttcccccgggttaaggttcgtaaccggg

SEQ ID NO: 383574 - DNA, 819 bp, Homo sapiens
  misc_feature: GZ8MTXP01B070R.21.40.D07.1.454.CMB.2.raw
  modified_base (687)..(687): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtgggggagtcttgggtccagccgtgggggtccctgagactctctgtgcagccctgtggtattcaccttttagagtcttattggatggacggtcgtcggggtccccgccgaacgggtcccgtaccggaagggggaacggggggtccgtagggggtaacgggttggggggttaccggaaccctaaaacgtaaacgttaaaaacggaccccgtaaaaaggggtaggttaacgggggtaaaaggtagggaaaaacgtaaaccgtaagtttaaacccgtttaaagttcggggtttacggtaaccgtttcggttagggttacggggaaaccgggggtcccgtaaactttacccgaacccgtaacttacccgttaaaccccgaaggaaaccgaaaccccgtaaaccggaccccgtaaaaggaaccgtcccttacgtaacgtttaggttaacttccgttagaaaccctaaaagttacgaaaaccncggtacccttaggacgggtaaggtaaccgggaacgggttaccgacgggttcgttagggtacgtttacgtttacgttgggtaacgtacggtaagacccggtccgtttacccccggtaacggttaagtaacggg

SEQ ID NO: 383575 - DNA, 560 bp, Homo sapiens
  misc_feature: GZ8MTXP01A7GP7.21.40.D07.1.454.CMB.2.raw
  modified_base (341)..(341): a, c, t, g, unknown or other
  modified_base (348)..(348): a, c, t, g, unknown or other
  modified_base (480)..(480): a, c, t, g, unknown or other
  modified_base (490)..(490): a, c, t, g, unknown or other
  modified_base (510)..(510): a, c, t, g, unknown or other
  modified_base (524)..(524): a, c, t, g, unknown or other
  modified_base (527)..(527): a, c, t, g, unknown or other
  modified_base (558)..(558): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggtcttggtccagccgtggggggtccctgagactctcctgtgcagcctctggacttcgacctttagagctaattggatgagcgtgggtcccgcgaggcctcggaggggagggctgggaggtgggngaccaanataagccaagagtaggaagtgaagaacaagtactagtggtacggactcgtgtagggaaacgggccctaattccaccattccaccaaggacacaacgccaaagcgctacatgaactcgagacaaatcgaaacntccgtagagngaacggagttacacgggttntagtattagttcgnggngacgaagacgtcccgttcccgtaaggttaancg

SEQ ID NO: 383576 - DNA, 613 bp, Homo sapiens
  misc_feature: GZ8MTXP01A8HGI.21.40.D07.1.454.CMB.2.raw
  modified_base (546)..(546): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcttgttgctatttagagtgtcagtgtgaggtgcagcgtggtggagtcgtgggggagtcgttggtccaggtccgtggggggtccctgacgactctcctgtcgcagcctgtggtacttcacctttagtagcttagttggatggagtcgtgggtcccgcgaggcctcggagggggagggcgtgggaggtgggtacgaccaaagaagtaaacgacgaagagtaggaagtgaaagaacaatactagtggtagacttcggtgtaggtacggggacctatccgactactcgtacccaggaacgaaccgtaacgacccgaaagcgtacctacgtacttagtactcgtagaacctaaatacgaaactcgacgtggagacggtaacggacgggttaacncgggcttggtgttaagttcgttacgtgacgtaagacgtccgttcccccgtaaggttaacgtaacggg

SEQ ID NO: 383577 - DNA, 604 bp, Homo sapiens
  misc_feature: GZ8MTXP01EP4XA.21.40.D07.1.454.CMB.2.raw
  modified_base (176)..(176): a, c, t, g, unknown or other
  modified_base (252)..(252): a, c, t, g, unknown or other
  modified_base (254)..(254): a, c, t, g, unknown or other
  modified_base (261)..(261): a, c, t, g, unknown or other
  modified_base (447)..(447): a, c, t, g, unknown or other
  modified_base (469)..(469): a, c, t, g, unknown or other
  modified_base (475)..(475): a, c, t, g, unknown or other
  modified_base (477)..(477): a, c, t, g, unknown or other
  modified_base (485)..(485): a, c, t, g, unknown or other
  modified_base (537)..(537): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggtttcctgtagctatttagaggtntcagtgtgagtgcagctggtgagtcgtgggggagcttggtccaggccgtggggggtccctgacgtactctcctgtncngtccctntggtattcgactttagatctagttggattggagcgttgggacccgcacgggtcctaccggagggggtaacgggggtctgggtaggtggggtcggaaccaaacgagtaaacgaccgaagtaggtaggaacgtagaaagactaagtatagagggtcgtaaccgtgtgtaaggacggcgtacttcactncgtacagacacacgcaaagtcnctacgntntactctanaactaagtacgacgcgtacgtagacgtacgtaacggacgttacgtacggttntagttacttacgttcgttacggtaagacggtaacgtacccgtccgttaccccggtaagttaacgtcg

SEQ ID NO: 383578 - DNA, 422 bp, Homo sapiens
  misc_feature: GZ8MTXP02JM87I.21.40.D07.1.454.CMB.2.raw
  modified_base (416)..(422): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggccccaaactcctcatctataggaataatcagcggccctcaggggtccctgaccgattctctggctccaattctggcacctcagcctccctggccatcagtgggctcggtccgaggatgaggctgattattactgtgcagcatgtgatgacggcctgagtggtccggtgttcggcggagggaccaggctgaccgtctaggtccagcccaagctgccccctggtcactctcgttcccgcctcctccgagcgacgactgacgcgggctggcaaggcgcatagnnnnnnn

SEQ ID NO: 383579 - DNA, 416 bp, Homo sapiens
  misc_feature: GZ8MTXP02F2YTQ.21.40.D07.1.454.CMB.2.raw
  modified_base (407)..(407): a, c, t, g, unknown or other
  modified_base (413)..(416): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggccccaaactcctcatctataggaataatcagcggccctcaggggtccctgaccgattctctggctccaattctggcacctcagcctcctggccatcagtgggctccggtcgaggatgaggctgattattactgtgcagcatgtgatgacggcctgagtggtccggtgttcggcgagggccaggctgacgtcctaggtccagcccaaggctgccccctggtcactctgttccccacctctccgagcgacgactgagcgggctggcaagggcncatagnnnn

SEQ ID NO: 383580 - DNA, 507 bp, Homo sapiens
  misc_feature: GZ8MTXP02GP10R.21.40.D07.1.454.CMB.2.raw
  modified_base (343)..(343): a, c, t, g, unknown or other
  modified_base (436)..(436): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtgggttttccttgttgctattttagaaggtgtccagtgtgaggtgcagctggtggagtctggggggaggcttgggtccagccgtggggggtccctgagactctcctgtgcagcctctggattcacctttagagctattggatgagctgggtccgccaggctccgaggggaggggctgggagtggggtgccaanataaagcaaagatggaaagtgagacatactatgtgactctgtgaaagggccattcacatctccagagacaacgaccaagagctcactgtatcngacaaatagaacagcagagagacgaggacgacgacgtgtgtatatgtgcgagagactaccctccgtactag

SEQ ID NO: 383581 - DNA, 424 bp, Homo sapiens
  misc_feature: GZ8MTXP02JA01W.21.40.D07.1.454.CMB.2.raw
  modified_base (413)..(424): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggccccaaactcctcatctataggaataatcagcggccctcaggggtccctgaccgattctctggctccaattctggcacctcagcctcctgccatcagtggctccggtcgaggatgaggctgattatactgtgcagcatgtgatgacgctgagtggtccgtgtcggcggagggacaggctgaccgtctaggtccagcccaaggctcgccccctcggtcactctcgttccccacccttcctccgagccgacgactgagcggctggcaagggcgcatagnnnnnnnnnnnn

SEQ ID NO: 383582 - DNA, 528 bp, Homo sapiens
  misc_feature: GZ8MTXP02IQNUN.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggtttctgtgctatttagaggtgtcagtgtgaggtgcagctggtggagtcgtgggggaggcttggtccagccgtggggggtccctgagactctcctgtgcagcctctggattcacctttagagctattggatgagcgtgggtccgccaggctccgaggggaaggggctgggagtggggtggaccaaacagtaaaagccaaagataggaagtgagacatactatgtagactcgtgtggaaaggggcccattccaaccatcctacagagacaacgccaaagagctacacttgtatcgagacaaatagaacagaccagagagacgaggacgacggcgtgtgtagttactgtgcgagacgacgtcccgtaccgtacgtacg

SEQ ID NO: 383583 - DNA, 423 bp, Homo sapiens
  misc_feature: GZ8MTXP02HQ3MF.21.40.D07.1.454.CMB.2.raw
  modified_base (416)..(423): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggccccaaactcctcatctataggaataatcagcggccctcaggggtccctgaccgattctctggctccaattctggcacctcagcctccctggccatcagtgggctcggtccgaggatgaggctgattatactgtgcagcatgtgatgacggcctgagtggtccggtgttcggcggagggaccaggctgaccgtcctaggtccagccaggctcgccccctggccactctcgttccccgccctcctccgagcgacgactgagcgggctggcaggcgcatagnnnnnnnn

SEQ ID NO: 383584 - DNA, 426 bp, Homo sapiens
  misc_feature: GZ8MTXP02J3YG9.21.40.D07.1.454.CMB.2.raw
  modified_base (423)..(426): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggccccaaactcctcatctataggaataatcagcggccctcaggggtccctgaccgattctctggctccaattctggcacctcagcctccctggccatcagtgggctccggtccgaggatgaggctgattattactgtgcagcatgtgatgacggcctgagtggtccggtgtcggcggagggaccaggctgacccgtccgtaggtcccagcccaaggctcgccccctcggtccactctcgttcccaccctcctccgacgcgacgctgacgcgggctggcaaggcgcagnnnn

SEQ ID NO: 383585 - DNA, 433 bp, Homo sapiens
  misc_feature: GZ8MTXP02HIAGL.21.40.D07.1.454.CMB.2.raw
  modified_base (387)..(387): a, c, t, g, unknown or other
  modified_base (417)..(417): a, c, t, g, unknown or other
  modified_base (424)..(433): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggccccaaactcctcatctataggaataatcagcggccctcaggggtcccctgaccgattctctggctccaattctggcacctcagcctccctggccatcagtgggctccggtccgaggatgaggctgattattactgtgcagcatgtgatgacggcctgagtggtccggtgttcggcggagggaccaggctgaccgtctaggtccagcccaaggctgccccctgggtcactctcgttcccaccctcctccgngccgacgactgacgcgggctgggcaaggcncgatagnnnnnnnnnn

SEQ ID NO: 383586 - DNA, 529 bp, Homo sapiens
  misc_feature: GZ8MTXP02HEZUO.21.40.D07.1.454.CMB.2.raw
  modified_base (262)..(262): a, c, t, g, unknown or other
  modified_base (328)..(328): a, c, t, g, unknown or other
  modified_base (376)..(376): a, c, t, g, unknown or other
  modified_base (446)..(446): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggtttcgtgtaggcgtatttagaaggtgtcagtgtgaggtgcagctggtggagtcgtgggggaggcttggtccagccgtggggggtccctgagactctcctgtgcagcctntggattcactttagagctatggatgagcgtgggccgccaggctcaggggaggggctgggagtgggnggaccaagataaaagcaaagatgggaagtgagacatatatgtggactntgtgaaggacgattcacactcctacacgacgaacaacgacaacgacgactacactatatactagacaaanaagaacacgacgagagagacgacggacgacgacgtacgtagtacttacgtgtgacgacgacgacgtcccgtaccgtacgtacg

SEQ ID NO: 383587 - DNA, 749 bp, Homo sapiens
  misc_feature: GZ8MTXP02JLIE4.21.40.D07.1.454.CMB.2.raw
  modified_base (570)..(570): a, c, t, g, unknown or other
  modified_base (694)..(694): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggggagtcgttcggtccgacgtccgggtcgggggtccctggacgtaccttcctccgtggtcgcgacgtcccttcgtaggtacttccttaaccgtttagtacgtacttagttaggtagtaggacgtcggtcgggtccccgaccgacggtcctaccggaagggggaacggggtcggtaggggtagggttggggtcggaacccaaacgtaaagtaaacgaccggtaaagggagtagggaaaggtagaagaactagttacgtagtcggtacgacgttgtagggtacgggaaacggggtccctaacttccgacctacgttaccgaccgaacggaacgaacccgaaacggacccgaaaggtaccnccttacgtacgttgtactaccgtaaagaacgaaaacgtcgaaaccgtacggaccgtagggaacgggaacggtaaccggaacgggtaccgtacggggttcttacggtttacgttaacgttacggnggtaacggaacggtaacggtaccccgtacccgttacccccggtaggtaactacgg

SEQ ID NO: 383588 - DNA, 428 bp, Homo sapiens
  misc_feature: GZ8MTXP02HA2TM.21.40.D07.1.454.CMB.2.raw
  modified_base (422)..(428): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggccccaaactcctcatctataggaataatcagcggccctcaggggtccctgaccgattctctggctccaattctggcacctcagcctccctggccatcagtggctccggtcgaggatgaggctgattattactgtgcagcatgtgatgacggcctgagtggtccggtgttcggcggagggccaggctgaccgtctaggtccagccaaggctcgccccctggtccactctcgttccccaccctcctccgacgccgacgactgacggcgggctggcaaggcgcagtagnnnnnnn

SEQ ID NO: 383589 - DNA, 526 bp, Homo sapiens
  misc_feature: GZ8MTXP02HAN2D.21.40.D07.1.454.CMB.2.raw
  modified_base (301)..(301): a, c, t, g, unknown or other
  modified_base (379)..(379): a, c, t, g, unknown or other
  modified_base (418)..(418): a, c, t, g, unknown or other
  modified_base (448)..(448): a, c, t, g, unknown or other
tcagtcgtcgctcgcacgaccggtgctcgatttagtgatagagcgtaacaacagaggggagagaggagccttagccctggaccccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccncaggctccagggaaggggctggaatggggtgccaaacataaagcaagatggaagtgagacatactatgtggactttcngtgaagggccattcaccatctccagagacaacgccaagngctcaactgtatctaggacaaaatgaaacngcctgacgagtcggaacggacacgggcttaggtacgttagtactggtgcgagacgactcccccgtcggtaatacggac

SEQ ID NO: 383590 - DNA, 421 bp, Homo sapiens
  misc_feature: GZ8MTXP02J00UF.21.40.D07.1.454.CMB.2.raw
  modified_base (407)..(407): a, c, t, g, unknown or other
  modified_base (412)..(421): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggccccaaactcctcatctataggaataatcagcggccctcaggggtccctgaccgattctctggctccaattctggcacctcagcctccctggccatcagtgggctccggtccgaggatgaggctgattatactgtgcagcatgtgatgacggcctgagtggtccggtgtcggcggagggccaggctgaccgtctaggtccagcccaaggctgccccctggcactctcgtcccgccctctccgagcgacgactgagcgggctggcaaggcgnatagnnnnnnnnnn

SEQ ID NO: 383591 - DNA, 681 bp, Homo sapiens
  misc_feature: GZ8MTXP02J1391.21.40.D07.1.454.CMB.2.raw
  modified_base (214)..(214): a, c, t, g, unknown or other
  modified_base (257)..(257): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggttttcctgtagctattttagaaggtgtccagtgtgaggtgcagctggtggagtgtgggggnggcgtggtccgacgcggtcggggtccgtgagctctcctgtgcncgcctcgtgtacttctaccttagtagtctagttgtagtgagtcgtcggtccgccgacggccgtaccggaggggacggggtcggtgggtagggtgggtacggaaccgaaacgaaagtaaagaacgaagtaagtaggtaaggtaggaagaacgtacgtaacgttagtaggtagtacgtacgtaggtacgggtaacgggtaccgtacgtaccgtaacctactaccgtacgaacgaacgaaaccgaaaccgaaccgaacgacgacgtacgtacgtacgtacgtacgtacgtaacgaaacgtaacgaacgacgtacgtacgaacgaacggtacggaacggaacggaccggtacgttacgttacgttacgttacgtacggtaacggtacggaacggtacgtacccgttaccccggttaccggtacgtacg

SEQ ID NO: 383592 - DNA, 524 bp, Homo sapiens
  misc_feature: GZ8MTXP02HBSEN.21.40.D07.1.454.CMB.2.raw
  modified_base (335)..(335): a, c, t, g, unknown or other
  modified_base (410)..(410): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggtttcctgtgctatttagaggtgtccagtgtgaggtgcagctggtggagtcgtgggggaggcttggtccagccgtggggggtccctgagactctcctgtgcagcctctggattcactttagagctattggatgagcgtgggtccgccaggctccgaggggagggctgggagtggggtgccaanagtaaagccaagataggaagtgagacatactatgtgactcgtgtaggaagggccctattccaccatcctcaaganaaccaacgccaagtacgcttacacttagtatcgtagaccaaatagacagctagagagacgaggacgacgcgtcgtgtatacgtgtgcgagacgacgtcccgtaccgtacgtacg

SEQ ID NO: 383593 - DNA, 423 bp, Homo sapiens
  misc_feature: GZ8MTXP02IHXSI.21.40.D07.1.454.CMB.2.raw
  modified_base (419)..(423): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggccccaaactcctcatctataggaataatcagcggccctcaggggtccctgaccgattctctggctccaattctggcacctcagcctccctggccatcagtgggctccggtccgaggatgaggctgattattactgtgcagcatgtgatgacggctgagtggtccggtgttcggcggagggaccaggctgaccgtctaggtccagcccaaggctcgccccctcggtcactctcgttccccaccctctccgagcgacgactgagcgggctggcaaggcgcatagnnnnn

SEQ ID NO: 383594 - DNA, 523 bp, Homo sapiens
  misc_feature: GZ8MTXP02H4CJ7.21.40.D07.1.454.CMB.2.raw
  modified_base (336)..(336): a, c, t, g, unknown or other
  modified_base (342)..(342): a, c, t, g, unknown or other
  modified_base (355)..(355): a, c, t, g, unknown or other
  modified_base (385)..(385): a, c, t, g, unknown or other
  modified_base (441)..(441): a, c, t, g, unknown or other
  modified_base (446)..(446): a, c, t, g, unknown or other
  modified_base (448)..(448): a, c, t, g, unknown or other
tcagtcgtcgctcgcacgaccggtgctcgatttagtgatagagcgtaaacaaacagaggggagagaggagccttagccctggactccaaggcctttccacttggtgatcagcactgagcacagaggactcaccatggaattggggctgagcgtgggttttctgttgctattttagaaggtgtccagtgtgaggtgcagctggtggagtcgtgggggagcttgggtccagccgtggggggtccctgagactctcctgtgcagcctctggattcactttagagctattggatcgagctgggtccgccaggctccgaggggaaggggctgggagtgggngccaanataaagccaaagntgggaaagtgagacatactatggtgacctntgtgaaagggccattcacatctacagagacaacgtcaagagctacacttgatctanacaananacacgacgagagagacgagacgacgcgtagtacgtactagtgtgcgacgacgaccgtacccgtaccgtacgtacg

SEQ ID NO: 383595 - DNA, 600 bp, Homo sapiens
  misc_feature: GZ8MTXP02J1D1B.21.40.D07.1.454.CMB.2.raw
  modified_base (265)..(265): a, c, t, g, unknown or other
  modified_base (303)..(303): a, c, t, g, unknown or other
  modified_base (335)..(335): a, c, t, g, unknown or other
  modified_base (341)..(341): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggttttcgtgtaggctatttagaaggtgtccagtgtgaggtgcagctggtggagtcgtggggggagcttgggtccagccgtggggggtccctgagactctcctgtgcagccctntggattcaccttttagagctattggatgagctgggccnccaggctccgaggggagggctgggagtggggngccaanataaaagcaagagtaggaagtgagacatatagtgtgtacgtcgtgtaggacggtacgtactaccactactcctacgacgaacgaacgaaccgaccgaacgacgtactaccgtacgtacgtactacgtacgtaacaaacgtaacgaacgacgacgtacgacggaacggtacggaacggacggacggtacgttacggttacgttacgttacgttaggtcggacggaacggacgtacccgtaccccggtaccggtacgtacg

SEQ ID NO: 383596 - DNA, 420 bp, Homo sapiens
  misc_feature: GZ8MTXP02IKIY4.21.40.D07.1.454.CMB.2.raw
  modified_base (414)..(420): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggccccaaactcctcatctataggaataatcagcggccctcaggggtccctgaccgattctctggctccaattctggcacctcagcctccctggccatcagtgggctcggtccgaggatgaggctgattattactgtgcagcatgtgatgacggcctgagtggtccggtgttcggcggagggaccaggctgaccgtctaggtccagcccaaggctgcccccttggcactctcgttccccacctcctccgcgcgacgactgagcggctgcaagcgcatagnnnnnnn

SEQ ID NO: 383597 - DNA, 549 bp, Homo sapiens
  misc_feature: GZ8MTXP02GKFWO.21.40.D07.1.454.CMB.2.raw
  modified_base (343)..(343): a, c, t, g, unknown or other
  modified_base (520)..(520): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtcagtgtgaggtgcagctggtggagtcgtgggggaggcttggtccagccgtggggggtccctgagactctcctgtgcagcctctggattcacctttagagctattggatgagcgtgggtccgcgaggctccgaggggaaggggctgggagtggggtgccaaanataaaagccaaagatagggaaagtgaagacatactaatgtggactcgtgtgaaagggccattccaccatccaccagacgaacaacgaccaaaggtacgctacaacttgaatcctagaactaaaagtgaaaccagcctagacgagtccggaaggacacgggtctgtacgtaatcgtgngacgagacgactccccgtacggtatacgg

SEQ ID NO: 383598 - DNA, 523 bp, Homo sapiens
  misc_feature: GZ8MTXP02GVXSW.21.40.D07.1.454.CMB.2.raw
  modified_base (337)..(337): a, c, t, g, unknown or other
  modified_base (493)..(493): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctatttagaaggtgtcagtgtgaggtgcagctggtggagtcgtgggggaggcttggtccagccgtggggggtccctgagactctcctgtgcagcctctggattcacctttagagctattggatgagctgggtccgcaggctccgaggggagggctgggagtggggtgccaanataaagcaaagataggaagtgagacatactatgtaggactcgtgtagaaacggggccaattcaccatctaccagacaacaacgaccaaagagctacactgtatctgaccaaatgaaacagcctagagaggtcgaggacacggctgtagtattacgngtaagcgagacgactccccgtacggtatag

SEQ ID NO: 383599 - DNA, 522 bp, Homo sapiens
  misc_feature: GZ8MTXP02HCXEN.21.40.D07.1.454.CMB.2.raw
  modified_base (374)..(374): a, c, t, g, unknown or other
  modified_base (435)..(435): a, c, t, g, unknown or other
  modified_base (448)..(448): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtgggttttccttgttgctattttagaaggtgtccagtgtgaggtgcagctggtggagtcgtgggggaggcttggtccagccgtgggggggtccctgagactctcctgtgcagcctctggattcacctttagtagctattggatgagctgggtccgccaggctccgaggggaaggggctgggagtggggtggaccaacgataaagccaaagatggaagtgagacntactatgtggactctgtgaaacgggacctattccaccatcctcagagacagcgaccaaagngctcgatgtatcngacaaatagacagacagagagcgaggacgacggcgtgtagtatagtgtgacgacgacgacgtccgtaccgtacg

SEQ ID NO: 383600 - DNA, 587 bp, Homo sapiens
  misc_feature: GZ8MTXP02JJ7EX.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattctacctttagtagctattggatgagcgtgggtccgcaggctccgaggggaggggctgggagtgggtggccaacaataaagcaagataggaagtgagacatactatggtggactcgtggtggaaacgggggcctattccaccattccaccaagacgaccaaacggaccaaaggcgacctcacttgtactctagactaaaatgaaacacggcctaggacgaagtcggaaacgggaccacggggtcttaggtacgttaacgttacgtggtaacggacgaaggaaccggtaccttcccccccggttacggttaaagtacgg

SEQ ID NO: 383601 - DNA, 432 bp, Homo sapiens
  misc_feature: GZ8MTXP02GE7N2.21.40.D07.1.454.CMB.2.raw
  modified_base (425)..(432): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctcctggccatcagtggctccggtcgaggatgaggctgattattactgtgcagcatgtgatgacggctgagtggtccggtgtcggcggagggaccaggctgaccgtcctaggtcccagcccaaggcctcgccccctgggtccactctcgttcccgccctcctccgacgcgacgactggacgcgggctaggcaaggcgacatagnnnnnnnn

SEQ ID NO: 383602 - DNA, 532 bp, Homo sapiens
  misc_feature: GZ8MTXP02JHHPY.21.40.D07.1.454.CMB.2.raw
  modified_base (256)..(256): a, c, t, g, unknown or other
  modified_base (288)..(288): a, c, t, g, unknown or other
  modified_base (316)..(316): a, c, t, g, unknown or other
  modified_base (321)..(321): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggtttcgtgtagctatttagaaggtgtcagtgtgaggtgcagctggtggagtcgtgggggaggcttgggtccagccgtggggggtccctgagactctcctgtgcncgctctgtatctacttagtagtctagtgatgngcgtcggtccgcgcgcgcgagggagggngtggnggtggtggacaacaagaagacgaagagagaagagagacatatagtagtagtacgtcgtgtaggacggacgtatactacactctcacgacgacaacgacaagagactcactagtatacgtacgacaataagaacgacgacgtagagagacgacggacgacgcgtagtacgtacgtacgtgtgcgacgacgtaccgtcccgtacgtacgtacg

SEQ ID NO: 383603 - DNA, 518 bp, Homo sapiens
  misc_feature: GZ8MTXP02JNZOL.21.40.D07.1.454.CMB.2.raw
  modified_base (344)..(344): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctgggtccgccaggctccgaggggaaggggctgggagtggggtggccaanataaagccaagatggaagtgagacatactatgtggactcgtgtggaaagggccgattcaccatctccagagacaacgccaagagctcactgtatctagacaaatgaacagcctagagagtcgaggacacggctgtcgtattacgtgtgcgagacgactccccgtacggtatacg

SEQ ID NO: 383604 - DNA, 512 bp, Homo sapiens
  misc_feature: GZ8MTXP02JTJ6F.21.40.D07.1.454.CMB.2.raw
  modified_base (364)..(364): a, c, t, g, unknown or other
  modified_base (483)..(483): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtccctgagactctcctgtgcagcctctggattcacctttagagctattggatgagctgggtccgccaggctccgaggggaggggctgggagtgggtggccaacataaagcaagatggaagtgagacntactatgtgactcgtgtgaagggccattcacatctcagagacaacgccaagcgctcactgtactctagacaaaagtgaaacagcctagagagtcgaggacacgggctgtagtacttacngtgcgagacgactccccgtcggtatacgg

SEQ ID NO: 383605 - DNA, 419 bp, Homo sapiens
  misc_feature: GZ8MTXP02FV9R6.21.40.D07.1.454.CMB.2.raw
  modified_base (414)..(414): a, c, t, g, unknown or other
  modified_base (417)..(419): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggccccaaactcctcatctataggaataatcagcggccctcaggggtccctgaccgattctctggctccaattctggcacctcagcctccctggccatcagtgggctccggtccgaggatgaggctgattattactgtgcagcatgtgatgacggcctgagtggtccggtgttcggcggagggaccaggctgaccgtcctaggtccagcccaaggctgccccctggtcactctgttccccgcctcctccgagcgacgactgagcggctggcaaggcgcanagnnn

SEQ ID NO: 383606 - DNA, 591 bp, Homo sapiens
  misc_feature: GZ8MTXP02FPPXQ.21.40.D07.1.454.CMB.2.raw
  modified_base (354)..(354): a, c, t, g, unknown or other
  modified_base (498)..(498): a, c, t, g, unknown or other
  modified_base (528)..(528): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggaggcgttggtccaggccgtggggggtccctgagactctcctgtgcagcctctggattcacctttagagctattggatgagcgtgggtccgccgaggcctccgaggggaaggggctagggaggtggggtcgacccaaanaagtaaaagccaaagagtagggaagtgaagacatactagtggtgacttgtgtaggaaacggggccctaattcccaacctatccctaccgagaacgaaccaacgaccaaaggacgctacacttgtactctagaacaaatgaaacnggcctaggagtagtacgaggaccacgggtnttaggtacgttacttcgtggtaacgacgaacgtacgtacccttaccccggtacggtaatacgg

SEQ ID NO: 383607 - DNA, 563 bp, Homo sapiens
  misc_feature: GZ8MTXP02GDB1J.21.40.D07.1.454.CMB.2.raw
  modified_base (460)..(460): a, c, t, g, unknown or other
  modified_base (520)..(520): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattcacctttagagctattggatgagcgtgggtccgccaggctccgaggggagggctgggaggtggggtgaccaacaagtaaaagccaaagagtaggaagtgagacatactatgtggactgtgtggaaagggccattcacatcacagacgaacaacgacaagacgctacactgtatctagaacaaatcgaaacngaccctaggaacgtacggtacggaagggaccaacggggtcttaggttacgttaattacgnggtaacgacgaagacgtaccttacccccgtacgggtaatacgg

SEQ ID NO: 383608 - DNA, 573 bp, Homo sapiens
  misc_feature: GZ8MTXP02JL60W.21.40.D07.1.454.CMB.2.raw
  modified_base (449)..(449): a, c, t, g, unknown or other
  modified_base (454)..(454): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattctacctttagtagtctattggatgagcgtgggtccgccaggctccgaggggaaggggctgggaggtggggtcggaccaaacgaagtaaaagccaaagagtagggaagtggaagacatactatggtggacttcgtgtaggaaggggccctattccacatccaccagacacaacgccaagancctanactgtatctagacaaatcgaaacacgcctaggaagtacggtacggaaggaccgacgggtcttaggtacttaagttacgtggtgacggtaagacgtccttacccccggtacggtatacgg

SEQ ID NO: 383609 - DNA, 696 bp, Homo sapiens
  misc_feature: GZ8MTXP02JFEZ1.21.40.D07.1.454.CMB.2.raw
  modified_base (321)..(321): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgtgctatttagaggtgtccagtgtgaggtgcagcgtgggtgggagtcggtggggggaggtcgttgggtccaggccggtggggggtccctgacgactctcctgtgcacgcctcgtggtacttcctaacctttagtaacttagttggatgagcgtgggtccncgaggcctaccggaggggaggggcgtgggaggtggggtcggaccaaacgaagtaaacggacaaagagtagggaaagtaggaagaacaatactagtggtacggacttcgtaggtagggaaacggggtcctaattcccaaccctattccctacccgaaaggaaccgaaacccgaaaccggcccaaaaggacgtacccttacctaaacgttaggttaacttccgtacggaaacctaaaaagtccggaaaaccgtcggtaccgtagggaaacggtacggtacggaacggaccgtacgggtcttaggttacgttaacttacggtggtacggaacggaaacggtaccgttaccccttacccccggtaggtaacgtacggcg

SEQ ID NO: 383610 - DNA, 653 bp, Homo sapiens
  misc_feature: GZ8MTXP02GCL10.21.40.D07.1.454.CMB.2.raw
  modified_base (258)..(258): a, c, t, g, unknown or other
  modified_base (278)..(278): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggtttcgtgtaggctatttagaaggtgtcagtgtgaggtgcagctggtggagtctgggggaggcttggtccagccgtgggggtccctgagctctcctgtgcagcctntggattcacctttagtagtntagtgtagtgagcgtcggtccgccgacggcgtacggaggggaggggcggtgggtaggtggggtcggaccgaacgaaacgtaaagaacgaagagtaggaaggtagagaacatactagtagtagtacgtacgtagtaggaacgggacgtacttacctaaccactacctaccgacgaacgaacgaaccgaccgaacgaacgacctacctactagttacgtacgtacgaacgtaaacgtaacgaaacgaacgtaccgtacggaaggtaacggtacggaacgggaaccggtaacgggtacggttacggttacgttacgttaacgttaggtaacggtacggtaacggtacgtaccgttaccccgttaccggttaacgtacg

SEQ ID NO: 383611 - DNA, 592 bp, Homo sapiens
  misc_feature: GZ8MTXP02HAJ4K.21.40.D07.1.454.CMB.2.raw
  modified_base (493)..(493): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattctacctttagtagtctattggatgagcgtcgggtccgccgaggctccgaggggaaggggcgtgggaggtggggtcgaccaacataaagcaagagtggaagtgaagacatactagtgtgactcgtagtaggaacgggccctaattccaaccctatccctaccgaaggacgaaccaaaccgaccaaagacgcctacacttgtactcgtagaccaaaatcgaaaccngacctaggaagtcggtacggacggacgacggggtcttaggttacgttacttacgtggaacggacgtaaggacgtactccccccggttacggtaatacgg

SEQ ID NO: 383612 - DNA, 534 bp, Homo sapiens
  misc_feature: GZ8MTXP02IT7QJ.21.40.D07.1.454.CMB.2.raw
  modified_base (369)..(369): a, c, t, g, unknown or other
  modified_base (460)..(460): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctgggtccgccaggctccgaggggaaggggctgggagtgggtggccaacataaagccaaagatggaagtgagacntactatgtgactcgtgtgaaggggccatcaccatctcagagacaacgccaagcgctcacttgtactctagacaaatgaaacagcctagagngtacgaggacacgggctaggttgtaactttactggtcgacggtagacggaccttcccccgtacgggtaatacgg

SEQ ID NO: 383613 - DNA, 645 bp, Homo sapiens
  misc_feature: GZ8MTXP02GT2BP.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattcacctttagtagctattggatgagcgtgggtccgccgaggctccgaggggaaggggctgggaggtgggtcggaccaaacataaagccaagagtaggaagtgagacatactagtgtaggactcgtggtaggaaacggggccctaatttcccaaaccctagtccctaccgaaggaacgaacccgaaaccgaccaaaaggtacgccttaccgaacgtttgtaacttccgagaacctaaaagtcggaaaccaggccctaggaacggaacggtaccgggaaacgggaccaccgggggtcttaggttacgttaacgtttaccggagggtaacggacggtaacggtaccgtaccccgtttacccccggttacgggtaatacgg

SEQ ID NO: 383614 - DNA, 526 bp, Homo sapiens
  misc_feature: GZ8MTXP02IFQ4L.21.40.D07.1.454.CMB.2.raw
  modified_base (344)..(344): a, c, t, g, unknown or other
  modified_base (371)..(371): a, c, t, g, unknown or other
  modified_base (496)..(496): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtggggggtccctgagactctcctgtgcagcctctggattcacctttagtgctattggatgagctgggtccgccaggctccgaggggaaggggctgggaggtggggtggccaaanaataaagccaaagatggaagtgagacntactagtgtgactcgtgtagaaaggggcattcaccatctaccagagacaacgccaagagcctcactgtatcgtgacaaatgaacagcctagagagtaccgaggacacgggctggtcgtaatttcnggtgacgagacgtactcccctcggatacgg

SEQ ID NO: 383615 - DNA, 626 bp, Homo sapiens
  misc_feature: GZ8MTXP02HVAU3.21.40.D07.1.454.CMB.2.raw
  modified_base (255)..(255): a, c, t, g, unknown or other
  modified_base (265)..(265): a, c, t, g, unknown or other
  modified_base (279)..(279): a, c, t, g, unknown or other
  modified_base (287)..(287): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggtttcctgtagctattttagaaggtgtccagtgtgaggtgcagctggtggagtctgggggagcttggtccagccgtggggggtccctgagactctcctgtgcncgcctctgtntctacttagtagtntatgatgngcgtcggtccgccgacggcgtcggaggggaggggcggtgggaggtgggtacggaccgaaacgaagtaaagacgaagtagtaggaagtagagactatactagtgtgtactcgtgtaggacgggaccgtactactacctactcctacgacgacgaacgaaccgaccgaaacgacgtactactacgttagtactacgtacgtaacgaaacgtaacgaacgacgtacgtacggaaggtaacggtacggacggaacggaccggtacggttacggttacgttacgttacgttaggtcggtacggaacggtaccggtacccgttaccccgttaccggttacgtacg

SEQ ID NO: 383616 - DNA, 520 bp, Homo sapiens
  misc_feature: GZ8MTXP02G5ZW0.21.40.D07.1.454.CMB.2.raw
  modified_base (407)..(407): a, c, t, g, unknown or other
  modified_base (429)..(429): a, c, t, g, unknown or other
  modified_base (434)..(434): a, c, t, g, unknown or other
  modified_base (436)..(436): a, c, t, g, unknown or other
  modified_base (439)..(439): a, c, t, g, unknown or other
  modified_base (441)..(441): a, c, t, g, unknown or other
  modified_base (445)..(445): a, c, t, g, unknown or other
  modified_base (447)..(447): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggttttccgtgtagctatttagaaggtgtccagtgtgaggtgcagctggtggagtcgtggggggagcttggtccagccgtggggggtccctgagctctcctgtgcagcctctggattcacctttagagctagttggatgagctgggtccgccaggctccgaggggagggctgggagtgggcgaccaagagtaaagccaaagagtaggaagtgagacatactatggtcgactgtgtgaaacgggcctaatcaacctntccacgagacacacgacagtcnctacntnatnanacananacacgcgagagagacgagacgacgcgtgtacgtacgtagtgtgacgacgacgtacgtaccgtacgtacgtacg

SEQ ID NO: 383617 - DNA, 565 bp, Homo sapiens
  misc_feature: GZ8MTXP02IUF77.21.40.D07.1.454.CMB.2.raw
  modified_base (344)..(344): a, c, t, g, unknown or other
  modified_base (405)..(405): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttgggtccagccgtggggggtccctgagactctcctgtgcagcctctggattcacctttagagctattggatgagcgtgggtccgccaggctccgaggggaaggggctgggagtgggtgaccaanataaagcaaagatggaagtgagacatactatgtgactcgtgtggaagggccatcaccatcnccagacgacaacgcaagacgctacaacttgtaatcgtagactaaaagtcgaaacacggcctaggaacgaggtacggaacgggaaccaccggggtcttaggtacgttaacgttacgtggtaacgacggaacgacgtacccgtcccccgtacggtaatacgg

SEQ ID NO: 383618 - DNA, 513 bp, Homo sapiens
  misc_feature: GZ8MTXP02IVPS8.21.40.D07.1.454.CMB.2.raw
  modified_base (261)..(261): a, c, t, g, unknown or other
  modified_base (411)..(411): a, c, t, g, unknown or other
tcagtcgtcgctcgcacgaccggtgctcgatttagtgatagagcgtaacaacagagggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctggggtncagcctctggattcacctttagtagctattggatgagctgggtccgccaggctccgaggggaaggggctgggagtgggtggccaacataaagcaagatggaagtgagacatactatgtgactcgtgtgaaggggcattcacatctcaganacaacgccaagcgctcactgtatctagacaaatgaacagcctagagagtacgaggacacggctgtagtactcgtgtgcgagacgactccccgtacgtatacg

SEQ ID NO: 383619 - DNA, 630 bp, Homo sapiens
  misc_feature: GZ8MTXP02GZ4R8.21.40.D07.1.454.CMB.2.raw
  modified_base (347)..(347): a, c, t, g, unknown or other
  modified_base (466)..(466): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtggggggtccctgagactctcctgtgcagcctctggattcacctttagagctagttggatgagcgtgggtccgccaggctccgaggggaaggggctgggagtggggtcggaccaaanaagtaaagccaaagagtagggaagtgagacagtactagtgtaggactcgtggtaggaaacggggccctaattccaaccctatcctaccgaagacgtaaccaaaccggccaaaggtaccncctacgtacgttagtactcgtaagaactaaacgtaacgaacgacgacgtacggaacggtaacggtacggaacggaacggacggtacgttacggttacgttacgttacgttacggtaacggtacggaacggtacgtaccgttaccccgttaccggttaacgtacg

SEQ ID NO: 383620 - DNA, 534 bp, Homo sapiens
  misc_feature: GZ8MTXP02FRUDK.21.40.D07.1.454.CMB.2.raw
  modified_base (506)..(506): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagagctattggatgagctgggtccgcaggctccgaggggaaggggctgggagtggggtggccaacataaagcaaagatagggaaagtgagacatactatggtggactcgtggtagaaagggggcctaattcaaccatcctccagagacaacgaccaagagctacactgtatctgacaaaatgaaacagcctagacgagtcggaaggacacgggctgtcgtattactggngcgagacgactccccgtacggtatacgg

SEQ ID NO: 383621 - DNA, 527 bp, Homo sapiens
  misc_feature: GZ8MTXP02FOGU9.21.40.D07.1.454.CMB.2.raw
  modified_base (343)..(343): a, c, t, g, unknown or other
  modified_base (382)..(382): a, c, t, g, unknown or other
  modified_base (406)..(406): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctgggtccgcaggctccgaggggaaggggctgggagtggggtggccaanataaagccaagatggaagtgagacatactatgtggactntgtgaaaggggccattcaccatcnccagagaacaacgaccaagagctcactgtaatctagacaaaatgaaacaggccctagagacgtcggaaggacacgggctggtgtaatctgtgcgagacgactcccccgtacgggtatacgg

SEQ ID NO: 383622 - DNA, 553 bp, Homo sapiens
  misc_feature: GZ8MTXP02IGWXW.21.40.D07.1.454.CMB.2.raw
  modified_base (549)..(549): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagcctggggggtccctgagactctcctgtgcagcctctggattcacctttagtagctattggatgagctggggtccgccaggctccgagggaagggggcgtgggaggtggggtgggccgaaacaagtaaaagacccgaaagaagtagggaaagtaggaggaacataactaatggtggactctgtgaaagggcccgattcaccatctccagagacaacgaccaagaagctcactgtatctgacaaatagaaacagaccctagagaggtacggaggaacgacggctagtagtattaactggtgcgagagactcccctaccggtanaacg

SEQ ID NO: 383623 - DNA, 540 bp, Homo sapiens
  misc_feature: GZ8MTXP02I4IRN.21.40.D07.1.454.CMB.2.raw
  modified_base (305)..(305): a, c, t, g, unknown or other
  modified_base (390)..(390): a, c, t, g, unknown or other
  modified_base (411)..(411): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggttttccgtgtaggctattttagaaggtgtccagtgtgaggtgcagctggtggagtcgtggggggaggcttgggtccagccgtggggggtccctgagactctcctgtgcagcctctggattcacctttagtagctattggatgagctgggccncaggctccgaggggaaggggctggggagtggggtggaccaacagtaaaagccaaagatggaaagtgagacatactatgtggatcngtgaaagggccattcaacctntcacagacgacaacgaccaagacgctacactgtatactagacaatagaacgacgacagagagtacggaggacgacgacgtagtacgtacgtagtagtgacgacgacgacgtacccgtaccgtacgtacg

SEQ ID NO: 383624 - DNA, 662 bp, Homo sapiens
  misc_feature: GZ8MTXP02HPGPP.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattctacctttagtagctattggatgagctgggtccgccaggcctccgaggggaaggggctgggaggtggggtggaccaaagaataaagccgaaagagtggaagtgagacatactatggtagactctggtagaaacgggggccctaagttcaacccattccctaccaaggacgaaaccgaaccgacccaaaggtacgtccctacgtaactttagtaacttccgttaggaacctaaaaatcggaaaaaccgacgggcccttagggaaaggtacggttaccgggaaacgggggtaaaccaaccgggggtcttaggttacggttaactttaaccggtggttaaccgggacggaaaggtaccggaacctttcccccccggtacggggttaaataccggg

SEQ ID NO: 383625 - DNA, 521 bp, Homo sapiens
  misc_feature: GZ8MTXP02HCRGY.21.40.D07.1.454.CMB.2.raw
  modified_base (342)..(342): a, c, t, g, unknown or other
  modified_base (406)..(406): a, c, t, g, unknown or other
  modified_base (479)..(479): a, c, t, g, unknown or other
  modified_base (484)..(484): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggagcttggtccagccgtgggggtccctgagactctcctgtgcagccctctggattcacctttagagctattggatgagctgggtccgccaggctccgaggggaagggctgggagtgggtggccaaanataaagccaaagatggaagtgagacatactatgtgactcgtgtaggaagggcgattcaccatcnccagagaacaacgaccaagcgctcactgtatctgaacaaatgaaacagacctagagacgtacgaggacacggntagtntacgttactgtgcgagagactccccgtacggatacgg

SEQ ID NO: 383626 - DNA, 546 bp, Homo sapiens
  misc_feature: GZ8MTXP02JL34X.21.40.D07.1.454.CMB.2.raw
  modified_base (520)..(520): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtgggggtccctgagactctcctgtgcagcctctggattcaccttagtagctattggatgagctgggtccatcaggctccgaggggaaggggcgtgggagtggggtggccaaacataaacgcaagataggaagtgagcatactagtgtgactctggtagaaaggggcccgtattccaacctatcctacccgaagacgaaccaaacgacccaaaggacgcctacacgttgtaactccgtgacaaaatcgaaacagcctagagtacgtcgaggacacgggctgtagtattcgngtcgacgagacgactcccccgaggta

SEQ ID NO: 383627 - DNA, 432 bp, Homo sapiens
  misc_feature: GZ8MTXP02GYR3D.21.40.D07.1.454.CMB.2.raw
  modified_base (424)..(432): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtggctccggtccgaggatgaggctgattattactgtgcagcatgtgatgacggctgagtggtccggtgttcggcggagggccaggctgaccgtctaggtcccagcccgaggctcgccccctggtcactctcgttccccgccctccgtccgacgccgacgacgtgacgcgggctggcaaggcgcatagnnnnnnnnn

SEQ ID NO: 383628 - DNA, 574 bp, Homo sapiens
  misc_feature: GZ8MTXP02I905S.21.40.D07.1.454.CMB.2.raw
  modified_base (341)..(341): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagctctcctgtgcagcctctggattcacctttagagctattggatgagctgggtccgccaggctccgaggggaaggggctgggagtgggtggccaanataaagcaagatggaagtgagacatactatgtagactgtgtgaaagggccgtattcaccatctaccagagacaacgaccaagacgctacacttgtatcgtacgacaaaagtcgaaactaggcccgttaggaaggacgtaccggaaggggaaccacggggtacttgggttagttaactttacgtagggttcggacggaaaggtacgtaccgttcccccgtacgggttaatacgg

SEQ ID NO: 383629 - DNA, 681 bp, Homo sapiens
  misc_feature: GZ8MTXP02G845O.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctcgtggattcacctttagagtctattggatgagcgtgggtccgccgaggcctaccggaggggaaggggcgtgggaggtggggtcggaccaaacgaataaaggcccaaaggagtagggaagtggaagaacagttactagtggtacggtactcgtggtagggaaacggggtcccaacgtttccaaaccctattacccgtacccgaaggaaacgaacccaaaaccggacccgaaagggacctaccttacaaccgtttgtaactccgttagaaacctaaaagtcgaaaaccacggtacccgtaggaacggaacggttacggaaaacggggtaccaacgggtcttacgggttagttaaacgtttaccgtgggtaacgacggaacggtaccgtacccgttaccccccggttacgggtaagtaaccgg

SEQ ID NO: 383630 - DNA, 650 bp, Homo sapiens
  misc_feature: GZ8MTXP02I837P.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcacgcctcgtggattctacctttagtagcttagttggatgagcgtcgggtccgccgaggcctaccggaggggaacggggcgtgggaggtggggtcggaccaaacgaagtaaagaccgaaagagtaggaagtgagacatactagtgtagactcgtggtaggaaacggggtcctaattcccgaacctatcccgtacgaaggacgaaccaaaccgaccaaaggactcctactacgttagtaacttcgaagaaccaaaagtcggaaaacctgtacccgtaggaacgacggtacggaaacggacccgacggggttacttggtttacgttaacgtttaccgtggggaacgaccggtaaaggaccggttacccctttacccccggtagggttaataccggg

SEQ ID NO: 383631 - DNA, 523 bp, Homo sapiens
  misc_feature: GZ8MTXP02G6IPR.21.40.D07.1.454.CMB.2.raw
  modified_base (381)..(381): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagcgtgggtccgccaggctccgaggggaaggggctgggagtgggtgccaacataagcaagataggaagtgagacatactatgtgactcngtgaagggccattcaccatcaccagacgacaacgccaagagctacactgtactctagacaaatgaacagcctagagagtacgaggacacgggctgtagtacttactggtgcgaagtacgacctcccccgtacggtaatacgg

SEQ ID NO: 383632 - DNA, 523 bp, Homo sapiens
  misc_feature: GZ8MTXP02GLUIQ.21.40.D07.1.454.CMB.2.raw
  modified_base (339)..(339): a, c, t, g, unknown or other
  modified_base (408)..(408): a, c, t, g, unknown or other
  modified_base (424)..(424): a, c, t, g, unknown or other
  modified_base (486)..(486): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagagctattggatgagctgggtccgcaggctccgaggggaggggctgggagtgggtgccaanataaagcaaagatggaagtgagacatactaatgtggactctgtggaaagggccattcacatctccaganacaacgccaagagctnactgtactctagacaaatgaaacagcctagagagtcgaaggacacggcttgtacgtattacnggtcgacgaaggacgacctcccccgtacggtatacgg

SEQ ID NO: 383633 - DNA, 548 bp, Homo sapiens
  misc_feature: GZ8MTXP02JQX7A.21.40.D07.1.454.CMB.2.raw
  modified_base (481)..(481): a, c, t, g, unknown or other
  modified_base (515)..(515): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctcgtggattcacctttagtagctattggatgagctgggtccgcaggctccgaggggaaggggctgggaggtggggtcggaccaaagagtaaaagccgaaagagtaggaagtgagacatactatgtagactcgtgtggaaagggccgattcacctatcctccaaggacgaacaacgaccaaagagctcactgtatcagacaaagtcgaacagcctagagngtacgaggacacgggcttggtacgtaatttacgnggtgacgaagacgtacctcccgtacggtatacg

SEQ ID NO: 383634 - DNA, 515 bp, Homo sapiens
  misc_feature: GZ8MTXP02HIWMR.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtccctgagactctcctgtgcagcctctggattcacctttagtagctattggatgagctgggtccgccaggctccgaggggaaggggctgggagtgggtggccaacataaagccaagatggaagtgagacatactatgtggactctgtgaagggcgattcacatctccagagacaacgcaagagctcactgtatctagacaaatgaacagcctagagaggtacgaggacacggctgtagtacttacgtgtgcgagacgactccccgtacggtactacgg

SEQ ID NO: 383635 - DNA, 521 bp, Homo sapiens
  misc_feature: GZ8MTXP02IMXH4.21.40.D07.1.454.CMB.2.raw
  modified_base (369)..(369): a, c, t, g, unknown or other
  modified_base (401)..(401): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctggggttttccttgttgctattttagaaggtgtccagtgtgaggtgcagctggtggagtcgtgggggaggcttgggtccagccgtggggggtcccctgagactctcctgtgcagcctctggattcacctttagtagctattggatgagctgggtccgcaggctccgagggaaggggctgggagtgggtggccaacataaagcaaagatggaagtgagacngtactatgtgactcgtgtgaagggcattcacntctcagagacaacgccaagagctacactgtatctagacaaatgaacagcctagagagtcgaggacacgggactggtagtacttacgtggtgcgagtacgactcccccgtacggtatacgg

SEQ ID NO: 383636 - DNA, 425 bp, Homo sapiens
  misc_feature: GZ8MTXP02GIC62.21.40.D07.1.454.CMB.2.raw
  modified_base (415)..(415): a, c, t, g, unknown or other
  modified_base (418)..(425): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctcctggccatcagtgggctccggtcgaggatgaggctgattattactgtgcagcatgtgatgacgctgagtggtcggtgttcggcggagggaccaggctgaccgtctaggtccagcccaaggctcgccccctggtccactctcgttccccgccctcctccagccgacgactgacgcgggctggcaaggcgcanagnnnnnnnn

SEQ ID NO: 383637 - DNA, 541 bp, Homo sapiens
  misc_feature: GZ8MTXP02IVGCG.21.40.D07.1.454.CMB.2.raw
  modified_base (422)..(422): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattctacctttagtagctattggatgagcgtgggtccgccaggctaccgaggggaaggggcgtgggagtggggtcggaccaaacgaagtaaagccaaagatagggaagtgagacatactatgtagactcgtgtgaaggggcattcacatctcaganacaacgaccaagagctcatgtactctagacaaatcgaaacacgctagagacggtacgaggaccacggcttagtagtacttacgtgtgacgaagacgacctcccccggtacgtagtacgg

SEQ ID NO: 383638 - DNA, 574 bp, Homo sapiens
  misc_feature: GZ8MTXP02JCVZ5.21.40.D07.1.454.CMB.2.raw
  modified_base (520)..(520): a, c, t, g, unknown or other
  modified_base (535)..(535): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtgggttttccttgttgctattttagaaggtgtccagtgtgaggtgcagctggtggagtcgtgggggaggcttgggtccagccgtggggggtccctgagactctcctgtgcagcctctggattcactttagagctattggatgagcgtgggtccgcaggctccgaggggaaggggctgggagtggggtggaccaacataaagcaagatggaagtgagacatactatgtagactcgtggtggaaaggggcccgtaattccaaccctatcccgtaccaggaacgaaccaaaccgaccaaagtacgcctacaacttgtaactccgtagacaaaatcggaaacagcctaggagacggtcggaaggcaaccgggtnttaggtatacttcgngtaacggcgaacggacgtaccgtccccgtacggtatcgg

SEQ ID NO: 383639 - DNA, 578 bp, Homo sapiens
  misc_feature: GZ8MTXP02I78CT.21.40.D07.1.454.CMB.2.raw
  modified_base (432)..(432): a, c, t, g, unknown or other
  modified_base (478)..(478): a, c, t, g, unknown or other
  modified_base (513)..(513): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctggagactctcctgtgcagcctctggattcacctttagtagctattggatgagctgggtccgccaggctccgaggggaaggggctgggaggtgggtcggaccaaacaagtaaagccaaagataggaaagtgaagacatactatggtgactcgtgtggaaaggggccctattccacctatccaccagaanaccaaacgccaaagcgctcaactgtactctagaacaaatgaaaccngcctaggaacgacggtacggaggaccaccggggtnttaggtacgttaacgttcgtggaacggacggaacgaccgtacccttccccggtacggtaatacgg

SEQ ID NO: 383640 - DNA, 521 bp, Homo sapiens
  misc_feature: GZ8MTXP02I16OF.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccaggcctggggggtccctgagactctcctgtgcagcctctggattcacctttagtagctattggatgagctgggtccgcaggctccgaggggaaggggctgggagtgggtggccaacataaagccaaagatggaagtgagacatactatgtgactctgtgaagggccgatcacatctcagagacaacgaccaagacgctacacttgtatctagactaaatcgaacagccctagacgagtacggaggacacggctagtgtacttacgtgtgcgagacgactccccgtacggtatacgg

SEQ ID NO: 383641 - DNA, 606 bp, Homo sapiens
  misc_feature: GZ8MTXP02HGMCS.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctctggattcacctttagagctattggatgagcgtgggtccgcaggctccgaggggaaggggctgggagtggggtgccaacataaagccaaagataggaagtgagacatactatggtagactcgtgtaggaacggggccgattccacctattcctacgaagacgaacaaaccgaccaaagacgctacacttagtactcgtagaacctaaagtcgaaacgagacccgttaggaaacgtacggtacggaacgggaccgtaaccgggtcctagggttagttaacgtttaaccgtggtaacggacggtaacggtacggtaccttaccccccggttacgggttaataacggg

SEQ ID NO: 383642 - DNA, 550 bp, Homo sapiens
  misc_feature: GZ8MTXP02GM74Q.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtccctgagactctcctgtgcagcctctggattcacctttagtagctattggatgagctgggtccgccaggctccgaggggaaggggctgggaggtggggtggaccaaacataaagccaagatggaagtgagacatactatgtgactcgtggtgaaaggggccctaattccaaccatcctaccagacgaccaacgccaaagcgctcactgtactctagacaaaagtcgaaacaggcctagagacgtacgaaggacacgggtctaggtacgtaattcgtgtgtcgaagtacgtacctcccccgtacggtatacgg

SEQ ID NO: 383643 - DNA, 519 bp, Homo sapiens
  misc_feature: GZ8MTXP02I5FUC.21.40.D07.1.454.CMB.2.raw
  modified_base (482)..(482): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttgggtccagccgtggggggtccctgagactctcctgtgcagcctctggattcacctttagagctattggatgagctgggtccgcaggctccgaggggaaggggctgggagtgggtggccaacataaagccaaagatgggaagtgagacatactatgtgactctgtgaaagggccgattcaccatctaccagagacaacgccaaagagctacactgtatctgacaaagtgaaacagcctagagagtcgaggacacggctaggtntacttactgtgacggagagacctcccctcggtatacg

SEQ ID NO: 383644 - DNA, 622 bp, Homo sapiens
  misc_feature: GZ8MTXP02G3021.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattcacctttagagtctattggatgagcgtgggtccgccgaggcctccgaggggaaggggcgtgggaggtggggtcggaccaaacgaagtaaaagccgaaagagtagggaaagtgaagaacagtactagtgtaggactcgtgtaggaaacgggccgtaattccaacctatccctaccaaggacgaaccgaaaccggaccaaagaacgcctacaccgttgtacttcgtagaacctaaaagtcggaaaccacggtaccctaggaacgaacggtacggaacggaccgacggggtctaggttagttaaactttcgtagggcgacggtaacgaccgtaccgtaccccgtacggtagtacgg

SEQ ID NO: 383645 - DNA, 577 bp, Homo sapiens
  misc_feature: GZ8MTXP02G4A5Q.21.40.D07.1.454.CMB.2.raw
  modified_base (387)..(387): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagagctatggatgagctgggtccgccaggctccgaggggaaggggctgggagtgggtggaccaacagtaaagccaaagataggaagtgaagacatactatgtggactcgngtggaaagggccatcacatcctacagacgacaacgaccaagacgctacgactgtactccgtagactaaaatcggaaacacggaccctaggaaggacgttaccgggaaaggaccaaacggggtcctagggttcgttaactttaacgtggtgaccggtaagacggtaacctcccccggtacgggtaatacgg

SEQ ID NO: 383646 - DNA, 646 bp, Homo sapiens
  misc_feature: GZ8MTXP02JHW1B.21.40.D07.1.454.CMB.2.raw
  modified_base (350)..(350): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggaggcttggtccagccgtgggggtccctgagactctcctgtgcagcctctggtattctacctttagagctatggatgagcgtggtccgccgaggctccggaggggaggggcgtgggaggtggggtcggaccaaanaagtaaagccgaaagagtaggaagtgaagacatactagtggtagacttcgtaggtggaaacggggtccctaattccaacctatccctaccgaggaaacgaaccaaacggacccaaaggacgccctacaacgttgtaaactccgtagaacctaaaagtcggaaaacctcggtacccgtaagggaacgtacggtaccggggaacgggtaaccaaaccggggtcttaaagggttcgttaaacgttccgtggtaaggaccgaaggtaccgtacccttacccccgttacgggtaatacggg

SEQ ID NO: 383647 - DNA, 579 bp, Homo sapiens
  misc_feature: GZ8MTXP02HMYUZ.21.40.D07.1.454.CMB.2.raw
  modified_base (474)..(474): a, c, t, g, unknown or other
  modified_base (512)..(512): a, c, t, g, unknown or other
  modified_base (533)..(533): a, c, t, g, unknown or other
  modified_base (576)..(576): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctgggtccgccaggctccgaggggaaggggctgggaggtgggtggaccaacataaagccaaagatggaagtgagacatactatgtgactcgtgtggaaaggggcccattccgaaccatcctccagacgaaccaaacgccaaagacgcctcacttgtatcgtagacaaaagtgaaaaccgngaccgtaggaacgtacggtacggaacggacgacgggtnttaggtacgttaacgttacgnggtaacggacggaacgtacgtacccttcccccgtaggttaacncgg

SEQ ID NO: 383648 - DNA, 552 bp, Homo sapiens
  misc_feature: GZ8MTXP02H1L5P.21.40.D07.1.454.CMB.2.raw
  modified_base (476)..(476): a, c, t, g, unknown or other
  modified_base (517)..(517): a, c, t, g, unknown or other
  modified_base (549)..(549): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctgggtccgcgaggcctccgaggggaaggggcgtgggaggtggggtggaccaaacaataaaagccaaagagtggaaagtgaagacattaactatggtgactcgtgtaggaacggggccgattcacctatcctaccagacacaacgaccaagacgctacacttgtatctagacaaatgaaacngacctagacgagtcgaaggaccacggctgtcgttattacgngtcgcgtaaggactacgtcccccgtacggtanacg

SEQ ID NO: 383649 - DNA, 521 bp, Homo sapiens
  misc_feature: GZ8MTXP02ILMKA.21.40.D07.1.454.CMB.2.raw
  modified_base (339)..(339): a, c, t, g, unknown or other
  modified_base (408)..(408): a, c, t, g, unknown or other
  modified_base (411)..(411): a, c, t, g, unknown or other
  modified_base (416)..(416): a, c, t, g, unknown or other
  modified_base (477)..(477): a, c, t, g, unknown or other
  modified_base (489)..(489): a, c, t, g, unknown or other
  modified_base (518)..(518): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcagcctctggattcacctttagtagctattggatgagcgtgggtccgccaggcctccgaggggaaggggctgggagtgggnggaccaacaataaagccaaagataggaagtgagacatactatgtagactcgtgtgaagggcattcaccntcncaganacaacgaccaagagctcactgtatctagacaaatgaacagcctagagagtcgagacacggntagtgtaattcnggtgcgagacgactcccccgtaggttaanacg

SEQ ID NO: 383650 - DNA, 520 bp, Homo sapiens
  misc_feature: GZ8MTXP02I4V4E.21.40.D07.1.454.CMB.2.raw
  modified_base (482)..(482): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtgggttttccttgttgctatttagaaggtgtccagtgtgaggtgcagctggtggagtctgggggaggcttggtccagccgtggggggtccctgagactctcctgtgcagcctctggattcacctttagtagctattggatgagctgggtccgccaggctccgaggggaaggggctgggagtggggtggaccaacataaagccaaagagtaggaaagtgaagacagtactatgtaggactgtagtgaaagggccattcaccattcacagagacaacgccaagacgctcactgtatcagacaaatgaacagcctagagagtcgaggactacggntgtagtactgtgcgacgagacgcctcccgtacgtatcg

SEQ ID NO: 383651 - DNA, 532 bp, Homo sapiens
  misc_feature: GZ8MTXP02IK2BW.21.40.D07.1.454.CMB.2.raw
  modified_base (342)..(342): a, c, t, g, unknown or other
  modified_base (416)..(416): a, c, t, g, unknown or other
  modified_base (494)..(494): a, c, t, g, unknown or other
  modified_base (528)..(528): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggcttggtccagccgtggggggtccctgagactctcctgtgcagcctctggattcacctttagtagctattggatgagctgggtccgcgaggctccgaggggaggggctgggagtgggtgccaanataagccaagatggagtgagacatactatgtgactcgtgtgaaggcattcacatctcagacacaacgcaagacnctacacttgtatctagacaaaatcgaaaacggtacctagaacggagtcggaggacacgggtctgttacgtacttacgnggtaacgcgaagacgacgttcccccgtacggtanacgg

SEQ ID NO: 383652 - DNA, 659 bp, Homo sapiens
  misc_feature: GZ8MTXP02FR9W9.21.40.D07.1.454.CMB.2.raw
  modified_base (263)..(263): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctcnggattcacctttagagctagttggatgagcgtgggtccgccgaggcctccggaaggggaacggggcgtaggggaggtggggtcggaccaaacgaagtaaaaggccaaaggagtagggaaagttggaagaactataacgtagtggtacggtacctcgttggtagggtaaacgggggcctaacgttccaaccctagttccctacccgaaggaaccgaaaccgaacccgaccgaaaggacgacctacgaacttagtaacttaccgtagaaacctaaagtacgaaacgtaacgcccgtaaggaacgggtacgtaacggaacgggacaacggggtctggttacttacgttactggtaacgacgaacggtacgtacccttacccccgtacgggttaatacgg

SEQ ID NO: 383653 - DNA, 415 bp, Homo sapiens
  misc_feature: GZ8MTXP02G3BP8.21.40.D07.1.454.CMB.2.raw
  modified_base (367)..(367): a, c, t, g, unknown or other
  modified_base (402)..(402): a, c, t, g, unknown or other
  modified_base (408)..(415): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggccccaaactcctcatctataggaataatcagcggccctcaggggtccctgaccgattctctggctccaattctggcacctcagcctccctggccatcagtgggctccggtccgaggatgaggctgattatactgtgcagcatgtgatgacgctgagtggtccggtgtcggcggagggaccaggctgaccgtctaggtccagccaggctcgcccctggtcactctcgtcccnccctctcgacgcacgactgacgcggctggcaggcncatagnnnnnnnn

SEQ ID NO: 383654 - DNA, 548 bp, Homo sapiens
  misc_feature: GZ8MTXP02IV1JQ.21.40.D07.1.454.CMB.2.raw
  modified_base (340)..(340): a, c, t, g, unknown or other
  modified_base (481)..(481): a, c, t, g, unknown or other
  modified_base (505)..(505): a, c, t, g, unknown or other
  modified_base (519)..(519): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtccctgagactctcctgtgcagcctctggattcacctttagagctattggatgagctgggtccgccaggctccgaggggaggggctgggagtgggtgaccaanagtaaagcaagatggaaagtgagacatactatgtgactctggtaggaaacggggccctaatttccaacccattcccgtaccgaaggaacgaaccaaaccggccaaagacgctacacttgtatcctagaccaaagtgaaacngcctagacgagtcgaggacacggntgtacgtattacgngtgacgagacgactccccgtaggtatacg

SEQ ID NO: 383655 - DNA, 604 bp, Homo sapiens
  misc_feature: GZ8MTXP02HCQUL.21.40.D07.1.454.CMB.2.raw
  modified_base (265)..(265): a, c, t, g, unknown or other
  modified_base (348)..(348): a, c, t, g, unknown or other
  modified_base (419)..(419): a, c, t, g, unknown or other
  modified_base (444)..(444): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggttttccgtgtaggctattttagaaggtgtccagtgtgaggtgcagctggtggagtcgtgggggaggcttggtccagccgtggggggtccctgagactctcctgtgcagcctntggattcacctttagagtctattggatgagcgtgggtccgcgaggcctccgaggggaggggctgggaggtgggtcgaccaaanataaagccaaagataggaagtgagacatactagtgtagacttgtgtggaaaggggccctaattccaacctntccacagacaacaacgacaagtacnctacgtacttgtaactcgagaactaaacgtaacgaacgaacgacgtacgaaggtaacggtacggaacgggaaccggacggtacgttacggttacgttacgttacgttacggtaacggtacggaacggtacggtaccgtaccccggttaccggtacgtacg

SEQ ID NO: 383656 - DNA, 672 bp, Homo sapiens
  misc_feature: GZ8MTXP02JKC5Z.21.40.D07.1.454.CMB.2.raw
  modified_base (300)..(300): a, c, t, g, unknown or other
  modified_base (338)..(338): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagctgggttttcctgttgctatttagaaggtgtccagtgtgaggtgcagctggtggagtcgtgggggagcttggtccagccgtgggggtccctgacgactctcctgtgcagcctcgtggattctactttagtaactagtgatgagcgtgggtccnccgaggctccgagggagggcgtggagtgggtgccaaanataaagcaagagtaggaagtgagacatacgtatggtaggactcgtaggtagaacggggcccgtattacccgactacttcccgtacccgaaggaaccgaacccgaaaccgggacccaaaagggccgtacctccaaacgtttcgtaaacttccgtacggaaaccctaaaagtacggaaaacctcggacccgtagggaaacgtacgggtaccggaaaaccggacgtaaacccggggtttcttaggttaacgtttaacgttaacggtacggtacggtaacggtaaacgtaacccggttaccccgttaccccccggttaacgggtaactaccggaccgg

SEQ ID NO: 383657 - DNA, 579 bp, Homo sapiens
  misc_feature: GZ8MTXP02JK4JX.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcgttggtccagccgtgggggtccctgagctctcctgtgcagcctctggattctacctttagtagctattggatgagcgtgggtccgccgaggcctccgaggggaaggggctgggaggtggggtgaccaacaagtaaagccaaagagtaggaagtgaagacatactatgtagactcgtgtaggaacgggcctattccaaccatccctaccaagacgaacaaccgaccaaagacgctacactgtaactcgtagaactaaagtcgaaactcgcctagaagaggtaccggaggaccgacgggtctaggttgtaacttacgtggtaacggacgaacgaacgtaccgtcccccgtacggtaatacgg

SEQ ID NO: 383658 - DNA, 552 bp, Homo sapiens
  misc_feature: GZ8MTXP02HHQLF.21.40.D07.1.454.CMB.2.raw
  modified_base (339)..(339): a, c, t, g, unknown or other
  modified_base (491)..(491): a, c, t, g, unknown or other
  modified_base (515)..(515): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattcacctttagagctattggatgagcgtgggtccgcaggctccgaggggagggctgggagtgggtgccaaanataaagccaagagtaggaagtgagacatactatgtgactcgtgtggaaagggtccattcactatcctaccaagacgaacaacgccaaaggacgcctacacgttgtactcgtacgaacaaatacgaaacacgcctagagacgtacggaggacncgggtctacgtagttacttacggngtaacgacgacgacgtacccgtacccgtagtagtacg

SEQ ID NO: 383659 - DNA, 596 bp, Homo sapiens
  misc_feature: GZ8MTXP02JS1HI.21.40.D07.1.454.CMB.2.raw
  modified_base (546)..(546): a, c, t, g, unknown or other
  modified_base (592)..(592): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattctacctttagtagctattggatgagcgtgggtccgcaggctccgaggggaggggctgggagtggggtgaccaaacagtaaagccaaagagtaggaagtgaagacatactagtgtgactcgtgtggaaagggcccgtattccaccatctaccagacgaaccaacgccaagagccttacactgtactcgtagaacaaagtcgaaactagaccctaggaacgtaacggtaccggaacgggacccgaaacggggtccttaggtacgttaacgttttaacgngggtaacgacggaaggtacgaacccgttcccccgtacggggttaanacgg

SEQ ID NO: 383660 - DNA, 604 bp, Homo sapiens
  misc_feature: GZ8MTXP02GWVLU.21.40.D07.1.454.CMB.2.raw
  modified_base (351)..(351): a, c, t, g, unknown or other
  modified_base (536)..(536): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctcgtggacttctacctttagtagtctattggatgagcgtgggtccgcgaggctccggaggggaaggggctgggaggtgggtcggaccaanataaagccaaagataggaagtgaagactatactatggtaggactcgtgtagggaaacggggtcctaattccaaccattccctaccgaagacgaaccaaccgaccaagacgcctacacttgtactcgtagaactaaaagtcgaaacacgcctaggaacgtacggtacggaaggaccgacggggttnttaggtacgttacttacggtggtaacggaacggaacgtacgtacccgtaccccggttacggtaatcgg

SEQ ID NO: 383661 - DNA, 530 bp, Homo sapiens
  misc_feature: GZ8MTXP02FT1LI.21.40.D07.1.454.CMB.2.raw
  modified_base (342)..(342): a, c, t, g, unknown or other
  modified_base (366)..(366): a, c, t, g, unknown or other
  modified_base (449)..(449): a, c, t, g, unknown or other
  modified_base (527)..(527): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtggggggaggcttggtccagccgtggggggtccctgagactctcctgtgcagcctctggattcacctttagtagctattggatgagctgggtccgccaggctccgaggggaggggctgggagtgggtgcaanataagcaagataggaagtgagacntactatgtgactcgtgtgaagggcatcaccatctacagacgacaacgccaagagctacactgtactcgtagacaaatgaaacngcctagagagtcggaggacacgggtctggttacgtattacgtggtcgacgaagacggaccttaccccgtacggttaanacg

SEQ ID NO: 383662 - DNA, 639 bp, Homo sapiens
  misc_feature: GZ8MTXP02GGJWP.21.40.D07.1.454.CMB.2.raw
  modified_base (347)..(347): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtggggggtccctgagactctcctgtgcagcctcgtggattctacctttagtagctattggatgagcgtgggtccgccgaggctccgaggggaaggggctgggaggtgggtgaccaanataaagccaagataggaagtgaagacataactagtggtgactgtaggtggaaacggggtccgtaattccaacctatcctacccgaaggaacgaaccgaaaccggacccaaaggaacgtccctacgaacgttattacgtacctaggaaacctaaaagttcgaaaacccgtaggtacccgtaagggaaagaacgggttacggaaacgggaaacccgtaacgggggtcttagggttacgttaagttaccgttgggtaacgcggaagacgtaccgttcccccggtacggtactagg

SEQ ID NO: 383663 - DNA, 532 bp, Homo sapiens
  misc_feature: GZ8MTXP02GL7H3.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtccctgagactctcctgtgcagcctctggattcacctttagtagctattggatgagctgggtccgccaggctccgaggggaaggggctgggagtggggtgccaacataaagccaagatggaagtgagacatactatgtgactctgtgaaagggcgtattcaccatcctaccagacacaacgaccaaagacgctacaacgttgtaactctagaacaaatgaaacacgcctagagagtcggaggacacggctgtcgtattacgtgtaagcgtagacgactccccgtacggtatacgg

SEQ ID NO: 383664 - DNA, 760 bp, Homo sapiens
  misc_feature: GZ8MTXP02HQBP0.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcgttggtccagccgtgggggtccctggagtactctcctgtgcagcctctggcttctacttagtagctatggatgagtcgtgggtcccgccgtaggcctaccggaaggggaacggggctggggaggttggggtacggacccaaaagaagtaaaagccgaaaaggagtagggaagtaggaagaacattaacgtaagttggtagggtaacttcgtaggttacggggaaacgggtcccgtaaactttcccaaccctattccccgttacccgaaaggaaacgaaacccgaaaccggaccctaaaaggacgtaccctacccgtactttaggttaactttacccgtagaaaccctaaaaagttaccggaaaaaccgtacggaaccccgttaggggtaaagggtaaaacgggtaccgggaaaacgggtaaacccggaaacccggggtcggtttacggtttacgttaacgttttaaacccggtgggttaacggacccggtaaaggtaaccgttacccgttacccccccggttaagggttaaacgtaccggg

SEQ ID NO: 383665 - DNA, 631 bp, Homo sapiens
  misc_feature: GZ8MTXP02GWBF2.21.40.D07.1.454.CMB.2.raw
  modified_base (464)..(464): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtgggttttccttgttgctattttagaaggtgtccagtgtgaggtgcagctggtggagtcgtgggggagcttggtccagccgtgggggtccctgagactctcctgtgcagcctctggattcacctttagagctattggatgagcgtcgggtccgccgaggcctaccgaggggaaggggctgggaggtggggtcgaccaacagtaaagccaaagatggaagtgaagactatactagtgtaggactcgtagtaggaaacggggtccctaattccaaccattccctaccgaagacgaaccaaaccggaccaaaggacncctacacgttagtactaccgtagaacctaaaagtcgaaaacgcggtacctagggaaacgtacggtaccgggaaaggtaccgaccgggtcttaggtacgtttaatttacgtgggtaacgaaccggaaggtacggtaccccttaccccccggtacgggtttaaagtacg

SEQ ID NO: 383666 - DNA, 600 bp, Homo sapiens
  misc_feature: GZ8MTXP02JLPGL.21.40.D07.1.454.CMB.2.raw
  modified_base (344)..(344): a, c, t, g, unknown or other
  modified_base (494)..(494): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctggagactctcctgtgcagcctctggattcacctttagagctattggatgagctgggtccgccaggctccgaggggaaggggctgggagtgggtggaccaanataaagccaaagataggaaagtgaagacatactagtgtggactcgtgtaggaaacgggggcccaagttcccaaccattccctaccaaggaacgaaccaaacgaccaaaggacgctacacttagtactacgtagaaccaaaatcgaaaacncgccgtaggaacgacggtacggaacggaccgacgggtacgttaggtacgttaacgttacgtggtaagacggaagtacgtacccgttcccccgtacggtaacgtacg

SEQ ID NO: 383667 - DNA, 505 bp, Homo sapiens
  misc_feature: GZ8MTXP02IO12P.21.40.D07.1.454.CMB.2.raw
  modified_base (396)..(396): a, c, t, g, unknown or other
  modified_base (404)..(404): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctgggtccgccaggctccgagggaaggggctgggagtgggtggccaacataaagcaagatggaagtgagacatactatgtgactctgtgaagggcattcacntctcaganacaacgcaagagctcactgtatctgacaaatgaacagcctagagagtcgaggacacggctgtagtattactgtgcgagacgtactccccgtacgacgtacg

SEQ ID NO: 383668 - DNA, 545 bp, Homo sapiens
  misc_feature: GZ8MTXP02G02MM.21.40.D07.1.454.CMB.2.raw
  modified_base (473)..(473): a, c, t, g, unknown or other
  modified_base (502)..(502): a, c, t, g, unknown or other
  modified_base (516)..(516): a, c, t, g, unknown or other
  modified_base (543)..(543): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctgggtccgccgaggctccgaggggaaggggctgggagtgggtggaccaacataaagccaaagagtaggaagtgagacatactatggtgactcgtgtggaagggccctattccaccatcctccagacgaacaacgccaaagacgcctacacttgtaactcgtagactaaaagtgaaacnggcctaggagacgtcggaggacacgggtntagtactacttcgngcgacgagacgtcctcccgtacggtancg

SEQ ID NO: 383669 - DNA, 520 bp, Homo sapiens
  misc_feature: GZ8MTXP02G8FVX.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctgggtccgccaggctccgaggggaggggctgggagtggggtggccaacataaagccaaagatgggaaagtgaagacatactatgtggactctgtggaagggcgattcacatctccagagacaacgccaaagagctcactgtatctagacaaaatgaaacagcctagagagtacgaggacacggctagtgtattactgtgcgagacgactccccgtacggtatacg

SEQ ID NO: 383670 - DNA, 434 bp, Homo sapiens
  misc_feature: GZ8MTXP02JAC6D.21.40.D07.1.454.CMB.2.raw
  modified_base (426)..(434): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtgggctccggtcgaggatgaggctgattatactgtgcagcatgtgatgacgctgagtggtccggtgtcggcggagggccaggctgaccgtctaggtccagcccaaggcctcgccccctcgggtccacttcgtcgttccccgcccttcctccgagccgacgactggacggcgggctggcgaaggcgcatgnnnnnnnnn

SEQ ID NO: 383671 - DNA, 670 bp, Homo sapiens
  misc_feature: GZ8MTXP02G0L6P.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattcacctttagtagctattggatgagcgtgggtccgccgaggctccggaggggaaggggcgtgggaggtggggtcggaccaaacagtaaaagccgaaagagtagggaaagtgaagaacatactagtggtggactcgtagggtacgggaaaggggcccgtaattcccgaacctactccctaccgaagacgaaccaaaccgaccaaagacgcctacacgttagtactcgtagaaccaaaagtcggaaaacacggtacccgtaaggaacggtaacggttaccggaaaacggggaacccgtacccggggtacttacgggttacgtttaaaacgtttccggttaggtaacgggacggtaaacggaaccgttacccgttaccccccgttaccggggtaattaacccggg

SEQ ID NO: 383672 - DNA, 579 bp, Homo sapiens
  misc_feature: GZ8MTXP02G7MP2.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagcgtgggtccgccaggcctccgaggggaacggggctggggaggtggggtcggaccaaacgaagtaaagccgaaagagtaggaaagtgagacatactatgtagactcgtgtaggaagggccctagttccaccatccctacgaagacgaaccaacgacccaaagacgcctactactgtatcgtagacaaagtgaaaccagcctagaacgacggtacggacggacgacggtacgttaggtagttaacttacgtggtcgacggaagacgtacgtccccctacggtatacg

SEQ ID NO: 383673 - DNA, 826 bp, Homo sapiens
  misc_feature: GZ8MTXP02FU70L.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagcttgggttttccttgttgcttatttagaaggtgtccagtgtgaggtgcagcgtggtggagtcggtgggggaggtcgttggtccaggccggtgggggtccctgagtacctctcctgtcgcacgcctcgtggtacttccgtaccttttaggtagtcttaagttggatggagtcgttcggggtcccgccgaggcctaccggaagggggaacggggtctaggggaggttcgggggtacgaccccaaaacgtaaagtaaaacgccgaaaaggtagtaggggaaaagtcggaaacgtaactagttaaccgtaaggttcggttacgggtacctttagttagggggtaacgggaaaacgggggtccccttaaacgttttacccgaaacccttaaccgtttacccttaacccccggaaaagggtaaccggaaaaaccccgaaaacccgggtacccccgtaaaaaaaggggcccgtacccctttaacctaaaacccggtttgtttaaaccttaccgttaacggaaaaccaaaaagttacggtaaaaccacggtaccccgttaaggggaaacgggtaacggttacccgggggaaaaggacccgtaccggggtactttgggttaagttactttaccgttggaacggtcggaaagtacgggtaccctttacccccggtacggttaaatcggg

SEQ ID NO: 383674 - DNA, 527 bp, Homo sapiens
  misc_feature: GZ8MTXP02IOPKG.21.40.D07.1.454.CMB.2.raw
  modified_base (496)..(496): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcctgttgctattttagaaggtgtccagtgtgaggtgcagctggtggagtcgtgggggaggcttggtccaggccgtggggggtcccctgagactctcctgtgcagcctctggattcactttagtagctattggatgagctgggtccgccaggcctccgaggggaaggggctgggaggtggggtcggaccaacaataaagccaaagagtaggaagtgagacatactaatggtgactctgtgaagggcattcacatctcagagacaacgcaagagctacactgtatcagacaaatagaacagcctagaagacggtacgaggacacgggctgtgtaacttagngtaagcgaagacgctcccccgtggactacgg

SEQ ID NO: 383675 - DNA, 555 bp, Homo sapiens
  misc_feature: GZ8MTXP02HQE6F.21.40.D07.1.454.CMB.2.raw
  modified_base (526)..(526): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagagctattggatgagctgggtccgcaggcctccgaggggaggggctgggaggtgggtcggaccaaacataaaagccaaagatggaagtgagacagtactatgtaggactcgtaggtaggaagggcccgtattcaacctatccctaccaaggaacgaaccaacgccaaaaggctctacacttgtaatctagacaaaagtcgaaacagcctaggactaaggcgaaggacacggctgtgttacttacgtgngcgagtacaccgtcccctacggtatacgg

SEQ ID NO: 383676 - DNA, 619 bp, Homo sapiens
  misc_feature: GZ8MTXP02JNAAY.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggaggcgttggtccaggccgtgggggtccctgagactctcctgtgcagcctctggtacttctactttagagtctattggatgagtcgtcgggtccgccgaggcctaccggaaggggaacggggctggggaggttggggtcggaccaaagaagtaaaggccgaagtagtagggaacgtgaagacatactagtggtagactcgtaggtaggaaacggggcctaaatcaacctattcccgaccaaggacgaaccaaccgacctaaagcgcttacacttgtaactcgtagaaccaaaagtcgaaactcgccgttaggacgacggtacgaagggaccacggggttcttagttacgttacttacgtggaacgaacggtagtaccgtacccgttaccccggtacgtagacg

SEQ ID NO: 383677 - DNA, 655 bp, Homo sapiens
  misc_feature: GZ8MTXP02G2DAE.21.40.D07.1.454.CMB.2.raw
  modified_base (349)..(349): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattcactttagtagctattggatgagcgtgggtccgtcgaggcctccgaggggaaggggctgggaggtggggtcggaccaaanaataaagccaagataggaagtgaagacatactaagtggtagactcgtaggtgggaaacgggtcccgtaattccaacctacttcccgtacccgaaaggaacgaaaccaaacccggacccgaaaaggacgtcccttacgaaccgttgttaaacttccgtagaacctaaaagtcgaaaactacggtaccgtaggaacgggaagtaccgggaagggaacccgaaccgggtcgtacggttaggttaactttaacgtggtaacggacggtaacggaacggtaccttaccccccgtaggggttaactaccggg

SEQ ID NO: 383678 - DNA, 682 bp, Homo sapiens
  misc_feature: GZ8MTXP02HO73Q.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctggagactctcctgtgcagcctctggattcacctttagtagctattggatgagcgtgggtccgccaggctccgaggggaaggggctgggaggtgggtggaccaacgagtaaagccaagagtaggaagtgaagacatactaatggtacgtactcgtgtaggaaacggggtccgaagtttccaaccattccgtacccaaggaagaacgtaaaccggacccaaaaggacggtacctacctaaccgtttggtaacttaccgttaggaaccctaaaagtacggaaaaccgaacgttacccgtaggtaaaaggaacggttaccggggaaaacgggttacccgaaacccgggggtcgttacggttagggtaaactttaaccgtggttaacggaaccggaaaggtaccggtaacccgtacccccccggttaggggttaaactaaccggg

SEQ ID NO: 383679 - DNA, 573 bp, Homo sapiens
  misc_feature: GZ8MTXP02GOW37.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagagctatggatgagcgtgggtccgcaggctaccgaaggaggggctgggagtggggtggaccaaacagtaaaagccaaagagtaggaaagtgaagacatactaatggtaggactcgtgtaggaaacggggcctaagttccaacccattcccgtacccagaacgaacaaaccgacccaaagacgctacacttgtactcgtagaaccaaaagtcgaaacagccctaggaacgaggtacggaggacacggctagttagtacttacgtgtgacgagacgacctccccgtacggtatacgg

SEQ ID NO: 383680 - DNA, 658 bp, Homo sapiens
  misc_feature: GZ8MTXP02G6B5C.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagagctattggatgagtctgggtccgccgaggcctccgaggggaaggggcgtgggaggtgggtggaccaaacgaagtaaagccaaagagtaggaaagtgagacatactagtgtaggactcgtggtaggaaacgggccgtaaatttccgaacccgtaatccctaccgaaggaacgaaacccaaaccggacccgaaaaggacgtaccgttacaaccgttggtaaacttcgttacggaacctaaaagttcggaaaaacctcggaccccgttaagggaacggtaacgggttaccggaaacgggtaccgaaccgggttcgttaggttacgttaagttaaccgttggcggacggtagacggtacctcccccggtacgggtataacgg

SEQ ID NO: 383681 - DNA, 669 bp, Homo sapiens
  misc_feature: GZ8MTXP02HH1N7.21.40.D07.1.454.CMB.2.raw
  modified_base (355)..(355): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcctacctttagtagctagttggatgagcgtgggtcccgccgaggctcccgaggggaacggggctgggagtggggtcggaccaaanagtaaaagccaaaggatggaagtgagacatactatgtagactcgtggtaggaacggggcctaatttccgaacctatccctacccgaaggaacgaaccgaaaccgcccaaaaggtcgccctacgtaaacctttggtaaacttccgtacggaacctaaaagttacggaaacctaggcccctagggaaacggacgggttacggaaacgggtacccgtaaacgggggtttgtacggtttaaagtttaccggtggttaggaaccgggttaaacgacggtaccccttaccccccgggtaccggttaacgtagggtcccgg

SEQ ID NO: 383682 - DNA, 432 bp, Homo sapiens
  misc_feature: GZ8MTXP02H95BA.21.40.D07.1.454.CMB.2.raw
  modified_base (421)..(432): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtcccctgaccgattctctggctccaattctggcacctcagcctccctggccatcagtggctccggtccgaggatgaggctgattattactgtgcagcatgtgatgacggctgagtggtccggtgttcggcggagggaccaggctgaccgtcgtaggtccacgccaggctcgcccccgtgtccactctcgttcccccaccctctccgagccgacgactgagcggctggcaaggcgcatagnnnnnnnnnnnn

SEQ ID NO: 383683 - DNA, 576 bp, Homo sapiens
  misc_feature: GZ8MTXP02G8RWA.21.40.D07.1.454.CMB.2.raw
  modified_base (475)..(475): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagcgtgggtccgccaggctccgaggggaaggggctgggaaggtggggtggaccaacgaagtaaagccaagagtaggaagtgagacatactatgtggactcgtgtaggaagggcctattccacatccacagacgaccaacgaccaaagacgcctacacgtgtatcgtagaccaaagtcgaaacncgcctaggagaggtacggaggacgacggtctagttacgttaactttacgtggtaacggacggaacgtacgtacccgttcccccgtacgggttaataccggg

SEQ ID NO: 383684 - DNA, 675 bp, Homo sapiens
  misc_feature: GZ8MTXP02H6HL1.21.40.D07.1.454.CMB.2.raw
  modified_base (196)..(196): a, c, t, g, unknown or other
  modified_base (466)..(466): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagcgtgaggtncagctggtggagtcgtgggggagtcttggtccaggccggtggggggtccctggacgtactctcctgtgcagccctcgtggattcctacctttagagtctagttggatgagtcgtcgggtccgcgaggctaccggaggggacggggtctaggggacggttggggacggacccaaaagtaagtaaaacgccgaaaggagtaggaagtgaagactataacgtaagtggtacggtaactcgtagtacgaaacggggtccatttacccacctacncccttacccgaaaggaacgaaacccaaaccggtacccaaaaggaccgtaccttacaaccgtttagtaacttaccgtagaaaccaaaaagtcggaaaaaccgcgttacccgtaaggacggtaaacgtcgggaaaacggtccgaaacggtctaggtacgttagttacgtgaaggcgaacgacgtaaccctttcccccgacggtttaacacg

SEQ ID NO: 383685 - DNA, 535 bp, Homo sapiens
  misc_feature: GZ8MTXP02GG5IB.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagcctggggggtccctgagactctcctgtgcagcctctggattcacctttagagctattggatgagctgggtccgccaggctccgaggggaaggggctgggagtggggtgaccaacataaagccaagatggaagtgagacatactatgtgactcgtgtggaagggccaattccacatcctccagagaaccaacgccaaagacgcctacacttgtactctagacaaatcgaaacagcctagagacgtacggaggacacgggtctgtagttacttagcgtgcgaagtacgacctccccgtacggtatacgg

SEQ ID NO: 383686 - DNA, 600 bp, Homo sapiens
  misc_feature: GZ8MTXP02FIM6E.21.40.D07.1.454.CMB.2.raw
  modified_base (344)..(344): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggggaggcttgggtccagccgtggggggtccctgagactctcctgtgcagcctctggattcacctttagtagctattggatgagctgggtccgccaggctccgagggaaggggctgggagtggggtggccaanataaaagccaaagatgggaaagtgagacatacgatgtggtacgtcttgtgggtaaacggggaccggtacttactaccaactcctacccaacggaagaaccgaaacccgaacccgaaacgaaggtacctaccaacctggttatccttaggacaaacgtagaaacagacccgtgagacggtcggaggacgaaccggcgttacgtcgttaattaccgttgtgccggaagacggtaactcccccgtacccggtagtaacg

SEQ ID NO: 383687 - DNA, 635 bp, Homo sapiens
  misc_feature: GZ8MTXP02I3NJ9.21.40.D07.1.454.CMB.2.raw
  modified_base (519)..(519): a, c, t, g, unknown or other
  modified_base (593)..(593): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtcagtgtgaggtgcagctggtggagtcgtggggggaggcgttggtccaggccggtgggggtccctgagactctcctgtgcagcctctggattcctacctttagagctagtggatgagcgtgggtccgccaggcctaccggaggggaaggggctggggaggtggggtcggaccaacaaagtaaaagccaaagagtaggaagtgaagacatactatggtaggactcgtaggtaggaaacgggggtccctaaagtttacccaaacctacttacccgtacccgaaggaaacgaaacccaaaccggacccgaaaggaccgccttaccaacgttgtaactcgtanaacgtaaaatacggaaacacgcctaggacggaagtcggaacggaccgacgggtcttaggtacgttaacttacgngtggacggaaggacgtaccttcccccggtaccggtaatacgg

SEQ ID NO: 383688 - DNA, 623 bp, Homo sapiens
  misc_feature: GZ8MTXP02I70RF.21.40.D07.1.454.CMB.2.raw
  modified_base (370)..(370): a, c, t, g, unknown or other
  modified_base (412)..(412): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttgggtccagccgtggggggtccctgagactctcctgtgcagcctctggattcactttagagctattggatgagctgggtccgccgaggctccgaggggaaggggctgggaggtgggtggaccaagataaagccaagatggaagtgagacntactatggtgactgtgtggaacggggcattcacatctcaganacaacgcaagcgactacacgttgtactcgtacgaacctaaaatcggaaacctacggtcccgtaaggaacggtaacggttaccgggaaacgggtaaacccgtacggggtacgttacggttaggttaaaacgttttccgtaggggttaacgaccggggtaaagtaaccggtacccctttcccccccggtttacgggggtaaactttaaccggg

SEQ ID NO: 383689 - DNA, 532 bp, Homo sapiens
  misc_feature: GZ8MTXP02GDUC7.21.40.D07.1.454.CMB.2.raw
  modified_base (340)..(340): a, c, t, g, unknown or other
  modified_base (353)..(353): a, c, t, g, unknown or other
  modified_base (369)..(369): a, c, t, g, unknown or other
  modified_base (433)..(433): a, c, t, g, unknown or other
  modified_base (503)..(503): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagagctattggatgagctgggtccgcaggctccgaggggaggggctgggagtggggtgccaanataaagccaaagntagggaagtgaagacntactatgtgactctggtagaaaggggccgattcaaccagtctaccagagaaccaacgccaaagngctacgactgtatctagacaaagtgaacagcctagagagtcgaggacacggctggtcgtaattcgtaggngacgagacgtaccgtacccgtagtactcg

SEQ ID NO: 383690 - DNA, 665 bp, Homo sapiens
  misc_feature: GZ8MTXP02HT0NN.21.40.D07.1.454.CMB.2.raw
  modified_base (483)..(483): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcctgttgctattttagaaggtgtcagtgtgaggtgcagctggtggagtcggtgggggagtcgtttggtccagccggtggggggtccctggacgactctcctgtgcagcctctggacttctacttagtagtctagttggatgagtcgtcgggtccgccaggcctaccggaggggaacgggcgtgggaggttggggacggaccaaacgaagtaaagccgaaagagtagggaagtgaagactagttactatggtacggactgtagggtaggaacggaccgaattaccgactactccgtaccaagaacgaaccgaaccgaccgaaggacncctacacttagtactacgtagaactaaagacggtaaacacggacctaggaaacggagggttaaccggaaacggggtaccgaaccggtcgttacggttacggtttaactttaaccggtaggttccggacgggaaaggttaccgaaacccgtttcccccccggtaaagggtttaacgtaacggg

SEQ ID NO: 383691 - DNA, 645 bp, Homo sapiens
  misc_feature: GZ8MTXP02JRBXB.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagtttggtccagccgtggggggtccctgagactctcctgtgcagcctctggattcacctttagtagctattggatgagcgtgggtccgcaggctccgaggggagggctggaggtgggtgaccaacgataaagcaagatagggaatgagacatactatggtaggactcgtggtaggaacgggtcccgtaattcccgaacctatcctacccgaaagacgaaaccaaccggccaaagcgtacctaccaagttgtataccgttagaaccaaaaagttcgaaaaccgcgtacccgttagggaacggaacggttccggaaaacgggacccgtaaccggggtcgttagggttaacgtttaacgttaccgtgggttaggaacccggtaaaggaaccgtacccgttacccccccggttacggggtaaatcggtaaccgg

SEQ ID NO: 383692 - DNA, 523 bp, Homo sapiens
  misc_feature: GZ8MTXP02H6FTW.21.40.D07.1.454.CMB.2.raw
  modified_base (368)..(368): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctgggtccgccaggctccgaggggaaggggctgggagtggggtggccaacataaagcaagatggaagtgagacntactatgtgactctgtgaagggccgattcaccatctaccagagacaacgccaagagctacactgtatctagacaaatgaacagcctagagagtacgaggacgacggctgtgtacttacgtgtgcgtaagacgtactcccccgtacggtactacgg

SEQ ID NO: 383693 - DNA, 598 bp, Homo sapiens
  misc_feature: GZ8MTXP02G5FJM.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctggagactctcctgtgcagcctctggacttctacctttagtagctattggatgagctgggtccgccgaggcctccgaggggagggctgggagtgggtgaccaacataaagccaagagtaggaagtgaagacatactaagtggtagactcgtagtaggaaacggggccctaattccaaccctagtcctacccgagacgacgaaaccgcaaagacgcctacactgtaactcgtagactaaaatcgaaacgtacgccgtaggagacggtcggaagggaccaacgggtcgttaggtacgttaacgttacgtggtaacggacgaacggtacgtaaccttcccccggtacgggtaatacggg

SEQ ID NO: 383694 - DNA, 574 bp, Homo sapiens
  misc_feature: GZ8MTXP02FO9VV.21.40.D07.1.454.CMB.2.raw
  modified_base (342)..(342): a, c, t, g, unknown or other
  modified_base (468)..(468): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtcagtgtgaggtgcagctggtggagtcgtgggggaggcttggtccagccgtggggggtccctgagactctcctgtgcagcctctggattcacctttagtagctattggatgagctgggtccgccaggctccgaggggaggggctgggagtggggtgccaaanataaagcaaagataggaagtgaagacatactatggtggactctgtggaaaggggccctattccaacatctaccagacgaacaacgaccaaagacgctacaactgtatcctagaccaaatcgaaacngcctaggaagaggtacggaacgggacacggggtcttaggttagttaaactttcgtagggtaaggaccgaaggtacggacctttccccccgtacggggtaataccgg

SEQ ID NO: 383695 - DNA, 536 bp, Homo sapiens
  misc_feature: GZ8MTXP02GJ1HH.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagcgtcgggtccgccgaggcctccgaggggaggggctgggaggtggggtggccaacataaagcaagatggaagtgagacatactatgtgactcgtgtgaaagggcctattcaaccatcctacagacgaacaacgaccaagacgctcacttgtactcgtgacaagtgaacagcctagagacgtacgaggacacgggctgtcgtaattcgtagtcggacgaggacgactccccgtacggtatacgg

SEQ ID NO: 383696 - DNA, 437 bp, Homo sapiens
  misc_feature: GZ8MTXP02FTMQG.21.40.D07.1.454.CMB.2.raw
  modified_base (309)..(309): a, c, t, g, unknown or other
  modified_base (408)..(408): a, c, t, g, unknown or other
  modified_base (426)..(437): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtggctccggtccgaggatgaggctgattattactgtgcagcatgtgatgacggctgagtggtccggtgtcggnggagggaccaggctggaccgtctaggtccacgcccaaggcctcgccccctggtccactctcgttcccccaccctcctccgagccgacgactgagcgggntcggcaaggcgcagtagnnnnnnnnnnnn

SEQ ID NO: 383697 - DNA, 571 bp, Homo sapiens
  misc_feature: GZ8MTXP02IDRQO.21.40.D07.1.454.CMB.2.raw
  modified_base (400)..(400): a, c, t, g, unknown or other
  modified_base (428)..(428): a, c, t, g, unknown or other
  modified_base (471)..(471): a, c, t, g, unknown or other
  modified_base (569)..(569): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctggagactctcctgtgcagcctctggattctaccttagtagctattggatgagcgtgggtccgccgaggcctccggaggggaaggggcgtggggaggtggggtcggaccaaacaagtaaagccaaagagtaggaagtgagacatactatgtgactcgngtggaaggccattccacatcctacaganaacaacgcaaagcgactcactgtaatctagacaaagtgaaacngcctaggagaacgtcggaaggaccacggtcgttaggtacgtttacttaacgttggaacgacggaagtacggtaacccttcccccggtacgggttaaancg

SEQ ID NO: 383698 - DNA, 620 bp, Homo sapiens
  misc_feature: GZ8MTXP02F1PZL.21.40.D07.1.454.CMB.2.raw
  modified_base (340)..(340): a, c, t, g, unknown or other
  modified_base (562)..(562): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggagcttggtccagccgtgggggtccctgagactctctgtgcagcctctggattcacctttagagctattggatgagctgggtccgccaggctccgaggggagggctgggagtggggtcgaccaanagtaaagccaagatagggaagtgagacatactatgtgactcgtaggtgaaacggggcctaattccaacctagtcctaccaaggaacgaaccaaaccgacccaaaaggtacgacccttacaaccgttgttaactccgtagaacctaaaagtcgaaacgtacgcctaggaacgtacggtacgaacgggacctacggggtcttaggttacgttaaactttacggnggtaacggacggtaaaggtaaccgtaccgtttaccccccggtacgggttaataaccgg

SEQ ID NO: 383699 - DNA, 520 bp, Homo sapiens
  misc_feature: GZ8MTXP02HXJXE.21.40.D07.1.454.CMB.2.raw
  modified_base (382)..(382): a, c, t, g, unknown or other
  modified_base (452)..(452): a, c, t, g, unknown or other
tcagtcgtcgctcgcacgaccggtgctcgatttagtgatagagcgtaacaacagagggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctgggtccgcaggctccgaggggaaggggctgggaggtgggtggccaacataaagcaagatggaagtgagacatactatgtgactcngtggaagggccattcacatctccgagagacaacgccaagacgctacacttgtatctagacaaatgaaacngcctagagagtcgaggacacggctgtcgtacttacgtgtgacgagactacgtccccctcggtatacgg

SEQ ID NO: 383700 - DNA, 451 bp, Homo sapiens
  misc_feature: GZ8MTXP02HASQ7.21.40.D07.1.454.CMB.2.raw
  modified_base (252)..(252): a, c, t, g, unknown or other
  modified_base (446)..(451): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtggctcggtccgaggntgagctgattattactgtgcagcatgtgatgacgctgagtggtccggtgttcgggcggagggaccagggctggaccgtcgtaggccacgcccgaaggctccggccccctcgggtccacttcctccgttcccccgccccttccgtccggacgcccgacgaccgtgacggcgggcctgggcgaacgggcgcatagnnnnnn

SEQ ID NO: 383701 - DNA, 622 bp, Homo sapiens
  misc_feature: GZ8MTXP02IMJU1.21.40.D07.1.454.CMB.2.raw
  modified_base (351)..(351): a, c, t, g, unknown or other
  modified_base (508)..(508): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccgagccgtggggggtccctgagactctcctgtgcagcctctggattctacctttagtagctattggatgagcgtgggtccgtcgaggcctccgaggggaaggggctgggaggtggggtggaccaanaataaagccaaagataggaagtgaagacatactagtgtgactcgtgtaggaaacggggtcccaattaccaaccagttccctaccgaaggaacgaaccgaaacgcccgaaaaggcctacctcaacgtttgtaatccgtagaccaaaagtcggaaaacncgacctaggaagacggtacggaacgggaccacgggtcttaggttacgtaaacgtttcgtggtaacgccggaaaggtaccggtaaccttccccccggttacgggttaataccggg

SEQ ID NO: 383702 - DNA, 613 bp, Homo sapiens
  misc_feature: GZ8MTXP02F8DJO.21.40.D07.1.454.CMB.2.raw
  modified_base (367)..(367): a, c, t, g, unknown or other
  modified_base (380)..(380): a, c, t, g, unknown or other
  modified_base (384)..(384): a, c, t, g, unknown or other
  modified_base (484)..(484): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtgggtttccttgttgctattttagaaggtgtccagtgtgaggtgcagctggtggagtcgtgggggagtcttggtccagccgtgggggtcctgagctctcctgtgcagcctctggtacttcaacctttagtagtctagttggaatgagtcgtgggtccgcgaggcctccgaggggaggggcgtgggaggtggggtcgaccaacaagtaaagccaaagngtaggaagtgaanacgntaactagtcggtaggactcgtagtggaaacgggcctaattcaactatcgtaccgagaacgaaccaacgaccaaaggacgtacctcaacgttgtatcgaanaacaagtacgaacgacgcgtaggaagtacggtacggaacggaccgacgggtacgttaggttacgttaacgtttacggtggtaacgaccggtaaacgtaccgtacccgtaccccggtacggtacgtacgg

SEQ ID NO: 383703 - DNA, 446 bp, Homo sapiens
  misc_feature: GZ8MTXP02FPB2Q.21.40.D07.1.454.CMB.2.raw
  modified_base (437)..(446): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtgggctccggtccgaggatgaggctgattattactgtgcagcatgtgatgacggctgagtggtccggtgtcggcggagggaccaggctgaccgtcctaggtccagcccaaggcctcgccccccgtgggtccactcctcgttcccccgccctccgtccgacgccgacgactgacggcggggctgggcaagggccgcagtagnnnnnnnnnn

SEQ ID NO: 383704 - DNA, 527 bp, Homo sapiens
  misc_feature: GZ8MTXP02JJFN8.21.40.D07.1.454.CMB.2.raw
  modified_base (266)..(266): a, c, t, g, unknown or other
  modified_base (435)..(435): a, c, t, g, unknown or other
  modified_base (440)..(440): a, c, t, g, unknown or other
  modified_base (445)..(445): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggttttccgtgtaggctattttagaaggtgtcagtgtgaggtgcagctggtggagtcgtggggggaggcttgggtccagccgtggggggtcccctgagctctcctgtgcagcctntggattcacctttagtagctattggatgagctgggtccgccaggctccgaggggaaggggctgggagtgggtggccaacataaagccaagatggaaagtgagacatactatgtggactgtgtgaaaggggccaattcaccatcacagagaccagccaaagtgctcactntatcnacaanagacgacgacgagagagacgacgacgacgtcgtcgtacgtacgtagtgtgacgacgacgtaccgtacccgtacgtacgtacg

SEQ ID NO: 383705 - DNA, 559 bp, Homo sapiens
  misc_feature: GZ8MTXP02JGQYB.21.40.D07.1.454.CMB.2.raw
  modified_base (265)..(265): a, c, t, g, unknown or other
  modified_base (462)..(462): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctcnggattcacctttagagctattggatgagcgtggtccgccaggctccgaggggagggctgggaggtgggtggccaacgaagtaaagccaaagagtaggaagtgagacatactatgtgactcgtgtagaaggggcctattccgacatcctaccagaacgaaccaacgaccaagacgctacactgtaactctagacaaancgaacagcctagagacgtcgaacggacacggcttaggtcgttaacttcgtggtcgacggaacgtacggccttaccccccggttagggtaacgtacgg

SEQ ID NO: 383706 - DNA, 643 bp, Homo sapiens
  misc_feature: GZ8MTXP02GI6TF.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagagctattggatgagcgtgggtccgccaggctccgaggggaggggctgggagtggggtgccaacataaagcaagatggaagtgagacatactatgtagactcgtggtaggaaacgggggcctaatttccaacccgtattcccgtacccaagggaacgaaaccgaaaccgcccgaaaaggacgaccttacgaacgttgtaacttccgtagaacctaaaagtcgaaaacacggacccttagggaacggaacgttccgggaaagggacccgaaaccggggtcttcggtttaggttaaactttaccggttgggtaacggaccggtaaggaaccggtaccttccccccggttacggggttaataaccggg

SEQ ID NO: 383707 - DNA, 548 bp, Homo sapiens
  misc_feature: GZ8MTXP02HLO05.21.40.D07.1.454.CMB.2.raw
  modified_base (389)..(389): a, c, t, g, unknown or other
  modified_base (462)..(462): a, c, t, g, unknown or other
  modified_base (493)..(493): a, c, t, g, unknown or other
  modified_base (511)..(511): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagagctattggatgagctgggtccgccgaggctccgaggggaaggggctgggaggtgggtcggaccaagaataaagccaaagatagggaagtgagacatactagtgtgactntaggtgaacggggctatcacatcacagacacaacgcaaagagctacgacttgtactctagacaaaatgaaacnggcctaggagacggtacgagggacacgggtnttagtacgttacttacgngtaacgcgaagacgtaccgtccccgtacggtactacg

SEQ ID NO: 383708 - DNA, 568 bp, Homo sapiens
  misc_feature: GZ8MTXP02IJ6PH.21.40.D07.1.454.CMB.2.raw
  modified_base (340)..(340): a, c, t, g, unknown or other
  modified_base (517)..(517): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggcttggtccagccgtggggggtccctggagactctcctgtgcagcctctggatcactttagagctattggatgagctgggtccgcaggctccgagggaaggggctgggagtgggtgaccaanaataaagcaaagataggaagtgagacatactatgtgactcgtgtagaaggccattcaccatctacagacacaacgccaaagcgctacacgttgtatctagacaaaagtgaaacaggtacctggaacgaaggtccggaaaaggtaccacgggtacttaggttacgttaaactttacgnggttcggacggaacgtaccgaaccgtttccccccgtacgggttaaatacgg

SEQ ID NO: 383709 - DNA, 595 bp, Homo sapiens
  misc_feature: GZ8MTXP02FRRBM.21.40.D07.1.454.CMB.2.raw
  modified_base (351)..(351): a, c, t, g, unknown or other
  modified_base (513)..(513): a, c, t, g, unknown or other
  modified_base (544)..(544): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtgggggtccctgagactctcctgtgcagcctctggacttctacctttagtagctagttggatgagcgtgggtccgcgaggcctccgaggggaggggctgggaggtggggtcgaccaaanaagtaaagccaaagagtagggaagtgaagacatactagtggtagtactcgtaggtaggaaacgggggccctaattcccaaacctattcctacccgaaggaacgaacccaaacgacccaaagacgtcctacaacttgtactccgtagaacaaaatcggaaacncgcctaggacgtagtccggaaggacacggtnttagtagttaacttcgtgcgacgagacgtaccttccccggtaggtatacgg

SEQ ID NO: 383710 - DNA, 578 bp, Homo sapiens
  misc_feature: GZ8MTXP02J3HRD.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagcctggggggtccctgagactctcctgtgcagcctctggattcacctttagtagctattggatgagctgggtccgcaggctccgaggggaaggggctgggagtggggtggccaaacataaagccaaagatggaagtgagacatactatgtgactcgtgtgaagggcccgattccaccatcctaccgagacgacaaaccggccaaagagctacacttgtatccgtagaccaaaagtgaaaccaggccctaggaacggtagtccggaaaggggaccaaccggggttcttaggttacgttacgtttacgtggtaacgacggacgacgtacccgtcccccggtacggtactacgg

SEQ ID NO: 383711 - DNA, 543 bp, Homo sapiens
  misc_feature: GZ8MTXP02HSAOW.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctgggtccgcaggctccgaggggaggggctgggagtgggtggccaacataaagccaaagatggaagtgagacatactatgtgactctgtgaagggcattcacatctaccagacacaacgccaaagagctacacttgatctgacaaagtgaaacagcctaggacgtaggtacggaagggtacgaccggtgttagttacgtactttaacgtgttggaccgaggtacgacttcccccgtacggtactaccgg

SEQ ID NO: 383712 - DNA, 519 bp, Homo sapiens
  misc_feature: GZ8MTXP02FSJXQ.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctggggttttccttgttgctattttagaaggtgtccagtgtgaggtgcagctggtggagtcgtgggggaggcttggtacagcctggggggtccctgagactctcctgtgcagcctctggattcacctttagtagctattggatgagctgggtccgcaggctccgaggggaaggggctgggagtggggtggccaacataaagccaaagataggaagtgagacatactatgtggactctgtgaagggccattcacatctccagagacaacgccaagacgctcactgtactctagacaaatgaaacagcctagacgagtacgaggacacggctgtatactactgtaagcgaagacgactcccgtacggtatacg

SEQ ID NO: 383713 - DNA, 596 bp, Homo sapiens
  misc_feature: GZ8MTXP02I2T93.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagcttattggatgagctgggtccgcgaggctccgaggggaaggggctgggagtggggtcggaccaaacaagtaaagccaaaggatagggaagtgagacattactagtgtggacttcgtggtaggaaacggggcctattccgaaccattctacccgagacgaaccaaaccgaccaaaggacgctaccacttgtaactcgtagaacctaaaagtcgaaacgacgccgtagaaggtaggtacggaagggaccacgggacttggtacgttaatttacgtggtcgacggtagacgtaccgtacccccgtaggtaactacgg

SEQ ID NO: 383714 - DNA, 417 bp, Homo sapiens
  misc_feature: GZ8MTXP02JK7MJ.21.40.D07.1.454.CMB.2.raw
  modified_base (411)..(417): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtgggctccggtcgaggatgaggctgattatactgtgcagcatgtgatgacgctgagtgtcggtgtcggcggaggaccaggctgaccgtctaggtccagcccaaggctcgccccctggtccactctcgttcccgccctctccgagcgacgactgagcggctggcaaggcgcatagnnnnnnn

SEQ ID NO: 383715 - DNA, 534 bp, Homo sapiens
  misc_feature: GZ8MTXP02FHSIY.21.40.D07.1.454.CMB.2.raw
  modified_base (188)..(188): a, c, t, g, unknown or other
  modified_base (410)..(410): a, c, t, g, unknown or other
  modified_base (457)..(457): a, c, t, g, unknown or other
tcagtcgtcgctcgcacgaccggtgctcgatttagtgatagagcgtaacaacagagggggagagaggagccttagccctggactccaaggcctttccacttggtgatcagcactgagcacagaggactcaccatggaattggggctgagctgggttttccttgttgctattttagaaggtgtccagtntgaggtgcagctggtggagtcgtgggggagcttggtccagccgtgggggtccctgagactctcctgtgcagcctctggattcacctttagtagctattggatgagctggggtccgcaggcctccgaggggaggggctgggagtggggtggccaacataaaagccaaagatgggaagtgagacatactatgtgactcgtgtagaaagggccgattcaccatcnccagagaacaacgaccaagacgctcactgatctgcaaatcggaaacncgcctagagacgtacgaacggacacggtctagtagtactacgtgtaacgcgacgacgacctccccgtacggtatacg

SEQ ID NO: 383716 - DNA, 623 bp, Homo sapiens
  misc_feature: GZ8MTXP02I0YYI.21.40.D07.1.454.CMB.2.raw
  modified_base (579)..(579): a, c, t, g, unknown or other
tcagtcgtcgctcgcacgaccggtgctcgatttagtgatagagcgtaaacaaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctctgtgcagctctggattcaccttagagctattggatgagcgtgggtccgccgaggtctccgaggggaggggcgtagggaggtgggtcggaccaacaagtaaagccaaagagtggaagtgagacatactagtgtggtactcgtagtagggaaacggggtcctatttccgaacctagttacctcccgaaggaacgaaccaaaccgccgaaaagacgccttacgacgttagtaactcgtaagaaacctaaagtgaaaacgcggtccttagggaaagtaccggttacggaagggttaaccacgggtcttaaggttacggtaactttacggnggtaacgacggaagtaccgtaccttcccccgtagggtataccgg

SEQ ID NO: 383717 - DNA, 666 bp, Homo sapiens
  misc_feature: GZ8MTXP02IZWBQ.21.40.D07.1.454.CMB.2.raw
  modified_base (498)..(498): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgacgctctcctgtgcagcctcgtggattcctacctttagtagcttagttggatgagtcgtcgggtccgccgacggcctaccggaaggggaaggggccgtaggggagggtggggtacggacccaaacgtaaagtaaaacggaccgaaagagtagggaaagtgaagaactatactaagtggtacgtaccttgtaggtaggaaacggggtccctaattcccaacctatcccaccgagaacgaaccaaccgtacaagtacncctaccagttgtactcgagaaacctaaatacgaaacctacgtccgtagaaacgacggtacgggaacggacccgaaacgggttcttaggttacgttaacgtttccggagggtaacggaaccggtaaacgtacccgttaccccgtttacccccgggtaagttaacgtacg

SEQ ID NO: 383718 - DNA, 560 bp, Homo sapiens
  misc_feature: GZ8MTXP02JGYT9.21.40.D07.1.454.CMB.2.raw
  modified_base (346)..(346): a, c, t, g, unknown or other
  modified_base (504)..(504): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggaggcttggtccagccgtggggggtccctgagactctcctgtgcagcctctggattcacctttagtagctattggatgagcgtgggtccgccaggctccgaggggaggggctgggaggtgggtcggccaanagtaaagccaaagagtggaagtgaagacatactagtgtggactcgtggtggaaaggggccaattccacatcctaccagaagacaacgaccaagacgctcacttgtatctagacctaaatcgaaacacgcctagagagtaccggaaggacgaccgggtnttaggtacgttaacttcgtggtcgacggagacgtacctccccgtacggtactacgg

SEQ ID NO: 383719 - DNA, 581 bp, Homo sapiens
  misc_feature: GZ8MTXP02GHZC8.21.40.D07.1.454.CMB.2.raw
  modified_base (530)..(530): a, c, t, g, unknown or other
  modified_base (578)..(578): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagctgggtttccttgtgctatttagaaggtgtcagtgtgaggtgcagctggtggagtcgtgggggagcttggtccaggccgtggggggtccctgagactctcctgtgcagcctctggattcacctttagagctattggatgagcgtgggtccgcaggctccgaggggaggggcgtgggaggtggggtcggaccaaacgataaaagccaaagagtaggaagtgagacatactatgtagactcgtgtgggacggccgtattcccaacctatccctaccaaggaacgaaccgaaacgacccaaaggacgtcctacaacgttagtactccgtagaaacctaaaagtcggaaaacctagccgtagagaacggtacgaacggacacgggtnttagtacgttactacgtgaacgacgacgacgtaccgtcccgtacgtanacg

SEQ ID NO: 383720 - DNA, 621 bp, Homo sapiens
  misc_feature: GZ8MTXP02I5OP3.21.40.D07.1.454.CMB.2.raw
  modified_base (263)..(263): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtggggggtccctgagactctcctgtgcagcctntggattcacctttagagctattggatggagcgtggtccgcaggctccgaggggaggggctgggaggtgggtgaccaacaagtaaagccaaagatagggaagtgagacatactagtggtagactcgtggtggaaacggggtccgtattccgaacctattcccgtaccgaacggaacgaacccaaaccggacccaaaagtacggaccctacaaccgttgtactcgtagaaccaaatacgaactagccgtagacggtacggtacggacggtaacgaccgggtacttacggtacgttaagtttaccgtggttaacggaccgaaggtaccgacccgtttaccccccgtaggttaacgtaacgg

SEQ ID NO: 383721 - DNA, 632 bp, Homo sapiens
  misc_feature: GZ8MTXP02FQDMB.21.40.D07.1.454.CMB.2.raw
  modified_base (303)..(303): a, c, t, g, unknown or other
  modified_base (342)..(342): a, c, t, g, unknown or other
  modified_base (355)..(355): a, c, t, g, unknown or other
  modified_base (494)..(494): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggagcttggtccagccgtggggggtccctgagactctcctgtgcagcctctggattcactttagtagctattggatgagcgtgggtccnccaggctccgaggggaggggctgggaggtgggtgccaanagtaaagcaaganaggaagtgagacatacatgtggactcgtggtagaacggggtcctaattccaaccctatccctaccgaaggaacgaaccaaaccggaccaaaggtacgcccttacaacttgttaactccgtagaacctaaaatcgaaacncggtacctaggaaggtaaacgtaccgggaaagggaaacccgaccgggggttactttacggtacgtttaacgttacggtggtaacggaacggtaacggtaaccgtaccccgtttacccccggtaacggttaacgtacgg

SEQ ID NO: 383722 - DNA, 571 bp, Homo sapiens
  misc_feature: GZ8MTXP02G2JI9.21.40.D07.1.454.CMB.2.raw
  modified_base (523)..(523): a, c, t, g, unknown or other
  modified_base (569)..(569): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctctggattctacctttagtagctattggatgagtcgtcgggtcccgccgtaggcctaccggaggggaaggggcgtgggaggtggggtcggacccaaagaagtaaaagccgaaagagtagggaagtgagacagtactagtgtgactctgtaggaacgggtcaattcacctatcctaccgagaacgacaacgaccaagagctacacttgtatcgtagaacaaatcggaaacagccgtagaagacggtcgaaggacgaccgggttntagtacgttactcgtgaacgacgacgacgtacctcccggtacgtancg

SEQ ID NO: 383723 - DNA, 627 bp, Homo sapiens
  misc_feature: GZ8MTXP02HM8ZM.21.40.D07.1.454.CMB.2.raw
  modified_base (351)..(351): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtgggttttccttgttgctattttagaaggtgtccagtgtgaggtgcagctggtggagtcgtgggggagcttggtccagccgtgggggtccctgagactctcctgtgcagcctcgtggacttcacctttagagtctattggatgagcgtgggtccgcaggcctaccggaggggaacgggctgggaggtgggtcggaccaaanagtaaagccaaagagtggaatgagacattactatggtagacttcgtagtagggaaacgggtcctaaattccaaccctaatccctaaccgaaggaacgaaccaaaccgccaaagcgctacgacttagactcctagaacctaaaagtcgaaactcgacctaggaaagtacggtacggaaacgggaacaccggggttcttaaggttacgttaacgtttacgtggtaacggtaacggaaacggtaccgtaccccgttacccccggtaacggttaagccgg

SEQ ID NO: 383724 - DNA, 523 bp, Homo sapiens
  misc_feature: GZ8MTXP02HS9IL.21.40.D07.1.454.CMB.2.raw
  modified_base (417)..(417): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggaggcttggtccagccgtggggggtccctgagactctcctgtgcagcctctggattcacctttagtagctattggatgagctgggtccgccaggctccgaggggaaggggcgtgggaggtgggtggccaacataaagccaagagtaggaagtccccgagacatactatgtgactctgtggagggcgagttcacatctcaganacaacgacaagagctcacttgtatctgacaaatagaacagacctagagagtacgaggacacggcgtgtgtacttacgtgtgcgagacgactcccgtcggtatacgg

SEQ ID NO: 383725 - DNA, 591 bp, Homo sapiens
  misc_feature: GZ8MTXP02HNKQI.21.40.D07.1.454.CMB.2.raw
  modified_base (348)..(348): a, c, t, g, unknown or other
  modified_base (375)..(375): a, c, t, g, unknown or other
  modified_base (384)..(384): a, c, t, g, unknown or other
  modified_base (428)..(428): a, c, t, g, unknown or other
  modified_base (464)..(464): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggcttggtccagccgtggggggtccctgagactctcctgtgcagcctctggattctacctttagtagctattggatgagtcgtgggtccgcgaggctccgaggggaggggctgggaggtgggtcgaccaanaagtaaagccaagataggaagtgaganatactatgngactcgtgtgaagggccattcacatcacagacacaacgcaaganctacacttgtactcgtagaacaaagtcggaaaaccncggtaccgtaggaacggacgggtaccggaacgggaccgtacgggtacgttaggttacgtttacgttacggtggtaaccggaacggaacggtaccggtacccgttcccccggttacggttaacgtcgg

SEQ ID NO: 383726 - DNA, 682 bp, Homo sapiens
  misc_feature: GZ8MTXP02JB21Q.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcgttggtccagccgtgggggtccctgagactctcctgtgcagcctcgtggattcctacctttagtgtctagttggatgagcgtgggtccgccgaggctccggaggggaggggcgtgggaggtggggtcggaccaacgaagtaaagaccgaaagagtagggaagtaggaagaactagttaactagtggtacgtacttcgtggtagggaaacggggtccctaatttccaaccgtatcccgtaccaaggaaaccgaaccaaaccggaccaaaaggacgaccttacctaacttagttactccggtagaaaccctaaaagtacgaaaacgtacggtaccgtaggaacgggtacgtaaccggaaacgggtaccgtaaccgggtcttaggttacgttaaaccgtttcgtagggtaacgaccggtaacggtaaacgtccccctttacccccggtaacggttaagtaacccggg

SEQ ID NO: 383727 - DNA, 637 bp, Homo sapiens
  misc_feature: GZ8MTXP02IUZHZ.21.40.D07.1.454.CMB.2.raw
  modified_base (508)..(508): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggtcttggtccagccgtggggggtccctgagactctcctgtgcagcctcgtggattctacctttagagtctagttggatggagtcgtgggtccgtcgaggctaccggaggggaaggggcgtgggaggtggggtcggaccaaacgaagtaaagccgaagagtaggaagtagagacatactatgtgactcgtagtaggaacggggtcctattacacctatcccaccagacgaaccaaccgaccaaagacgcctaccaacttagtactaccgtagaacctaaaagtacgaaaccncggtaccgtaggacggaacggtacgggaacggaccggtaccggtacgttggttacggttactttaacggtgtaacggacggtaaaggtacccgtaccctttaccccccggtacggtttaaactaccggg

SEQ ID NO: 383728 - DNA, 656 bp, Homo sapiens
  misc_feature: GZ8MTXP02FUH2F.21.40.D07.1.454.CMB.2.raw
  modified_base (302)..(302): a, c, t, g, unknown or other
  modified_base (328)..(328): a, c, t, g, unknown or other
  modified_base (342)..(342): a, c, t, g, unknown or other
tcagtcgtcgctcgcacgaccggtgctcgatttagtgatagagcgtaacaacagagggggagagaggagccttagccctggactccaaggcctttccacttggtgatcagcactgagcacagaggactcaccatggaattggggctgagctgggttttccttgttgctattttagaggtgtccagtgtgaggtgcagctggtggagtcgtgggggagcttggtccagccgtggggggtccctgagactctcctgtgcagcctctggattcactttagagtctattggatgagcgtgggtccnccgaggctccgaggggagggctgggngtgggtgaccaaanagtaaagccaaagagtaggaagtgaagactagtactagtggtacgactcgtgggtagaaacggggccctaattccgaacctatccgtaccaggaaacgaaaccgaaccgaccaaaaggccgtacctacaaacgttggttaaaactccggttaaagaaacctaaagtaccgaacgacgtcgtaagggaaacggtacggtaacggaaacggaccgtacgggttacttacgggttacgttaaacgttacggtagggaaccgaacggtaaacgggtacccgttacccccgtttcccccggttaacggttataaccggg

SEQ ID NO: 383729 - DNA, 559 bp, Homo sapiens
  misc_feature: GZ8MTXP02IK2SP.21.40.D07.1.454.CMB.2.raw
  modified_base (267)..(267): a, c, t, g, unknown or other
  modified_base (422)..(422): a, c, t, g, unknown or other
  modified_base (439)..(439): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggnttcacctttagtagctattggatgagcgtgggtccgccgaggctccgaggggaaggggcgtgggaggtggggtcggaccaaacgaagtaaagccaaagagtaggaagtgagacatactatgtagactcgtgtggaacggcattcacatctcaganacaacgccaagagcctnacttgactcgtagacaaatagaacagcctagagtagtacggaaggaccgaacgggtctagttcgttaactttacgtggtaagacggacgacgtaccttacccccgtacggttaactacgg

SEQ ID NO: 383730 - DNA, 578 bp, Homo sapiens
  misc_feature: GZ8MTXP02FX0I1.21.40.D07.1.454.CMB.2.raw
  modified_base (529)..(529): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggtcttggtccaggccgtggggggtccctgagactctcctgtgcagcctctggattcactttagagctattggatgagctgggtccgcaggctaccgaggggaaggggctgggagtggggtggaccaaagaataaagcaaagagtaggaaagtgaagacatactagtgtaggactcgtggtggaaacgggggccctaattcaaccctattcctaccgaagaagaaacaaaacggaccaaagacgcctacacgttgtatactagaaccaaaatcgaaactacgcctaggaagtcggtacggaaggacacgggtntaggttagtaacttagtgtgacgagtacgacctcccccgtaggtatacg

SEQ ID NO: 383731 - DNA, 610 bp, Homo sapiens
  misc_feature: GZ8MTXP02I6WWV.21.40.D07.1.454.CMB.2.raw
  modified_base (496)..(496): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcagcctctggtattctacctttagtagtctattggatgagcgtcgggtccgccgaggccgtaccggaggggaaggggcgtggggtaggtggggtcggaccaaacgaagtaaacgaccgaaagagtaggaaagtgaagacagtactagtgtagactcgtggtagaaacggggctattccaactatccctacgagaacgaaccaaacgaccaaagacgactactaacgtgtaactcgtanaacctaaagtacgaacgacgtccgtagacgacggtacggaggtacgaccggtataggtgttaactacgttggaacggtacgaacgtacgcccgttacccccgtaggtactacgg

SEQ ID NO: 383732 - DNA, 632 bp, Homo sapiens
  misc_feature: GZ8MTXP02HPS9O.21.40.D07.1.454.CMB.2.raw
  modified_base (509)..(509): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcgttggtccaggccgtggggggtccctgagactctcctgtgcagcctctggattctaccttagtagctattggatgagcgtcgggtccgccgaggcctaccgaggggaaggggcgtagggaggtggggtggaccctaaacgaagtaaaagccgaaagagtggaaagtgaagacatactaatgtagggtacttcgtgttaggaaacggggtccactttcaaccctagtcccttaccgaaggaacgaaccaaaccggaccaaagacgtacctacactttagtaactccgtaanaacgaaagtaacgaacgacgtcgtagacggtacggtacggaacggacgacggtcgttacggtacgttacgtttcggaggtaacgacgaacgtacgtacccgttcccccggtacggtacgtacg

SEQ ID NO: 383733 - DNA, 567 bp, Homo sapiens
  misc_feature: GZ8MTXP02FWQ56.21.40.D07.1.454.CMB.2.raw
  modified_base (472)..(472): a, c, t, g, unknown or other
  modified_base (488)..(488): a, c, t, g, unknown or other
  modified_base (520)..(520): a, c, t, g, unknown or other
  modified_base (537)..(537): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcagcctctggattcacctttagtagctattggatgagcgtgggtccgccgaggcctccgaggggaaggggctgggaggtggggtggaccaaacaagtaaagccgaaagagtaggaagtgaagacatactatgtgacttcgtgtggaaaggggccattccaacctatcctaccgagaacgaaccaaccgaccaaaggactcctacacttgttacncgtagaacctaaagtnaaacagtccagacggagtacggagaccacggnttagtacgttatcgtgngacgagacgacccttcccgtacggtatacg

SEQ ID NO: 383734 - DNA, 536 bp, Homo sapiens
  misc_feature: GZ8MTXP02H0AXE.21.40.D07.1.454.CMB.2.raw
  modified_base (375)..(375): a, c, t, g, unknown or other
  modified_base (478)..(478): a, c, t, g, unknown or other
  modified_base (493)..(493): a, c, t, g, unknown or other
  modified_base (496)..(496): a, c, t, g, unknown or other
  modified_base (509)..(509): a, c, t, g, unknown or other
  modified_base (511)..(511): a, c, t, g, unknown or other
  modified_base (534)..(534): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggaggcttggtccagccgtggggggtccctgagactctcctgtgcagcctctggattctacctttagtagctattggatgagcgtgggtccgcaggcctccgaggggaggggctgggaggtgggtggccaaacagtaaagccaagagtaggaagtgagacntactagtgtgactctgtaggaacggggccctattccacctatcctaccgaagacgaaccaacgaccaaagacgctacacgttgtatctagacaaatgaaaccngcagagagcggagcncgntgtacgtactcgngngcgacgtacgcctcccgtagtancg

SEQ ID NO: 383735 - DNA, 505 bp, Homo sapiens
  misc_feature: GZ8MTXP02HNGCP.21.40.D07.1.454.CMB.2.raw
  modified_base (263)..(263): a, c, t, g, unknown or other
  modified_base (279)..(279): a, c, t, g, unknown or other
  modified_base (340)..(340): a, c, t, g, unknown or other
  modified_base (343)..(343): a, c, t, g, unknown or other
  modified_base (368)..(368): a, c, t, g, unknown or other
  modified_base (380)..(380): a, c, t, g, unknown or other
  modified_base (401)..(401): a, c, t, g, unknown or other
  modified_base (406)..(406): a, c, t, g, unknown or other
  modified_base (418)..(418): a, c, t, g, unknown or other
  modified_base (420)..(420): a, c, t, g, unknown or other
  modified_base (425)..(425): a, c, t, g, unknown or other
  modified_base (428)..(428): a, c, t, g, unknown or other
  modified_base (430)..(430): a, c, t, g, unknown or other
  modified_base (432)..(432): a, c, t, g, unknown or other
  modified_base (434)..(434): a, c, t, g, unknown or other
  modified_base (436)..(436): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggttttcgtgtagctattttagaaggtgtccagtgtgaggtgcagctggtggagtcgtgggggagcttgggtccagccgtggggggtccctgagactctcctgtgcagcctntggattcactttaganctattggatgagcgtgggtccgcaggcctaccgaggggagggctgggagtgggtgaccaanaanaaaagccaagataggaagtgacgantatatgtgactngtgaaggcctatccacatccncaganacagccaagtcntnatgtngananananangcagagagacgagacgacgcgtgtagtactacgtagtgacgacgacgtaccgtcccgtacgtacgtacg

SEQ ID NO: 383736 - DNA, 511 bp, Homo sapiens
  misc_feature: GZ8MTXP02JJHUD.21.40.D07.1.454.CMB.2.raw
  modified_base (461)..(461): a, c, t, g, unknown or other
  modified_base (483)..(483): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagagctattggatgagctgggtccgccaggctccgaggggaggggctgggagtgggtgccaacataaagccaagatggaagtgagacatactatgtggactcgtgtggaaagggccctattccaccatctaccagagacaacgccaagagctcactgtactctgacaaatgaaacagcctgagngtacgagcacgctgtgtatacngtgcgagacgactccccctaggtatacg

SEQ ID NO: 383737 - DNA, 532 bp, Homo sapiens
  misc_feature: GZ8MTXP02FM9SV.21.40.D07.1.454.CMB.2.raw
  modified_base (373)..(373): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaggtgtccagtgtgaggtgcagctggtggagtcgtgggggaggcttggtccagccgtggggggtccctgagactctcctgtgcagcctctggattcacctttagagctattggatgagctgggtccgccaggctccgaggggaaggggctgggagtggggtcggccaaacataaagccaaagatgggaaagtggagacntactatggtggactcgtgtggaaagggccgaattcacatctccagaagaccaacgaccaaagagctacactgtatctagacaaatgaacaggcctagagagtcgaggacacgggctgtgttaactactgtgcgagacgtacctcccgtacggtatacgg

SEQ ID NO: 383738 - DNA, 600 bp, Homo sapiens
  misc_feature: GZ8MTXP02FIVKK.21.40.D07.1.454.CMB.2.raw
  modified_base (342)..(342): a, c, t, g, unknown or other
  modified_base (510)..(510): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggttcttggtccagccgtggggggtccctgagactctcctgtgcagcctctggattcacctttagagctattggatgagctgggtccgcaggctccgaggggaggggctgggagtggggtgccaanataaagccaaagatagggaagtgaagacatactatggtgacttcgtaggtaggaaacgggggcccgtaatttcccaaaccctattccctacccgaaggaacgaaaccaaaccgaccaaaagggacgtcctacaccgtagtaactccgtagaacctaaaagtcgaaacncgacctaggagacggtacggagggaccacgggtcttggtacgttaacttacgtggtgacgaagacggtacctaccccggtcggtatacgg

SEQ ID NO: 383739 - DNA, 650 bp, Homo sapiens
  misc_feature: GZ8MTXP02FHDTO.21.40.D07.1.454.CMB.2.raw
  modified_base (339)..(339): a, c, t, g, unknown or other
  modified_base (486)..(486): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctatttagaaggtgtccagtgtgaggtgcagctggtggagtcgtgggggaggcttggtccagccgtggggggtccctgagctctcctgtgcagcctctggattcacctttagtagctattggatgagctgggtccgcaggctccgaggggaggggctgggagtggggtgccaanataaagccaagatgggaagtgagacatactatggtagactctggtaggaaacgggggcctaattccaaccctatccctaccgaaggacgaaccaacggaccaaagacgctacactgttaactcgtagaactaaaagtcggaaaaccncggtaccgtaagggaacggtaacggtaccgggaaacggggtaacccgtacggggttacgtttacgggtttacgtttaaacgtttacggttagggtaacggaacgggtaaacggtacccggtaacccccgtttaccccccggggtaacgggtttaacgtaacggg

SEQ ID NO: 383740 - DNA, 535 bp, Homo sapiens
  misc_feature: GZ8MTXP02IJVCX.21.40.D07.1.454.CMB.2.raw
  modified_base (413)..(413): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctatttttagaaggtgtccagtgtgaggtgcagctggtggagtcgtgggggaggcttggtccagccgtggggggtccctgagactctcctgtgcagcctctggattcactttagtagctattggatgagcgtgggtccgccaggctccgaggggaaggggctgggaggtgggtgaccaacaataaagccaaagagtaggaagtgagacatactatgtgactgtgtgaaggcgattcacatctacaganacaacgccaagacgctacactgtatctagacaaagtgaaacagcctagagcgtacggagacgacggtctagtagtaaacttcgtagtaagacgtacgacgtacctccccgtacggtaacacg

SEQ ID NO: 383741 - DNA, 559 bp, Homo sapiens
  misc_feature: GZ8MTXP02GHS9G.21.40.D07.1.454.CMB.2.raw
  modified_base (303)..(303): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggcttggtccagccgtggggggtccctgagactctcctgtgcagcctctggattcacctttagagctattggatgagctgggtccncgaggctccgagggaaggggctggagtgggtgccaacataaagccaaagataggaagtgaagacatactatgtaggactcgtgtgaaagggccgattcgaccatctccagagacaacgaccaagacgcacacttgaatctagaccaaaatgaaacagccctagagagtacggacggacacgggcttggtacgtaagtttaccgaggttaacgaccggaagaacggtacccttcccccggtaacggttagtaaccgg

SEQ ID NO: 383742 - DNA, 692 bp, Homo sapiens
  misc_feature: GZ8MTXP02FL0BJ.21.40.D07.1.454.CMB.2.raw
  modified_base (359)..(359): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggaggcgttggtccagccgtgggggtccctgagactctcctgtgcagcctcgtggattcacctttagagcttagttggatgagtcgtcgggtccgccgaggctaccggaggggaacggggctggggaggtggggtcggaccaaanaagtaaaacgcaaagagtaggaagtgaagacatactagtggtaggacttcgtaggtacggaaacgggggccctaatttacccgaaacctatcccgtaccgaaggaacgaaacccgaaaccggaccaaaaggtacgcctacacttgtaactccgtaagacctaaaagtacgaaaaccagtaccctaggaaacggtacggtaccggaaaggggacccgaaccggggtttacgtttacggttaacgtttaacttaacggttacgggtaacgggaacccggtaaaggaccccgttacccccggtttacccccggttaacggggttaacttaaccggg

SEQ ID NO: 383743 - DNA, 520 bp, Homo sapiens
  misc_feature: GZ8MTXP02IEPL8.21.40.D07.1.454.CMB.2.raw
  modified_base (350)..(350): a, c, t, g, unknown or other
  modified_base (419)..(419): a, c, t, g, unknown or other
  modified_base (494)..(494): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtgggggtccctgagactctcctgtgcagcctctggattcacctttagtagctattggatgagcgtgggtccgcaggctcccgaggggaaggggcgtgggaggtggggtcggaccaaanaagtaaagccaaagataggaagtgagacatactatgtgactctgtgaagggccattcacatcctcaganaacacgaccaagagctacactgtatctagacaaatgaacagcctagagagtcgaaggcacggctgtgtattctgngacgagcgactccccgtacggatacg

SEQ ID NO: 383744 - DNA, 573 bp, Homo sapiens
  misc_feature: GZ8MTXP02G6975.21.40.D07.1.454.CMB.2.raw
  modified_base (351)..(351): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcagcctctggattcacctttagtagctattggatgagctgggtccgccgaggcctccggaggggaaggggctgggaggtggggtggaccaaanataaaagccaaagagtaggaagtgagacatactatgtgactctgtagaaggggccattccaactatccctacgaagacgaaccaaacgccaaagtacgcctacacttgtactctagaacaaaagtcgaaacacgcctaggaacgtacggtacggaggaccacgggtctaggtgtaaacttcgtggtcgacgacgacgtaccgtcccccgtacggttaacacg

SEQ ID NO: 383745 - DNA, 539 bp, Homo sapiens
  misc_feature: GZ8MTXP02JY28A.21.40.D07.1.454.CMB.2.raw
  modified_base (460)..(460): a, c, t, g, unknown or other
  modified_base (502)..(502): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagagctattggatgagctgggtccgccaggctccgaggggaggggctgggagtgggtgccaacataaagccaagagtgggaaagtgagacatactatgtggactcgtggtggaacggggcccattccaacctatctaccagacgacaacgccaagacgctcactgtatctagacaaatgaacngcctagacgagtcgacggacacgggctaggtagtacttacgnggtgacggaagacgtacctcccccgtacggtatacgg

SEQ ID NO: 383746 - DNA, 621 bp, Homo sapiens
  misc_feature: GZ8MTXP02HLSKY.21.40.D07.1.454.CMB.2.raw
  modified_base (305)..(305): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcgttggtccagccgtggggggtccctgagactctcctgtgcagcctctggattcacctttagagctattggatgagcgtggggtccncgacggctccgaggggaaggggctgggagtgggtgaccaacataaagccaagatagggaagtgagacatactatgtagactcgtggtaggaaaggggccgaattccaaccctagttccctaccgaagacgaaaccaaccggaccaaaggacgccttacaacgttgtaactccgtagaaacccaaaagtacgaaaaccgagacccttagggaacgtaacggtacccggaagggaaccgtaaccgggtcgttaggtacgttaacgttacgtggtaacgcggaagtaccggacctttccccccgtagggtaataccggg

SEQ ID NO: 383747 - DNA, 570 bp, Homo sapiens
  misc_feature: GZ8MTXP02F0Y3A.21.40.D07.1.454.CMB.2.raw
  modified_base (348)..(348): a, c, t, g, unknown or other
  modified_base (539)..(539): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggaggcttggtccaggccgtggggggtccctgagactctcctgtgcagcctctggattcacctttagagctattggatgagcgtgggtccgccaggcctccgaggggaggggctgggaggtggggtgaccaaanagtaaagccaagagtaggaagtgaagacatactatggtagactcgtaggtaggaaacggggcctattcacctatcctaccgagacgaaccaacgaccaaagacgcctacacttgtactcctagaaaccaaagtacgaaactagcctaggagacggtacggaaggaccgacggcttagtagtaacttcgtgnggacgaagcgacctccccgtacggtatacgg

SEQ ID NO: 383748 - DNA, 678 bp, Homo sapiens
  misc_feature: GZ8MTXP02JP5R0.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctctggattctacctttagagtctagttggatgagcgtgggtcccgccgaggcctaccggaggggaacggggcgtggggaggtggggtcggaccaaacgaagtaaagccaaaggagtaggaagtgaagactatactagtgtaggacttcgtaggtacggaaacggggtcctaatttaccgaacctagtaccctaccgaaggaacgaaccaaaccggaccaaaggtacgcctacgaacgttagtactaccgtagaaccaaaagtcggaaacacggtacccgtagggaacgaacggttaccgggaagggacctaaaccgggggttgtttacgggttaacgtttaacgttacggtacggtaacggaaccggtaacggtacccggtaaccccgttacccccgggtttaacgggtaacgtacgg

SEQ ID NO: 383749 - DNA, 553 bp, Homo sapiens
  misc_feature: GZ8MTXP02I20KQ.21.40.D07.1.454.CMB.2.raw
  modified_base (390)..(390): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctctggattcacctttagtagctagttggatgagcgtggtccgcaggctccgaggggaaggggctgggagtggggtcggaccaaacaagtaaaagccaaagagtaggaagtgaagacatactatgtgactntgtgaagggcatcaccatctacagagaacaacgccaagacgctacacttgtaactctagacaaatgaaacagcctagagtagtacggaggaccacgggtcttagttagtaaactttcgtggtaacgacggagaacgtaccgttacccccgtacggtaatacgg

SEQ ID NO: 383750 - DNA, 606 bp, Homo sapiens
  misc_feature: GZ8MTXP02JYNSR.21.40.D07.1.454.CMB.2.raw
  modified_base (502)..(502): a, c, t, g, unknown or other
  modified_base (564)..(564): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggtcttggtccagccgtgggggtccctgagactctcctgtgcagcctctgattcacctttagagctagttggatgagcgtcgggtccgccgaggcctccggaaggggaacggggcgtggggaggtggggtcggaccaaacgaagtaaacgaccgaaagagtagggaaagtgaagacatactagtggtaggactcgtgtaggaaacggggccctagttaccacctattcgtactaagacgaaccaacgccaaagacgtcctacacgtgtactcgtagaacaaagtanaaacgtcgccctaggaacgtacggtacggaacggacgaaccggtgttgtagttactttacgnggtcgacgaacggtacgtaccttacccccgtacggtatacgg

SEQ ID NO: 383751 - DNA, 663 bp, Homo sapiens
  misc_feature: GZ8MTXP02JGGY5.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagctggttttccttgttgctattttagaaggtgtccagtgtgaggtgcagctggtggagtcgtgggggagcttggtccagccgtgggggtccctgagctctcctgtgcagcctctggattctacctttagtagctattgaatgagcgtggtccgccaggctaccggaggggaacggggcgtgggagtggggtcggaccaaacgaaagtaaagccaaagagtaggaaagtggaagacatactagtggtagaacttcgtagtagggaaacggggccatttacccgaactattcccaccgaaggaacgaaccaaacgaccaaaagacgcctacgaacttgtaactccgtagaaactaaaacgtgaaacctacggcccgttaaggaacggtaacggtaccgggaaacggaaacggtcccggtacgttaggggtttacttaaacgtttaccgtaggggttggaaccgggaaagtaacccggtacccttttcccccccgggtaaagggtttaactaacccgggg

SEQ ID NO: 383752 - DNA, 677 bp, Homo sapiens
  misc_feature: GZ8MTXP02GV3E2.21.40.D07.1.454.CMB.2.raw
  modified_base (602)..(602): a, c, t, g, unknown or other
  modified_base (611)..(611): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgcagcgtggtggagtcggtgggggaggtcttggtccagccggtcgggggtccctggacgtaccttctccgtggtcgctacggtcccttcgtaggtactttcctaacctttaggtacgtcttagttggatggagtcgtcgggtccgccgacggccgtaccggaaggggaacggggtcgtggggtaggtggggtacgaccgaaacaagtaaagccgtaaagagtaggaagtagaagacagttatagtggtacgtacttcgtaggtacggaaacgggtcctattaccgaacctagttaccaccgaaggaacaacccgaaaccgtaccgaaagccgtactaccagttgacttacgacgaactaaaagcggaaacacggttaccgaggaacgtacggtaacgaaccgggtacncggggtttnttacggttaattacgtacgtggtaacgaccgtaaccgccgtaccccgtaccggtacggtactacgg

SEQ ID NO: 383753 - DNA, 726 bp, Homo sapiens
  misc_feature: GZ8MTXP02G9FXF.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggtttctgtagctatttagaaggtgtccagtgtgaggtgcagctggtggagtcgtgggggaggcttggtccagccgtggggggtccctgagactctcctgtgcagcctcgtggtattctacctttagtacgtcttagttggatgagcgtgggtccgcaggctaccgaggggaaggggctgggaggtggggtcgacccaaagaagtaaagccaaaggagtaggaaagtgaagaactataacgtaagtggtacggaacttcggtaggtacgggtaaacgggggtccctaaacgtttacccaaaccgttaactcccgttacccgaaaggggaaccgaaaccgaaaccccgggaacccaaaagggttaccgaccttacccgacgtttaggtaactttcccgtaaggaaccttaaaaagtcggaaaaccttaacggcccgttaagggaaagggacgggttaaccggaacgggggaacctaacccgggggtttacgttagggtttaacgttaacgtttcggtaggtcggtaacggtaacggtacccggttacccgttacccccggttaaggtacgtaacgg

SEQ ID NO: 383754 - DNA, 598 bp, Homo sapiens
  misc_feature: GZ8MTXP02HILRJ.21.40.D07.1.454.CMB.2.raw
  modified_base (504)..(504): a, c, t, g, unknown or other
  modified_base (549)..(549): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctctggattctacctttagtagctagttggatgagtcgtgggtccgccaggcctccgaggggaaggggcgtgggaggtgggtcggaccaaacaagtaaagccaaagagtagggaagtgaagacagttactatggtaggtactcgtaggtaggaacggggcccgtaattcccaactaatccctacccgaagaacgaaacccgaaacgaccccaaaggacgtcctacaaacgtttgtaactccgtanaacaaaatgaaaccagcctaggaagaggtacgacggacgacggtntagtacgttacgtacgtgaacgacgaagactcccgtcccgtagtacacg

SEQ ID NO: 383755 - DNA, 568 bp, Homo sapiens
  misc_feature: GZ8MTXP02IWOZ8.21.40.D07.1.454.CMB.2.raw
  modified_base (495)..(495): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcagcctctggattctacctttagtagcttattggatgagcgtgggtccgccgaggcctccgaggggaaggggctgggaggtgggtcgaccaacaataaagcaaagagtggaagtgagacatactatgtgactgtgtggaaacggggcctattcacctatccacagacacaacgcaaagcgctacatgtactcagaactaaatcgaaacacgcctaggagtacggtcggaacggaacncggggtcttaggttacgtaactttacgtggtaaggaccgagtacgaccctttcccccggtaggttaactacgg

SEQ ID NO: 383756 - DNA, 607 bp, Homo sapiens
  misc_feature: GZ8MTXP02HFEJA.21.40.D07.1.454.CMB.2.raw
  modified_base (496)..(496): a, c, t, g, unknown or other
  modified_base (533)..(533): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcgttggtccagccgtggggggtccctgagactctcctgtgcagcctctggattctacctttagtagctattggatgagcgtgggtccgccaggctaccgaggggaaggggctggggaggtggggcggaccaaacgaagtaaagccaaagagtaggaagtgagacatactagtgtagactgtgtaggaaacgggcctattcaaccatccgtaccaagacgaaccaaacgaccaaagacgccttacgactttgtactcgtagaacaaaagtcggaaaacngacccgtaggaagacggtacggaaggacaccggggtnttaggttacgttacttacgtggaacggacggtaacggtaccgtacccgttcccccggttaacggtaacgtacgg

SEQ ID NO: 383757 - DNA, 572 bp, Homo sapiens
  misc_feature: GZ8MTXP02IY06O.21.40.D07.1.454.CMB.2.raw
  modified_base (465)..(465): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctggagactctcctgtgcagcctctggattctacctttagtagctattggatgagctgggtccgcgaggctccgaggggaaggggctgggaggtggggtggaccaacagtaaagccaaagatggaagtgagacatactagtgtggactcgtggtagaagggccgattcacatctacagagacaacgccaagacgctcactgtatctagacaaaagtcgaaacncggtacctaggaacggtagtacggaacgggaccgacgggcttaggttacgttaattaacgtggtaacggcgtaacggacgtaccgttacccccgttcggtaatacgg

SEQ ID NO: 383758 - DNA, 536 bp, Homo sapiens
  misc_feature: GZ8MTXP02HVFST.21.40.D07.1.454.CMB.2.raw
  modified_base (333)..(333): a, c, t, g, unknown or other
  modified_base (339)..(339): a, c, t, g, unknown or other
  modified_base (380)..(380): a, c, t, g, unknown or other
  modified_base (404)..(404): a, c, t, g, unknown or other
  modified_base (417)..(417): a, c, t, g, unknown or other
  modified_base (446)..(446): a, c, t, g, unknown or other
  modified_base (474)..(474): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtggggggtccctgagactctcctgtgcagcctctggattcacctttagagctattggatgagcgtgggtccgccaggctccgaggggagggctgggagtgggngccaanataaagccaagatggaagtgagacatactatggtggactgngtagaaggcattcacatctcaganacaacgccaaganctacacttgtatctagacaaaatgaaacngacctagagacgtacgaaggacacgggnttaggtagtaacgtttacgaggtaacgcggaagacgaccgtcccccgttacgggtaatacgg

SEQ ID NO: 383759 - DNA, 514 bp, Homo sapiens
  misc_feature: GZ8MTXP02IOVRH.21.40.D07.1.454.CMB.2.raw
  modified_base (356)..(356): a, c, t, g, unknown or other
  modified_base (387)..(387): a, c, t, g, unknown or other
  modified_base (403)..(403): a, c, t, g, unknown or other
  modified_base (450)..(450): a, c, t, g, unknown or other
  modified_base (467)..(467): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtcccctgagactctcctgtgcagcctctggattcacctttagtagctattggatgagctgggtccgcaggctccgagggaaggggctgggagtggggtggaccaacataaagccaaagntaggaagtgagacagtactatggtgactcgngtgaagggccatcacntctcagagacaacgaccaagagctcactgtatcgagacaatcgaacngctagagagtcgagacncggactgtgtacttacgtgtgcgtagacactccccgtacggtatacg

SEQ ID NO: 383760 - DNA, 705 bp, Homo sapiens
  misc_feature: GZ8MTXP02H1L1K.21.40.D07.1.454.CMB.2.raw
  modified_base (597)..(597): a, c, t, g, unknown or other
  modified_base (658)..(658): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtgggagtcggtgggggagtcgttggccgacggtccggtcgggggtccctggacgtactctcctggtcgcacgtccctcgtggtacttactaccgtttagtacgtcttagttggataggagtcggtcgggtcccgcgacggtcctaccgggaaggggaacggggtcgtaggggtagggttcggggtacggaacctaaaagaaagtaaaacgaccgaaagtaagtaggggaaaaggtaggaacgaacctagttaacgtaagttcggtacgtaacgtcgtaggtacgggtaaacggggcctaacttcccgaaacctcttacccgacgaacggaacgaaaccgaaccgaacgaacgacgtcctacctacgttgtaactccgtagaaaccaatacgaaacncgtaccgtagaacgtacggtacggaaggtaccgacggtctaggttagttacgtttaacggnggtaacgacggtaacgtacccgtacccgttacccggtacgtaagtcg

SEQ ID NO: 383761 - DNA, 618 bp, Homo sapiens
  misc_feature: GZ8MTXP02H1M9R.21.40.D07.1.454.CMB.2.raw
  modified_base (571)..(571): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggaggcttggtccagccgtgggggtccctggagactctcctgtgcagcctctggacttctacctttagtagtctagttggatgagtcgtcgggtccgccgaggccgtccgaggggaacggggcgtggggaggtggggtcggaccaaacgaagtaaagccaaagagtaggaagtgaagactatactatgtgtactcgtgtagaaacggggcccgattccaaccgtatcccgtaccaaggaacgaaaccaaaccgccaaaagacgtcctacacgttgtaactcgtagaactaaaagtcgaaacacgcctaggaacgaacgtcggaaacggaccgacggcttaggttaatacgtttacgnggtaacggacggaacgtacgtaccctcccccggttaggtaactacgg

SEQ ID NO: 383762 - DNA, 629 bp, Homo sapiens
  misc_feature: GZ8MTXP02F8SWU.21.40.D07.1.454.CMB.2.raw
  modified_base (493)..(493): a, c, t, g, unknown or other
  modified_base (530)..(530): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggaggcgttcggtccaggcccggttggggggtcccctggacgtacttcctccgtggtgcacgccttcgtggtattctacctttagagtctagttggatggagcgtgggccgcgaggcctccggaggggaacggggctagggaggtggggtacggaccaaacaataaaggaccaaaggagtacgggaagtgaagactatacgtagtgtcggtacttcgtagggtaggaaacggggccttaattccactatccacgagacaacctaacggaccaaaggtcncctacacgttgtactgtagaaccaaaagttcgaaacncgaccgtagaacggacgtacggaggtaacccgtcggacttggtagttaaccgttgtggaaccgagtacgaccgtaccctttccccggaagttataccgg

SEQ ID NO: 383763 - DNA, 576 bp, Homo sapiens
  misc_feature: GZ8MTXP02JSXYF.21.40.D07.1.454.CMB.2.raw
  modified_base (490)..(490): a, c, t, g, unknown or other
  modified_base (541)..(541): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattcacctttagtagctattggatgagcgtgggtccgccgaggctccgaggggaaggggcgtgggaggtggggtggaccaaacaataaaagaccaaagagtagggaaagtgaagacatactagtgtgactcgtgtagaaacgggggtccctattcccaacctattcctaccagaacgaaccaaaccgccaaagagcctacactgtatcgtgaacaaatgaaacngcctaggagaacggtcggaacggacgacgggcttaggtacgttaacttacnggtcgacgagacgaccttccccgtacggtatacgg

SEQ ID NO: 383764 - DNA, 599 bp, Homo sapiens
  misc_feature: GZ8MTXP02HVSJZ.21.40.D07.1.454.CMB.2.raw
  modified_base (348)..(348): a, c, t, g, unknown or other
  modified_base (595)..(595): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcgttggtccagccgtgggggtccctgagactctctgtgcagcctcgtggattcacttagagtctatggatgagtctgggtccgccgaggcctaccgaggggaaggggcgtgggaggtggggtcgaccaaanagtaaagccaaagagtaggaagtgacgacatactatggtaggacttcgtaggtagggaaacggggctaagttccaacctattcccgtaccgaagaacgaaccaaaccggcaaaggacgtcctacacttggatcctagaaccaaatcgaaaccgacgcccgtagaacggtacggtcggaaacgtcgaacggtctagttacgttaactttcgagtcggacgaaggcgtaaccttcccccgtaggttaanacgg

SEQ ID NO: 383765 - DNA, 628 bp, Homo sapiens
  misc_feature: GZ8MTXP02JIC81.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcagcctctggattctacctttagtagcttattggatgagcgtggtccgccaggctccgaggggaggggctgggaggtgggtcggaccaaacgaataaaagccaaagagtaggaaagtgaagacagttaactagtggtaggactcgtggtggaacggggccgattcaacctatcctaccagacggaacaaccgaccaaagacgctacacttgtatccgtagaacaaagtacgaaacacgacccgtaggaaggtacggtacggaacgggaaccgtacccggggtcgtttacgggttaggttaactttaacgtcgggttaaggacggaacgggtacgtaaccccgtttcccccggttaccggttaagtaccgg

SEQ ID NO: 383766 - DNA, 625 bp, Homo sapiens
  misc_feature: GZ8MTXP02FF8XT.21.40.D07.1.454.CMB.2.raw
  modified_base (340)..(340): a, c, t, g, unknown or other
  modified_base (498)..(498): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtggggggtccctgagactctcctgtgcagcctctggattcacctttagagctattggatgagctgggtccgccaggctccgaggggaggggctgggagtggggtgccaanagtaaagccaaagatgggaagtgagacatactatggtggactcgtggtaggaaaggggcccgtaatttccaaccctattccctacccgaaggaacgaaccaaaccgacccaaaggacgcctacacgttgtaacttcgtagacctaaaagtcgaaaacngaccctaggaacggacggtaccggaaagggaccgaacggggtccttagggtagtttaacgttaccgttagggtggaaccggaaggtaacgtacccgtttaccccccgttaccggggtaattaaccgg

SEQ ID NO: 383767 - DNA, 653 bp, Homo sapiens
  misc_feature: GZ8MTXP02GY9PM.21.40.D07.1.454.CMB.2.raw
  modified_base (602)..(602): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcgttggtccagccgtgggggtccctgagactctcctgtgcagcctcgtggattcacctttagtagctagttggatgacgtcgtcgggtccgccgaggcctacccggagggggaacggggctggggaggtggggtacggaccaaagaataaacggccaaaggagtagggaagtgaagacattactaagtgtacgtactcgtaggtaggaaacggggtccctattacccaacctattcccgaccgaaggaaacgaacccgaaaccgcccgaaaaggccgtacctactacgttgtaacctcggtacaacctaaaagtcgaaaacacggtcccgtaggaacggtacgtacgaaggggccaacggggtcttaggtacgttaactttacgngggtaacgacggtaacgtacggtacccgttacccccgtacggtaagtaccg

SEQ ID NO: 383768 - DNA, 520 bp, Homo sapiens
  misc_feature: GZ8MTXP02FIMMS.21.40.D07.1.454.CMB.2.raw
  modified_base (344)..(344): a, c, t, g, unknown or other
  modified_base (386)..(386): a, c, t, g, unknown or other
  modified_base (490)..(490): a, c, t, g, unknown or other
  modified_base (493)..(493): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggtttccttgtgctatttagaaggtgtcagtgtgaggtgcagctggtggagtcgtggggggaggcttgggtccagccgtggggggtccctgagactctcctgtgcagcctctggattcacctttagtagctattggatgagctggggtccgccaggctccgaggggaaggggctgggagtggggtggccaaanataaaagccaaagatggaaagtgaagacatactatgtgactngtgaagggccgattcaccatctccagagaacaacgaccaaagagctacactgtatctagcaaaatgaaacagcctgagagtcgagggacacggctgtgtaattntgngcgagacgacctccccgtacgtatacg

SEQ ID NO: 383769 - DNA, 608 bp, Homo sapiens
  misc_feature: GZ8MTXP02HHX4X.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtccctgagactctcctgtgcagcctctggattcacctttagtagctattggatgagctgggtccgccaggctccgagggaaggggctgggagtgggtgccaacataaagccaagataggaagtgagacatactatgtggactcgtagtggaaacggggtccaagtttccaaccaattccctacccaaggaacgaacccgaaacgaccccaaaggacgccttacaaccgttggtaactcgtagacaaaagtcgaaaccaagcccgttaggaacgaacggtacggaagggaccgaaccggggttcgttacggttacgttacgttacgtggtcggacggaacggaccgtacctacccccggtacggtaactacg

SEQ ID NO: 383770 - DNA, 624 bp, Homo sapiens
  misc_feature: GZ8MTXP02JQ5TZ.21.40.D07.1.454.CMB.2.raw
  modified_base (347)..(347): a, c, t, g, unknown or other
  modified_base (462)..(462): a, c, t, g, unknown or other
  modified_base (501)..(501): a, c, t, g, unknown or other
  modified_base (569)..(569): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtggggggaggcttggtccagccgtggggggtccctgagactctcctgtgcagcctctggattcacctttagtagtctattggatgagcgtgggtccgcaggctccgaggggaaggggctgggaggtgggtgaccaanagtaaaagccaagatggaagtgaagacatactagttggtggaactcgtgtaggaaacgggggtcctatttccaactattccacccgaaggaactaacaaaccgcccaaaggtacnctacgaacttgtaactcgtagaacaaaatcggaaaaccncgaccgtaggaacgtacgggtacggaacgggaccgtacgggtcgtttaggttacgttaacgtttcggnggtaacggaacggaacggtacccgtacccgttacccccggtacggttaatacggg

SEQ ID NO: 383771 - DNA, 606 bp, Homo sapiens
  misc_feature: GZ8MTXP02H3MZX.21.40.D07.1.454.CMB.2.raw
  modified_base (602)..(602): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctctggattctacctttagtagctattggatgagcgtcgggtccgcaggcctaccgaggggaaggggctgggaggtggggtcgccaaacgataaagcaagagtaggaaagtgaagacatactagtgtagactcgtgtaggaaacggggccctaattcccgaacctatccctaccgagacgaaccaaccgccaaagacgcctacacgttgtactctagacaaaagtcgaaacacgtcctaggaagtacggacggaacgggtaccacgggtcgttagttacgttaaacgtttccgtaggtaaccggaccgaaaggtaccgacccgttccccccgtacggtttaanacgg

SEQ ID NO: 383772 - DNA, 771 bp, Homo sapiens
  misc_feature: GZ8MTXP02HR9JM.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcgttggccagccgtgggggtccctggagactctcctgtgcagcctcgtggacttctacctttagtagtctagttggatgagtcgtcggggtcccgccgaggcctaccggaggggaacggggcgtggggagggttggggtcggacccgaaaacgaagtaaaacggccgaaaaggtagttagggaaagtggaagaactagttaactaagttggtaggtaacctcggtaggttacgggaaaacggggtccctaaatttcccaaacccgtattacccgttaacccgaaaggggaaaccaaaccgtaaaacccccggacccgaaaaaagggttaccggccctttaaacccgtaaaaccgttttgggtaactttaccccggtaagggtaaaacccaaaaaagggtttaccgaaaaacccgtacgggtaccgtaagggaaacggtaacgggtaacgggaaaccggtaacgtaccggtgtttaggttacgtttaacgttacgacggtaacggtacggaaacggttacccgacccgtttacccccggtaaggttaacgtacgg

SEQ ID NO: 383773 - DNA, 522 bp, Homo sapiens
  misc_feature: GZ8MTXP02FJMHX.21.40.D07.1.454.CMB.2.raw
  modified_base (346)..(346): a, c, t, g, unknown or other
  modified_base (387)..(387): a, c, t, g, unknown or other
  modified_base (411)..(411): a, c, t, g, unknown or other
  modified_base (458)..(458): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtgggttttccttgttgctattttagaaggtgtccagtgtgaggtgcagctggtggagtcgtggggggaggcttgggtccagccgtggggggtccctgagactctcctgtgcagcctctggattcacctttagagctattggatgagctgggtccgccaggctccgaggggaggggctgggagtggggtggccaaanataaaagccaaagatgggaagtgagacatactatgtgactngtgaagggcattcacatctcaganacaacgaccaaagagctacactgtatctagacaaaatgaacagaccngagagacgaggacgacggcgtgtgtattactgtggcgacgacgacgtcccgtaccgtacgtacg

SEQ ID NO: 383774 - DNA, 598 bp, Homo sapiens
  misc_feature: GZ8MTXP02IMLQF.21.40.D07.1.454.CMB.2.raw
  modified_base (358)..(358): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcctgttgctattttagagtgtccagtgtgaggtgcagctgggtggagtcgtgggggaggcttggtccaggccgtggggggtccctgagactctcctgtgcagcctctggattctacctttagtagcttattggatgagcgtcggggtccgccgaggcctaccggaggggaaggggcgtgggaggttggggtcggaccaaanaagtaaagccgaaagagtagggaagtgaagaacatactagtggtacgactcgtggtagaacggggtccattcacctatcctaccagacgaacgaaacgaccaagacgctacacttgtactctacgacaaaatcgaaacacggcctaggagacggtacggacggaccgaccgggtataggttcgttaaagtttcgtaggtcgacgaaacggacgtaccgtcccccggttacggaatacggg

SEQ ID NO: 383775 - DNA, 510 bp, Homo sapiens
  misc_feature: GZ8MTXP02IRHVJ.21.40.D07.1.454.CMB.2.raw
  modified_base (369)..(369): a, c, t, g, unknown or other
  modified_base (456)..(456): a, c, t, g, unknown or other
tcagtcgtcgctcgcacgaccggtgctcgatttagtgatagagcgtaaacaacagagggggagagaggagccttagccctggactccaaggcctttccacttggtgatcagcactgagcacagaggactcaccatggaattggggctgagctggggttttccttgttgctattttagaaggtgtccagtgtgaggtgcagctggtggagtctggggggaggcttggtccagcctggggggtccctgagactctcctgtgcagcctctggattcacctttagtagctattggatgagctgggtccgcaggctccaggggaaggggctgggagtgggtggccaacataaagccaaagatggaagtgagacntactatgtgactctgtgaagggccattcacatctcagagacaacgccaaagacgctcacttgtatctagacaaatgaacagcctganagtcgagacacggctgtgtattactgtgcgagacgactccccgtcggtaatacg

SEQ ID NO: 383776 - DNA, 537 bp, Homo sapiens
  misc_feature: GZ8MTXP02ISTHH.21.40.D07.1.454.CMB.2.raw
  modified_base (256)..(256): a, c, t, g, unknown or other
  modified_base (370)..(370): a, c, t, g, unknown or other
  modified_base (373)..(373): a, c, t, g, unknown or other
  modified_base (386)..(386): a, c, t, g, unknown or other
  modified_base (402)..(402): a, c, t, g, unknown or other
  modified_base (405)..(405): a, c, t, g, unknown or other
  modified_base (410)..(410): a, c, t, g, unknown or other
  modified_base (421)..(421): a, c, t, g, unknown or other
  modified_base (425)..(425): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtncagcctctggattcacctttagagctattggatgagcgtgggtccgccaggctaccgaggggaaggggctgggaggtggggtcgaccaacgataaagcaaagataggaagtganacntactatgtgactntgtgaagggcatcacntcncaganacacgcaaganctanactgtactctgacaaatgaactagcctagagagtacgaggtacacggtctaggttacgtaacttcgtgtggaccggtagtacgtacccgtcccccggttacggtaagtacgg

SEQ ID NO: 383777 - DNA, 556 bp, Homo sapiens
  misc_feature: GZ8MTXP02IS2I8.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcactatggaattggggctgagctgggttttccttgttgctattttagaaggtgtccagtgtgaggtgcagctggtggagtcgtggggggaggcgttggtccagccgtggggggtccctgagactctcctgtgcagcctctggattcacctttagtagctattggatgagcgtgggtccgccaggctccgaggggaggggctgggaggtgggtggaccaacaagtaaagccaagagtagggaagtggaagacatactatgtagactcgtgtagaaggggtccattcacatctacagacgacaacgaccaagacgctacacgtgtactctagacaaatgaacagtcctagagagtacggaggacgtacggctaggttacgtacttacgtggtaacgacggtagacgtaccgtcccccgtaggtaactacgg

SEQ ID NO: 383778 - DNA, 516 bp, Homo sapiens
  misc_feature: GZ8MTXP02FUPJK.21.40.D07.1.454.CMB.2.raw
tcagtcgtcgctcgcacgaccggtgctcgatttagtgatagagcgtaacaacagagggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggaggcttggtccagccgtggggggtccctgagactctcctgtgcagcctctggattcacctttagtagctattggatgagctggggtccgccaggctccgaggggaaggggctgggagtggggtggccaacataaagccaagatgggaagtgagacatactatgtggactctgtgaaagggccgattcacatctccagagacaacgccaagagctcactgtatctgacaaatgaacagcctagagagtcgaggacacggctgtgtattactgtgcgagacgactccccgtacggtatacg

SEQ ID NO: 383779 - DNA, 673 bp, Homo sapiens
  misc_feature: GZ8MTXP02HL1IQ.21.40.D07.1.454.CMB.2.raw
  modified_base (265)..(265): a, c, t, g, unknown or other
  modified_base (539)..(539): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcgttggtccgaggccgtgggggtccctgagactctcctgtgcagcctntggattcacctttagagtctagttggatgagtcgtcgggtccgaccgaggccgtaccggaaggggaaggggcgtaggggaggtcggggtcgaacccgaaagaagtaaaacgacccaaaggtagtagggaaagtggaagaactattacgtagttgtagtactcgtaggtacgggaaacggggtctacgttacccaccgtaattcccgtaccgaaagaaccgaaccgaaaaccggacccaaaagggactaccgttacacctttagaacttcggaanaaacctaaaagtacgaaacacgtccgtaaggaggaaacggtacggaaacggaccgacggtattacgggttacttaaagtttcgaggttaacgacggtaaagtccggtacccgttccccgtacgggtttaacacg

SEQ ID NO: 383780 - DNA, 613 bp, Homo sapiens
  misc_feature: GZ8MTXP02H91A2.21.40.D07.1.454.CMB.2.raw
  modified_base (396)..(396): a, c, t, g, unknown or other
  modified_base (570)..(570): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggcgttggtccagccgtgggggtccctgagactctctgtgcacgcctctggtattcctacctttagtagtctagttggatggagtcgtcgggtcccgccgaggccgtaccggaaggggaaggggcgtgggaggtggggtacgaccaaacaagtaaagcaaagagtaggaagtgagaacntaactagtgtgactcgtgtaggaacggggccattccacctatcctaccaaggacaaccgaacgacccaaaggacgctacaacttgtatcctagaacctaaaagtgaaaccgacgtacctaggaacgtacggtacgggaacggtaccgacggtcgttaggttagtacttttacgnggtaagcgaacggtaccgtaccgttcccccggtaggtacacgg

SEQ ID NO: 383781 - DNA, 660 bp, Homo sapiens
  misc_feature: GZ8MTXP02GGI3G.21.40.D07.1.454.CMB.2.raw
  modified_base (593)..(593): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtgggaggtccggggggaggcgttggtccaggccggtggggggtccctgagctctcctgtgcagccctctggattctacctttagtagctattggatgagtcgtggggtcccgcgaggcctccggaggggaacggggcgtgggaggtggggtcggacccaaagataaaaggcaaaggagtaggaagtgagacatactagtggtcggactcgtaggtaggaacggggtccctattcccgaacctatccctaccgaaggaccaaccaaccggaccaaaagggctcctacgacttaggtactcgtagaaacctaaagtcgaaacctagaccctaggaacgaggtaccggaaacggtacccgtaacgggtcctttaggtacggtttaaactttacgngggttacgaacggtaaacggtacccgtaaccccttccccccggggtttaacgtaagtaccgggtcgg

SEQ ID NO: 383782 - DNA, 607 bp, Homo sapiens
  misc_feature: GZ8MTXP02F929I.21.40.D07.1.454.CMB.2.raw
  modified_base (506)..(506): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggcttggtccagccgtggggggtccctgagactctcctgtgcagcctctggattcacctttagagctattggatgagcgtgggtccgccaggctccgaggggaggggctgggaggtggggtcgaccaacaagtaaagcaaagagtaggaagtgaagacatactagtggtagactcgtggtaggaaacgggggccctaattccaacctattccctaccaggaacaaccaaccgaccaaaggtacgccctacgaacgtttgaacttccgtagaaaccaaaagtcgaaaacncggccctaaggaacgacggtacggaacgggaccacgggtcttaggtacgttaacttcgtggaacgacggaagacgtacccttcccccggtaggtaatacgg

SEQ ID NO: 383783 - DNA, 430 bp, Homo sapiens
  misc_feature: GZ8MTXP02IBZBP.21.40.D07.1.454.CMB.2.raw
  modified_base (341)..(341): a, c, t, g, unknown or other
  modified_base (352)..(352): a, c, t, g, unknown or other
  modified_base (375)..(375): a, c, t, g, unknown or other
  modified_base (391)..(391): a, c, t, g, unknown or other
  modified_base (406)..(430): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaaccggccccaaactcctcatctataggaataatcagcggccctcaggggtcccctgaccgattctctggctccaattctggcacctcagcctcctggccatcagtggctccggtcgaggatgaggctgattattactgtgcagcatgtgatgacgctgagtggtccggtgtcggcggagggcaggctgaccgtctaggccagcccagcncgcccctgtcnctctcgttccccaccctctcganccagactgacgcggcnggcaggcgcagtagnnnnnnnnnnnnnnnnnnnnnnnnn

SEQ ID NO: 383784 - DNA, 627 bp, Homo sapiens
  misc_feature: GZ8MTXP02GLZOP.21.40.D07.1.454.CMB.2.raw
  modified_base (354)..(354): a, c, t, g, unknown or other
  modified_base (625)..(625): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggagtcttggtccagccgtgggggtccctgagactctcctgtgcagcctcgtggacttcctactttagagctagttggatgagcgtgggtccgcgaggctaccggaggggaggggctgggaggtggggtacgaccaaanaagtaaagcctaaagagtaggaaagtgaagacattacgtagtggtacggacttcgtggtagggaaacgggccgtaattcccaacctattcccgtaaccgaggaacgaaacccgaaaccgaccgaaaagacggccctaacgacttagtataccctagaaaccaaaagtcggaaacacgtccgaaggacgtaacgcggaaacggaccggaacgttcgtagttacgttacttagtggcgacgtaacgacgtacccgttcccccgtacggttaancg

SEQ ID NO: 383785 - DNA, 859 bp, Homo sapiens
  misc_feature: GZ8MTXP02GHUX4.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagcgttgggttttccttgttgtcttattttaagaaggtgtccagtgtgaggtgcagcgtggtggaggtcggtgggggaggtcgttgggtcccgacggtcccggttcggggggttccctggacgtaccttccgtccgtggtcgcacggtcccttcgtggtacttcctaaccgtttagtacgtcttagttggatggaggtcgtcggggtcccgccgacggccgtaccggaagggggaacggggtcggtaggggtagggttcggggtacggaaccccgtaaaacgaaagtaaaacggaccgaaaaggtaagtaggggtaaaggtaggaacgtaacgtagttaacgttaaggttcgggtacggtaccgttacggttagggtaacggggaaaaccgggggtccccttaaaagtttcccgaaacccttacgttcccccgtaaaccgaaagggaaaccgaaaccccgaaaacccggaacccgaaaagggaccgtcccttaaaccgtaacgtttacggttaacctccgggttaaaagaaaacccgtaaaaggttacgaaaacccggttacggtaccggtaaaggggaacggttaaccgggtaaccgggaaaccgggtaccgtaccggggttagttacggtttaacgtttaacgttaaccggtgggtaaccggtaacggaacggtaccccgttaccccgttaccccggtaaggtacgtaacgg

SEQ ID NO: 383786 - DNA, 592 bp, Homo sapiens
  misc_feature: GZ8MTXP02H5WF5.21.40.D07.1.454.CMB.2.raw
  modified_base (341)..(341): a, c, t, g, unknown or other
  modified_base (475)..(475): a, c, t, g, unknown or other
  modified_base (534)..(534): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattctacctttagagtctattggatgagcgtcgggtccgccaggcctccgaggggaaggggctgggaggtgggngaccaaacataaagccaagataggaagtgaagacagtactatggtgactcgagtggaacgggtccagttcacctatccctaccaagacgaacaacgaccaagacgtctaccacttagtactctagacaaagtanaacgagcctaggaacgaggtaccgaagggacgacggtcgtaggtttacgactttaccgnggttaacggccggaaagggtaccgtaaccgtcccccggttaacgggtttaaacgtcgg

SEQ ID NO: 383787 - DNA, 728 bp, Homo sapiens
  misc_feature: GZ8MTXP02FRREL.21.40.D07.1.454.CMB.2.raw
  modified_base (265)..(265): a, c, t, g, unknown or other
  modified_base (347)..(347): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcagcctntggattcacctttagtagctattggatgagcgtgggtccgccgaggcctccgaggggaggggctgggaggtgggtgaccaanataaagcaagataggaagtgagacatactatggtaggacttcgtaggtagggaaacggggtcccgtaaagtttcccaaaccctacttcccgtacccgaagggaaacgaaacccgaaacccggacccgaaaggtacgtaccctacctaaccgttgttaaacttccgttaggaaacctaaaagttacggaaaacctaacggccccgttaagggaacgggtaaacgggttacccggggaacgggggaaacccgaaccgggggttcctttacgggtttaacggtttaaaacttttccggtaagggtttaaccgggaacccgggttaaagggtaacccggttacccgtttaccccccccggtaacgggggttaatttaacccgggg

SEQ ID NO: 383788 - DNA, 680 bp, Homo sapiens
  misc_feature: GZ8MTXP02F2RVL.21.40.D07.1.454.CMB.2.raw
  modified_base (264)..(264): a, c, t, g, unknown or other
  modified_base (329)..(329): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctntggattcacctttagtagctattggatgagcgtgggtccgcgaggctccgaggggagggctgggngtggggtgaccaacataaagccaaagagtagggaagtgagacatactatgtagtactcgtaggtaggaaacgggggcctattaccaacccgtattccctacccgaagaacgaaccaaaccggacccaaaagacgtcctacgaccgttagttaactccgttagaaacctaaaagttcggaaaacctacggtccccttaaggggaacggtaacgggttaccggaaaacgggggaacctaacccgggggttactttacgggtttaacggtttaaacgtttcggtagggttaacgggaacggtaacggtaacccgttaccccgtttacccccgggtaacgggttaacgtaaccgg

SEQ ID NO: 383789 - DNA, 652 bp, Homo sapiens
  misc_feature: GZ8MTXP02J23F6.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggaggcgttggtccgagccgtggggggtccctgacgctctcctgtgcagcctctggtattctacctttagtagctagttggatgagtcgtcgggtccgccgaggtcctaccgaagggggaggggtctgggtaggtggggtcgaccaaacaataaaacgccaaaggagtaagggaagtggaacgtacataacgtagtggtgtactcgttggtaggaaacggggtcccgtaattccccgaactacgtccctaccgaagaaccgaaacccaaaccggacccaaaaggccgtacctaccgacttaggttaacttccgaaggaacctaaaagtcgaaaaccgtcggtacctagggaacgacggtacggaaacggacctaccgggtcttggtacgtacttacgtggtgaccggtagaccgtacctcccccggtaggttacacgg

SEQ ID NO: 383790 - DNA, 531 bp, Homo sapiens
  misc_feature: GZ8MTXP02IHYMV.21.40.D07.1.454.CMB.2.raw
  modified_base (342)..(342): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtccctgagactctcctgtgcagcctctggattcacctttagtagctattggatgagctgggtccgccaggctccgaggggaaggggctgggagtgggtggccaanataaagccaagatggaagtgagacatactatgtaggactcgtgtagaaggggccattcaccatctccagagacaacgcaagagctcactgtatctagacaaatgaacacgcctagacgtacgtcgaacggacacggggtctaggtgtaacttctggtgacgtagacgtacctccccgtacggtatacgg

SEQ ID NO: 383791 - DNA, 613 bp, Homo sapiens
  misc_feature: GZ8MTXP02GFNWX.21.40.D07.1.454.CMB.2.raw
  modified_base (358)..(358): a, c, t, g, unknown or other
  modified_base (574)..(574): a, c, t, g, unknown or other
  modified_base (587)..(587): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttgggtccgaggccgtggggggtccctggagactctcctgtgcagcctcgtggattctacctttagagtctattggatgagcgtcgggtccgccgaggctccggaggggaaggggctgggaggtggggtcggaccaaanagtaaagccaaagagtagggaagtgaagacagtaactagtagtgaccttcgtaggtaggaaacgggggtccctaaatttccaaacccgtattcccgtacccgaagggaaacaaacccgaaaccggacccaaaggacgtacctacccgaagttggtaactccgtagaaacctaaagtcgaaacacggcctaggacgtacgtacgaggtacacgggtntagtactacgtgngaagacgagacgtccctcccgtgatg

SEQ ID NO: 383792 - DNA, 595 bp, Homo sapiens
  misc_feature: GZ8MTXP02JLYDH.21.40.D07.1.454.CMB.2.raw
  modified_base (463)..(463): a, c, t, g, unknown or other
  modified_base (488)..(488): a, c, t, g, unknown or other
  modified_base (566)..(566): a, c, t, g, unknown or other
  modified_base (593)..(593): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggtcttggtccagccgtgggggtccctgagactctcctgtgcagcctcgtggacttctacctttagagtctagttggatggagtcgtcggggtcccgccgacggtccgtacccggaagggggaacgggggtcgtaggggtaggtcggggtacggaccaaacgaagtaaaacgccgaaaggagtagggaagtagagaactatactagtggtagactcgtaggtagggaaacgggcctaaatccaactntccgacagacgaccaacgccaaagngcctagactgtactcagaactaaagcaaacgcgcctagaacgcgtacgaggaccacgggtctaggttctaattcgtgngacgaagcgtaccttccccgacggtancg

SEQ ID NO: 383793 - DNA, 583 bp, Homo sapiens
  misc_feature: GZ8MTXP02HAO3R.21.40.D07.1.454.CMB.2.raw
  modified_base (478)..(478): a, c, t, g, unknown or other
  modified_base (482)..(482): a, c, t, g, unknown or other
  modified_base (506)..(506): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcgttggtccagccgtggggggtccctgagactctcctgtgcagcctcgtggattctactttagagctattggatgagtcgtcgggtccgccgaggctaccggaggggaacggggtcgtagggaggtggggtacggaccaaaacaagtaaaacggaccaaagagtaggaaacgtagagaactatactaatggtagactgtgtagggaacgggctaattccaaccgtatccctacaagaacgaaaccaacgccaaaaggtcnctanaacttgtaatcgagactaaaaganaacacgacagagagacgacggacgaccgagtacgtacgtactagtgtgacgagacgacgtacccgtaccgtacgtag

SEQ ID NO: 383794 - DNA, 600 bp, Homo sapiens
  misc_feature: GZ8MTXP02G3PK0.21.40.D07.1.454.CMB.2.raw
  modified_base (260)..(260): a, c, t, g, unknown or other
  modified_base (265)..(265): a, c, t, g, unknown or other
  modified_base (280)..(280): a, c, t, g, unknown or other
  modified_base (283)..(283): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcctgttgctattttagagtgtccagtgtgaggtgcagctggtggagtcgtgggggaggccttgggtccaggccgtggggggtccctggagctctcctgtgccngctgngtcttctacgttagngtntagtgatgcgtcgtcggccgcgagtcgtcggagggagggtgtgggtaggtggcgacaagtagaacgacgaagagtaggaagtgaacgactagtagtagtagtacgtacgtacgtacgtacggacgtacgtactacgtactactactacgacgacgaacgaacgacgaacgacgtacgtacgtacgtacgtactacgtacgtacgtaacgtacgaacgtacgacgtacgacgtacggtacgacgacggacggtacgtacgtacgttacgttacgtacgtaacgtacgtacgtacgtaccgtaccgtaccgtacgtacg

SEQ ID NO: 383795 - DNA, 591 bp, Homo sapiens
  misc_feature: GZ8MTXP02J1WP6.21.40.D07.1.454.CMB.2.raw
  modified_base (534)..(534): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggcttgggtccgaggccgttggggggtccctgagactctcctgtgcagcctctggattcacctttagagctattggatgagcgtcgggtccgccgaggctccggaggggacggggctgggaggtggggtggaccaaacaagtaaacgccaaaggagtaggaagtgaacgacatactagtgtaggtactcgtggtaggaacggggccgtattccactactcctaccgagaacgaacgaacgaccaaagacgctacactagtactcgtagaccaaagtacgaacgagcccgtagacgacgtacggacggacgaccggtntaggtacgtacttacgtagtggtaccgagtacgtccgtaccccgtaccggtatacgg

SEQ ID NO: 383796 - DNA, 527 bp, Homo sapiens
  misc_feature: GZ8MTXP02J11XN.21.40.D07.1.454.CMB.2.raw
  modified_base (408)..(408): a, c, t, g, unknown or other
  modified_base (431)..(431): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtcccctgagactctcctgtgcagcctctggattcacctttagagctattggatgagctgggtccgccaggctccgaggggaaggggctgggagtgggtggcaaacataaaagcaaagatggaaagtgagacatactatgtgatctgtgaaaggggcccattcaccatcnccagacgacaacgccaaaggacntcactgtaatctagacaaatagaacaacgacctagagagacgaacggacgacgcgtgtcgtattactgtgcgagacgacgtccctaccgtacgtag

SEQ ID NO: 383797 - DNA, 640 bp, Homo sapiens
  misc_feature: GZ8MTXP02G7YEW.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctctggattctacctttagagcttagtggatgagcgtgggtccgccgaggcctccggaggggaacggggctaggggaggtggggtcggaccaaacaagtaaagccgaaagagtaggaagtgaagacatactagtgtagacttcgtaggtacggaaacggggccctaattcccaacgacttcccacccgaaggaacgaacccgaaaccggcccgaaaaggtacgcccttaaccgaacgttggttaactccgttaaggaacctaaaagtcggaaacacggtcctagggaaacgtacgtacgggaaaggaccgacggtctaggggttacttaacgttcgtaggcgacggaacgtacgtacccgtcccccgtacggtaagtaccg

SEQ ID NO: 383798 - DNA, 688 bp, Homo sapiens
  misc_feature: GZ8MTXP02GZQLV.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggacttctacctttagtagctattggatgagtcgtgggtccgccgaggctccgaggggaacggggcgtgggaggtggggtcggaccaaacgaagtaaagaccgaagagtaggaagtgaagacatactagtgtagactcgtgtagggaaacgggtcctaacttccaacccgtattcccgtacccaaggaacgaaacccgaaaccggaccgaaaacggacgtccctacgacctttaggtacttcccgagaaacctaaaagtacggaaaaccgtaggtaccccgtagggtaaacggtaacgggttaccggaaaacggggaccctaaccgggggtctttaacggttacgtttaaactttacggttggtaacggaccggtaaacggtaccgtaacccgtttcccccccggtaaggttaacgtaaccggg

SEQ ID NO: 383799 - DNA, 569 bp, Homo sapiens
  misc_feature: GZ8MTXP02IJSOD.21.40.D07.1.454.CMB.2.raw
  modified_base (337)..(337): a, c, t, g, unknown or other
  modified_base (423)..(423): a, c, t, g, unknown or other
  modified_base (430)..(430): a, c, t, g, unknown or other
  modified_base (480)..(480): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggcttggtccaggccgtggggggtccctgagactctcctgtgcagcctctggattcacctttagtagctattggatgagcgtggtccgccaggctccgagggaggggctgggaggtgggnggaccaacaataaagccaaagatagggaagtgaagactataactagtggtgactcgtggtagaacggggcctattccactatcccncaagganaccaaacgccaaagacgcctacacgttgtatcgtagacaaaagtgaaacngcctagacgtagtacggacggaccacgggctaggttcgtaaactttgagtcggacgaaggtactaccgttcccccgttaacgagtacgg

SEQ ID NO: 383800 - DNA, 521 bp, Homo sapiens
  misc_feature: GZ8MTXP02JIJK2.21.40.D07.1.454.CMB.2.raw
  modified_base (362)..(362): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtccctgagactctcctgtgcagcctctggatcacctttagtagctattggatgagctgggtccgccaggctccgagggaggggctgggagtgggtgcaacataaagccaagatggaagtgagacntactatgtggactctgtggaaagggccattcaccatctaccagagaacaacgccaagagctacacttgtatcctgacaaatggaaacagcctagagacgtcggagacacggctagtcgtaattactggtgacgtagacgactccccgtacggtatacgg

SEQ ID NO: 383801 - DNA, 549 bp, Homo sapiens
  misc_feature: GZ8MTXP02JSGX2.21.40.D07.1.454.CMB.2.raw
  modified_base (424)..(424): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagagctatggatgagctgggtccgccaggccccagggaggggctggaggtgggtggccaacataaagcaagatggaagtgagacatactatgtggactctggtaggaagggccgtattccaccatcctcagacgacaacgaccaagngactcactgtatctagacaaatcgaaacgacgccgtagagacggtacgaacgggacaccgggtcttaggtagttacttacgtgtacggaacggagaacgtaccgtccccgtaccggtatacgacg

SEQ ID NO: 383802 - DNA, 630 bp, Homo sapiens
  misc_feature: GZ8MTXP02F72VN.21.40.D07.1.454.CMB.2.raw
  modified_base (584)..(584): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcagcctctggattcactttagtagcttattggatgagcgtcgggtccgccgaggctaccggaggggaaggggcgtgggaggtggggtcggaccaaagaagtaaagaccaaagagtaggaagtgaagaacataactagtggtagactcgtggtaggaaacggggtccctaattacccgaacctagttccctaccgaggaacgaaaccaaccgaccaaaggacgtcctacacgttgtactcgtagaactaaaatcgaaacgacgtaccgtagagggaacggtacggaacggacggtacggacgttagttacgttacgttaacgttggnggtcggaaacggacgtaacccgttcccccgttaccggtagtaacgg

SEQ ID NO: 383803 - DNA, 830 bp, Homo sapiens
  misc_feature: GZ8MTXP02G8VXK.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaagttgggctgagcgttgggttttccttgttgcttattttagaaggtgtccagtgtgaggtgcagcgtggtggaggtcggtgggggaggtcgttggtccgaggtccggttcgggggtccctaggacgtaccttccgttccgtggtcgaccgaggtcccttcgtggtactttcctaacccgttttaaggtagtccttaagtttgggaatggacggtcgttcggggtccccgcccgaaggcccgtacccggaagggggaaacggggtccgttaggggacgggttgggggtacgggaaccccaaacgaaagttaaaacggacccgtaaaaggtagttaggggaaaaggttggaaacggtaacctagttaaccgttaagtcgggttacggggaaccttcggtagggttacggggaaaaccgggggtccctaaagtttcccaaacccgtaattccccgtaacccgaaggaaacggaaacccaaaccggaccgaaagacgtccctacgaaccgtttaggttaactcgtaacggaaaccctaaaagttcgaaaccgacggacccgtttaggaaacgggtaacggtaccggaaacgggtacccgtacggttaccggttaggtttaccgttaaacttccgggtgttcgggaaacggttaacggaccggttaaccccttccccccgggttacggttaagtaacgg

SEQ ID NO: 383804 - DNA, 547 bp, Homo sapiens
  misc_feature: GZ8MTXP02FFTYM.21.40.D07.1.454.CMB.2.raw
  modified_base (342)..(342): a, c, t, g, unknown or other
  modified_base (363)..(363): a, c, t, g, unknown or other
  modified_base (432)..(432): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagagctattggatgagctgggccgccaggctccgaggggaggggctgggagtggggtggaccaanagtaaaagccaagatggaagngagacatacatgtgactcgtgtgaaaggggcctattcaccatccgtaccaagacgacaacgaccaaagngctcactgtatcgtagacaaagtcgaaactgcctagagacgtacggagacacgggtactggtgttaaacttcgtaggtcgtaggaacgcgtaactcccccggtacggtaatccgg

SEQ ID NO: 383805 - DNA, 542 bp, Homo sapiens
  misc_feature: GZ8MTXP02FZMRW.21.40.D07.1.454.CMB.2.raw
  modified_base (265)..(265): a, c, t, g, unknown or other
  modified_base (297)..(297): a, c, t, g, unknown or other
  modified_base (334)..(334): a, c, t, g, unknown or other
  modified_base (375)..(375): a, c, t, g, unknown or other
  modified_base (486)..(486): a, c, t, g, unknown or other
  modified_base (502)..(502): a, c, t, g, unknown or other
  modified_base (510)..(510): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggaggcttggtccagccgtggggggtccctgagactctcctgtgcagcctnggattcacttagagctattgatgagctggccncaggctccgagggacgggctgggagtgggtgaccaanataaagcaagatggaagtgaagacagtacatgtacggactntgtagaagggtccattcaaccatcaccagagaacaacgacaagagctcactgtactcgtagaacctaaaatcggaaacagaccgtagacgacggtaccggagacgaccggnttagtagtaaacttgngtaacggngaacgtacacgttcccccgtacggttaacacg

SEQ ID NO: 383806 - DNA, 580 bp, Homo sapiens
  misc_feature: GZ8MTXP02F7DSH.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattcacctttagtagctattggatgagcgtgggtccgccgaggctaccgaggggaggggctgggaggtggggtcggaccaacgataaagccaagagtaggaagtgagacatactatggtagactcgtggtggaaacggggccgtattcaccatcctaccagacgacaaccgaccaagacgctacgactgtatcctagaccaaagtcgaaacacgccgtaggagtaaggtcggaaggaccgaacgggcttaggttgttaacgttacgttggtaacgacggaaggacgtacctacccccggttacggtaagtacgg

SEQ ID NO: 383807 - DNA, 543 bp, Homo sapiens
  misc_feature: GZ8MTXP02IV2WE.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcagcctctggattctacctttagtagctagttggatgagcgtgggtccgcaggctccgaggggaaggggctgggaggtggggtcggaccaaacaagtaaagcgaaagagtggaagtgaagacatactatgtgactgtgtgaagggcgattcaccatcctcagaacgacaacgccaagagctacactgtatctagacaaagtcgaacagccgtagagagtacggaggaccacgggtctaggtagtaacttagtgtgacgaagacgactcccccgtaggtactacgg

SEQ ID NO: 383808 - DNA, 577 bp, Homo sapiens
  misc_feature: GZ8MTXP02JJLMQ.21.40.D07.1.454.CMB.2.raw
  modified_base (301)..(301): a, c, t, g, unknown or other
  modified_base (487)..(487): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaagtgtccagtgtgaggtgcagcgtggtggagtcgtgggggagcttggtccagccgtgggggtccctgagctctcctgtgcagcctctggattcacctttagagtctatggatgagtctcgggtccnccgaggctaccggaggggaaggggcgtgggaggtgggtcgacccaaagaagtaaagccaaagataggaaagtgaagacagttacctagttggtgaccttcgtaggtaggaaacgggtccctaaattcccaacctattaccacccgagaacgaaccaacgaccaaagtacgctacacttgattcganaactaaagacgaacacgacgagagacgacggacggacgacgcgtgttacgttacgtatgtcgacgagacgacgtccgtaccgtacgtacg

SEQ ID NO: 383809 - DNA, 630 bp, Homo sapiens
  misc_feature: GZ8MTXP02FUKCH.21.40.D07.1.454.CMB.2.raw
  modified_base (604)..(604): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtgggggaggcgttggtccaggccgtggggggtccctgagactctcctgtgcagcctctggtattcacctttagtacgacttagttggatggagtcgtcgggtcccgccgaggcctacccggaagggggaacggggcgtaggggaggtgggggtacgaccgaaacgaaagtaaaacgccgaaaagagtagggaagtagaacgaactatactaagtggtacgacttcgtaggtaggaaacggggtcctaattccaacctattcccacgaacgaacgaaaccacgaccgaaagcgtcctacgaacttgtactcgtaacgaacaaagtcgaaacacgccgtaggacgtacgacggaaggaccgacgtgtacgttagttaactcgtgaaggacggtaanacggtaccctccccggtagtacacgg

SEQ ID NO: 383810 - DNA, 605 bp, Homo sapiens
  misc_feature: GZ8MTXP02HEXQ4.21.40.D07.1.454.CMB.2.raw
  modified_base (521)..(521): a, c, t, g, unknown or other
  modified_base (573)..(573): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgcagcgtggtggagtcgtgggggaggcttggtccagccgtgggggtccctgagactctcctgtgcagcctctggattcctacctttagagtctagttggatgagtcgtgggtccgcgaggctaccgaggggaaggggcgtgggaggtgggtcggaccaaacgaagtaaagaccaaagtagtaggggaaagtgaacgaacagttaactagtgtacggtacttgtaggtacgggaaacggggtcctaattaccaacccgtatccctaccgaagacgaacaaaccggacaaagacgcctacacttgtactccgtagaacaaatcgaaacncgcctaggaacgtaggtacgaaggacaccgggtattggtagttacttcgtgngacggaagcgtaccgtccccgtaaggtatacg

SEQ ID NO: 383811 - DNA, 540 bp, Homo sapiens
  misc_feature: GZ8MTXP02JMRLK.21.40.D07.1.454.CMB.2.raw
  modified_base (437)..(437): a, c, t, g, unknown or other
  modified_base (497)..(497): a, c, t, g, unknown or other
  modified_base (502)..(502): a, c, t, g, unknown or other
  modified_base (512)..(512): a, c, t, g, unknown or other
  modified_base (538)..(538): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtggggggtccctgagactctcctgtgcagcctctggattcacctttagagctattggatgagcgtgggtccgccgaggctaccgaggggtaaggggctgggaggtggggtcggaccaaacgagtaaaagcccgtaaagagtaggaaagtgaagacagtactagtgtggactcgtgtggaaaggggcccaattccaccatcctcaganacaacgccaagtagctacactgtatcagaccaaatgaacagcctagagagtcgaggaccncggtntgtatactgngaagcgacgactcctccccgtagtancg

SEQ ID NO: 383812 - DNA, 705 bp, Homo sapiens
  misc_feature: GZ8MTXP02JKXR7.21.40.D07.1.454.CMB.2.raw
  modified_base (300)..(300): a, c, t, g, unknown or other
  modified_base (462)..(462): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctggtttctgtgctatttagaggtgtcagtgtgaggtgcagctggtggagtcgtgggggagtcttggtccagccgtgggggtcctgagactctctgtgcagcctcgtggtacttctacctttagagtctagttggatgagtcgtcgggtccnccgaggctaccggaaggggaggggtctaggggaggtggggtacggaccaaacgtaaagtaaaacgccgaaagtagtagggaaagtggaaacgaactattaactaagtggtacggaacttcgtagggtacgggaaacggggtccctaattcccaaacccgttntacccgtaccgaaaggaaccgaaaccgaaccgtaccgaaagtaccgtccttaaacgtacgttagtacttcggaaagaaactaaacgtaacgtaaaccgtaacgtaccgtaacggtaacggtaacgggtaacggaacggtaaccggtaccgggtacggttacggttacgttaacgttacggttacggtaacggtacggtaacggtaccggtacccgttaccccggttaccggttaacggtacgg

SEQ ID NO: 383813 - DNA, 626 bp, Homo sapiens
  misc_feature: GZ8MTXP02HN1C6.21.40.D07.1.454.CMB.2.raw
  modified_base (340)..(340): a, c, t, g, unknown or other
  modified_base (348)..(348): a, c, t, g, unknown or other
  modified_base (462)..(462): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaagtgtcagtgtgaggtgcagctggtggagtcgtgggggaggcgttggtccagccgtggggggtccctggagactctcctgtgcagcctctggattcctacctttagagctagttggatgagcgtcgggtccgccaggctccgaaggggaggggctgggagtgggngaccaaanagtaaaagcaaagagtaggaagtgagacatactatggtaggtactcgtagtaggaaacggggcccaaattccaaccgatccctacgagaacgaaccaaaccgccaaaggtaccnctacacgttgtactcgagaaactaaaagaacgaacgaacgaccgtacgaacgaacggtacggaacggaaccggaaccggtacgtacggttacgttacgttaacgttacggtaacggtacggaacggtacgtacccgttaccccgttacccggttaacgtaacgg

SEQ ID NO: 383814 - DNA, 578 bp, Homo sapiens
  misc_feature: GZ8MTXP02HCHCB.21.40.D07.1.454.CMB.2.raw
  modified_base (339)..(339): a, c, t, g, unknown or other
  modified_base (458)..(458): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattctacctttagtagctattggatgagcgtgggtccgccaggctccggaggggaggggcgtgggaggtgggnggaccaacaataaagaccaagagtaggaagtgaagactatactagtgtgactcgtagtggaaacggggcctattcacctatcctacagagaaccaacgcctaagacgctacactagtancgtagaactaaactcgaaacacgtccgtaaggagtacggtacggaacggaccgacgggtctaggttacgttacgttaccgtggtaacgacggagacgtacctcccccgtaggtactacgg

SEQ ID NO: 383815 - DNA, 680 bp, Homo sapiens
  misc_feature: GZ8MTXP02IWJ5O.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcgttggtccagccggtcggggggtccctggacgacctccctcgtgtcgacgcgtcctgtgtactaccttacgttagtactacttagtagtagtagtcgtcggtccggtccgcgcgtccgacgggaggggacgggtcggtagggtagggtgggtaccgaacaaacgtaaagtaacgaacgaagtagtaggaagtagaacgatacgtatagtaggtactacgtgtagggtagggaccgtaccttactacccaattcctacgaacgaacgaacaaaccgaccgaaactaggactcctactacgttatacctacggacaaaacgaagtaaccgaagtcccgtaggaaggtaacggacggtaacggaaccgtaacgggtaccggttagttaacgttaaacgtttacttagggtacggaaccgtaaggtaaccgtacctacccccggtttaccggtaagttacgacgg

SEQ ID NO: 383816 - DNA, 676 bp, Homo sapiens
  misc_feature: GZ8MTXP02JYDZK.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctagttggatgagcgtgggtccgccgaggcctccgaggggaacggggctgggaggtggggtcggaccaaacaagtaaaagccaaagagtaggaagtgagacatactatggtgactcgtggtaggaaacgggggtcccgtaattcccgaaccctattccctacccgaaggaacgaaacccgaaaccggacccaaaaggacgtcccttaccaacgtttaggttaacttcgttacggaacctaaaagtacggaaaaccctaggtaccccgtagggaaacggtaacgggttaccgggaaaacggggacccgaaccggggtcttagggttacgtttaaacgttaccggtggtaacggacggtaagacggtacccttcccccggttacgggtataacggg

SEQ ID NO: 383817 - DNA, 572 bp, Homo sapiens
  misc_feature: GZ8MTXP02JDUOR.21.40.D07.1.454.CMB.2.raw
  modified_base (301)..(301): a, c, t, g, unknown or other
  modified_base (330)..(330): a, c, t, g, unknown or other
  modified_base (477)..(477): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgtgctattttagaaggtgtccagtgtgaggtgcagctggtggagtcgtgggggagcttggtccagccgtgggggtccctgagctctcctgtacagcctctggattctacctttagtagctagttggatgagctgggtccncgaggctcgaggggagggctggagtgggngaccaaacataaagcaagagtggaagtgagaacatactagtggtaggactcgtaggtagaaggggcccgtaattccgaaccattccacccgaagaacgaacaaaccgccaaaagcgctaccatgtaactctagacaaaagtgaaacncgcctaggaacgtagacggaacgggacaacgggcttaggtagtacttaacgtggtcgaacggagaccgtaccgtccccgtacggtaatacggacg

SEQ ID NO: 383818 - DNA, 621 bp, Homo sapiens
  misc_feature: GZ8MTXP02GYZDI.21.40.D07.1.454.CMB.2.raw
  modified_base (349)..(349): a, c, t, g, unknown or other
  modified_base (574)..(574): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctctggattcacctttagagctattggatgagcgtgggtccgccgaggcctaccggaggggaaggggctgggaggtggggtcgaccaaanaagtaaagcctaaagatagggaagtgagactagtactagtgtagactcgtagtagggaaacggggcctaagttccaaccgtatacccgtaccgaagaacgaacccgaaacgcccgaaaagcgtccataccgttagtacttcgagaacctaaagacggaaacacgtaccgtaggaacggtacggtaaccgagggaaccgcgtggtttagtacgttaactttaccgnggtcgaccggaagtaccgtacccttaccccggtacggttaataccgg

SEQ ID NO: 383819 - DNA, 587 bp, Homo sapiens
  misc_feature: GZ8MTXP02GO33F.21.40.D07.1.454.CMB.2.raw
  modified_base (344)..(344): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagcgtgggtccgccaggctccgaggggaggggctgggaggtgggtgaccaanagtaaagccaagataggaagtgagacatactatggtagactcgtggtaggaaagggggtccaattccaactatcctaccagaacaaccaacgaccaaagtacgcctacacttgtactcgtagaactaaaatggaaacacgcctaggaacgaggtacggaaggtaccacgggtctaggttagttacttaccgtggtaacggaccgaaggtacgacccttacccccggtacggggttaataccgg

SEQ ID NO: 383820 - DNA, 575 bp, Homo sapiens
  misc_feature: GZ8MTXP02IYET4.21.40.D07.1.454.CMB.2.raw
  modified_base (262)..(262): a, c, t, g, unknown or other
  modified_base (337)..(337): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctntggattcacctttagagctattggatgagcgtggtccgcaggctccgaggggagggctgggagtgggcgaccaanataaagcaagataggaagtgaagacatactagtgtgactcgtgtagaacgggcctattccacgtatcctaccagacgacaaacgccaaagacgctacaacttgtactcgtagaacaaaagtcgaaacagacccgtaggaacgtacgtacggaaggaccgaacgggtcttaggttagttaactttacgtggtaacgacggaaacgtacgtaacccttcccccggtaggttaactacggg

SEQ ID NO: 383821 - DNA, 588 bp, Homo sapiens
  misc_feature: GZ8MTXP02FQECI.21.40.D07.1.454.CMB.2.raw
  modified_base (391)..(391): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtgggggaggcttggtccagccgtgggggtccctgagactctcctgtgcagcctctggattcactttagagctattggatgagcgtgggtccgcaggctccgaggggagggctgggagtggggtggaccaaagataaagccgaaagagtagggaagtgaagacataactatgtggacttcgnggtaggaacggggcctattccaaccattccctaccaagaagaaccaacgacccaaagtacgcctacgactagtaactctagaaccaaatcggaaacaggcctaggagacgtacggaacggacacgggcttaggttacgttaaatttcgtaggtccggagaacggtacgtacccgtacccccgtaccgggtaatacgg

SEQ ID NO: 383822 - DNA, 595 bp, Homo sapiens
  misc_feature: GZ8MTXP02ICKDB.21.40.D07.1.454.CMB.2.raw
  modified_base (499)..(499): a, c, t, g, unknown or other
  modified_base (553)..(553): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattctaccttagtagtctagttggatgagcgtcgggtccgccgaggcctacccggaggggaacggggcgtggggaggttggggtacggaccaaacgaagtaaaggccaaaggtagtaggaagtagagaacataacttatgtgactcgtgtaggaacggggtcattccaccgactctccgaagagaaccaacgaccaaagacgcctacacttgtatcgtagacaaaatgaaacngacctaggagaacgtcggaacggacgaacggtcgttaggtacgtattttacggnggtaacgacgacggacgtacccgtccccgtacggtacgtacg

SEQ ID NO: 383823 - DNA, 619 bp, Homo sapiens
  misc_feature: GZ8MTXP02I2MIQ.21.40.D07.1.454.CMB.2.raw
tcagtcgtcgctcgcacgaccggtgctcgatttagtgatagagcgtaacaacagagggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctctgtgcagcctcgtggattctacctttagtagcttagttggatggagcgtgggtccgccgaggctccggaggggacggggctaggggaggtgggtcggaccaaacgataaaacgccaaagagtaggaagtgaagactagtactatggtagactcgtaggtaggaaacggacctattccaccgtaactcctaccaagacgaaccaaaccgaccgaaagacgtactcaaccgttgtactcgtacgactaaagtcgaaacacggtcctaggtaacgacggtacggaacgggacaccgggtattacggttagtaacttaccggtggtaacgtacggaacgtacggtaacccttcccccggtacggtaatacgg

SEQ ID NO: 383824 - DNA, 588 bp, Homo sapiens
  misc_feature: GZ8MTXP02IVWZG.21.40.D07.1.454.CMB.2.raw
  modified_base (280)..(280): a, c, t, g, unknown or other
  modified_base (436)..(436): a, c, t, g, unknown or other
  modified_base (542)..(542): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaggtgtccagtgtgaggtgcagctggtggagtcgtgggggagtcttggtccaggccgtgggggtccctgagctctcctgtgcagcctcgtggattctacctttagngcttattggatgacgcgtgggtccgccgaggcctaccggaggggaaggggcgtgggaggtggggtcgaccaaagaataaagccaaagagtagggaaagtgagacattactagtggtgactcgtgggtaggaaacggggccctaaattccgaaactnttcctaccgagaacgaacccaacggaccaaaggacgtcctacgacttgttaactcgtacgaaactaaagtcgaaacacgcctagagacggtacggaggacacggtntgtacgttatcgtgcgacgacgacgtacccgtcccgtaggtatcgg

SEQ ID NO: 383825 - DNA, 618 bp, Homo sapiens
  misc_feature: GZ8MTXP02FUYWZ.21.40.D07.1.454.CMB.2.raw
  modified_base (331)..(331): a, c, t, g, unknown or other
  modified_base (347)..(347): a, c, t, g, unknown or other
  modified_base (482)..(482): a, c, t, g, unknown or other
  modified_base (577)..(577): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccgagccgtgggggtccctgacgactctcctgtgcagcctctggattcactttagagctagttggatgagcgtgggtcctcgaggctaccggaggggagggctagggngtggggtcgaccaaanagtaaacgcagtgagtggaagtgagacatactgtgtgacttcgtagtacgggaaacgggtccctaattccaacctattcccgaccgaagaaccgaaccaaaccgccgaaaagttcgccttacaacgtgttaaccncgtaagaaactaaagacgaaaccgcggtacgtaggaacggtacggtaccgggaaacggtaccgtacggtcgtttacggttacttacgtttacggnggtacgaacgtaggtaccctacccgttaccccggtagtaag

SEQ ID NO: 383826 - DNA, 587 bp, Homo sapiens
  misc_feature: GZ8MTXP02FVVQO.21.40.D07.1.454.CMB.2.raw
  modified_base (347)..(347): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcagcctctggattcacctttagagctattggatgagcgtgggtccgccaggcctccggaggggaggggctgggaggtggggtgaccaanaagtaaagccaaagagtaggaagtgaagacatactatgtagactcgtgtaggaacggggccattcacatcctaccagacacaacgaccaagacgctacacttgtactcgtagacctaaagtcgaaccagcctaggaacggacgtacgggaaggaccgacgggtcttaggttagttaacttacgtggtaacggacggaaacggtacggtacccttaccccccggtacgggtaataaccggg

SEQ ID NO: 383827 - DNA, 624 bp, Homo sapiens
  misc_feature: GZ8MTXP02IE8TK.21.40.D07.1.454.CMB.2.raw
  modified_base (287)..(287): a, c, t, g, unknown or other
  modified_base (470)..(470): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctctggattcacctttagagctattggntgagcgtgggtccgtcaggctccgaggggacggggctgggaggtggggtcggaccaaacgataaaacggccaaagtagtagggtaagtggaacgcataccgtaatggtagggacctgtgtaggaaacgggccctattccacattccaccagaacacgaaccgcctaaagacgcctacacgttnactcgtaagactaaagtacgaacacgtacgtagggaacgtacggtaccgggaacggaaccgtaccgggtacgttaggtttaacgttaacgttaccgtggaacggtaacggtaaacggaccgttaaccccgtcccccggttaaggtaacgtacgg

SEQ ID NO: 383828 - DNA, 527 bp, Homo sapiens
  misc_feature: GZ8MTXP02FGPY4.21.40.D07.1.454.CMB.2.raw
  modified_base (343)..(343): a, c, t, g, unknown or other
  modified_base (368)..(368): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctgggtccgccaggctccgaggggaggggctgggagtggggtggccaanataaagccaagatggaagtgagacntacatgtgactcgtggtgaaaggggtccgattccaacatctccagacgaacaacgacccaagacgctacgactgtatctgaccaaaatgaaaccagccctgagagtcgaggacacggctgtgtattacgtgtcgcgagacgactccccgacggtatacg

SEQ ID NO: 383829 - DNA, 536 bp, Homo sapiens
  misc_feature: GZ8MTXP02G9SP0.21.40.D07.1.454.CMB.2.raw
  modified_base (479)..(479): a, c, t, g, unknown or other
  modified_base (497)..(497): a, c, t, g, unknown or other
  modified_base (511)..(511): a, c, t, g, unknown or other
  modified_base (513)..(513): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggggaggcttggtccagccgtggggggtccctgagactctcctgtgcagcctctggattcacctttagtagctattggatgagctgggtccgccaggctccaggggaaggggctgggagtggggtggcctaaacgataaaagccaaagataggaagtgagacatactaatgtaggactactgtgaaaggggccgtattcgaccatctccagagacaaacgccaaagacgctcaactgtaatcgtagacaaaatgaaacagccctgaanagtacgaggacacgggtntgtacgtacttcgngngcgagacgctccccgtcgtatcg

SEQ ID NO: 383830 - DNA, 683 bp, Homo sapiens
  misc_feature: GZ8MTXP02JCL44.21.40.D07.1.454.CMB.2.raw
  modified_base (281)..(281): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcgttggtccgagccgtgggggtccctgagctctcctgtgcagcctctggacttctacctttagngtctattggatgagcgtgggtccgcaggcctaccggaggggaaggggctagggacggtgggtcggaccaaacgaataaacgcgaaagagtagggaaagtggaagaactagttaactagttggtacggaactcgtaggtacggaaacggggcctaaattaccaacccgtattcccacgaacgggaacaaacccgaacggaccctaaaggacgtacctactacgtgtaaattcccgaagaacctaaaagtcggaaaactaccggccttaaggaacggtaaacggtcccgggaaaagggtacccgaaaccgggggttacgtttacggtttaacgttaacggtttacggtaggtaacggacggtaacgtaccggttacccctacccccggttacggtaacgtacgg

SEQ ID NO: 383831 - DNA, 769 bp, Homo sapiens
  misc_feature: GZ8MTXP02ICAIK.21.40.D07.1.454.CMB.2.raw
  modified_base (710)..(710): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcttgttgctattttagaggtgtccagtgtgaggtgcagctggtggagtcgtgggggaggcttggtccagccgtggggggtccctgagactctcctgtgcagcctctggacttctaccttagtagtctagttggatgagtcgtcgggtccgccgaggcctaccggaggggaaagggggctggggaggttggggtcggacccaaaacgaagtaaaaggccaaaaggagtagggaaaggtgaaggactattaacgttagtaggtacggtaaccttcgtaggttacgggaaaacgggggtcccgtaaattttcccgaaacccctacgtttacccgttaaccccgaaagggaaacggaaaaccccgaaaacccgggacccccgtaaaaaagggaaccggtcccctttaaacctaaaccggtttttaggtaaccctttacggttacggaaaacctaaaaagttacgggaaaaacccgtacggtaacccgtagggaaacgggtaacggtaccggggaacggtaccggaacggttcgttaggttacgttaacgtttacggnggtaacggacgtaaacggtacccgtaacccgtttacccccggttacggtaacgtacggg

SEQ ID NO: 383832 - DNA, 615 bp, Homo sapiens
  misc_feature: GZ8MTXP02GH3IS.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagctgggttttccttgttgctattttagaaggtgtccagtgtgaggtgcagctggtggagtcgtgggggaggcttggtccagccgtgggggtccctgagactctcctgtgcagcctctggattctacctttagtagtctattggatgagcgtgggtccgccgaggctccggaggggaaggggcgtgggaggtggggtcggaccaaacgaagtaaaagccgaaagagtagggaagtgaagaacataacgtatggtaggacttcgtggtaggaaacggggccgtaacttaccaaccgtattcctacccgagaacgaaccaacgaccaaagacgctacacgttgttactcgtacgaacaaaagtacgaaacagtccgtagaacgaaggtacggaagggaaccgtacgggtctaggttacgttaagttaacgtgtaaggacgaagacgtacctacccccgttacgggtatacgg

SEQ ID NO: 383833 - DNA, 685 bp, Homo sapiens
  misc_feature: GZ8MTXP02FLDOU.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggagtcttggtccagccgtgggggtccctgagactctcctgtgcagcctctggattcacctttagagctagttggatgagtcgtgggtccgccgaggctccggaggggaacggggctggggaggtggggtacggacccaaacgtaagtaaacgccgaaaaggagttagggaaagtggaagacctattaacgtaagttggtacggtacttcgtagggtagggaaacgggggtccttaactttccaaaccgtacttcccgtaccgaaggaaacgaacccgaaaccgaccgaaagacgtcctacgacgtgtaactcgtagaacctaaagtacgaaactacgcccgtaggaacggtacgacgggaacggacgacccggggtattacggtttagttaaacctttcggttggtaacggaacggtaacggtaaccggtaccccgtttaccccccggtaacgggttaagtaacccgggg

SEQ ID NO: 383834 - DNA, 697 bp, Homo sapiens
  misc_feature: GZ8MTXP02GSK9O.21.40.D07.1.454.CMB.2.raw
tcagtcgtcgctcgcacgaccggtgctcgatttagtgatagagcgtaacaacagagggggagagaggagccttagccctggactccaaggcctttccacttggtgatcagcactgagcacagaggactcaccatggaattggggctgagctgggttttccttgttgctattttagaaggtgtccagtgtgaccccccggtgcagctggtggagtcgtggggggaggtcgttggtccgaggccggtcggggggtcccgtgagactctcctgtgcacgcctctggtacttcctacctttagtagtcttagttggatggagcgtcgggtcccgccgacggcctaccggaagggggaacggggcgtaggggtagggtggggtcggaccgaaacgaagtaaacggaccgaaaggagtagggaagtaggaaggaactagttaactaagttggtacggtacgttacgtagggtacgggaaacgggggtccctaacgttacccacccgtaattcccgacccgaaggaacgaaacccaaaccgaccgaaaggactcctacaacttagtactacgtagaaacctaaaagtacgaaacgtaacgcctaagggacgtaacggtacgggaaacggactaccgggtattaggtaacgtttagttaacgttggcgaacgaagtacgaccttcccccggtaacggtataccgg

SEQ ID NO: 383835 - DNA, 747 bp, Homo sapiens
  misc_feature: GZ8MTXP02G08TB.21.40.D07.1.454.CMB.2.raw
  modified_base (178)..(178): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcctgttgctattttagaggtntccagtgtgaggtgcagctggtggagtcgtgggggagtcttggtccagccgtgggggtccctgacgctctctgtgcagcctcgtggtacttctacctttagctacgtcttaagtggatggacgtcggtcgggtcccgcgacggtccgtaccggaggggaacggggtcgtagggtagggtcggggtacggaacccaaagtaacgtaaacgacgaaagtagtagggaaaggtagaaacgggactaaacgttaacgttaggtacgggttacggtaccgtttcggtaggggttaaacgggaaaccgggggtacccttacttacccgaaacctctttaccccgaccaaacgggaaacgaaacccgaaccggaccgaaaaacgggctacccgttacccgtaagttacgttaccgttacgtaacggaacctaaaaagttcggaaaaccgcggttaaccgtacggggaaaggtaccggtacgggaaacgtaaccgacggggttacctagggtttaccgttattacggtggtacgaacgggttacgaacggttaccccttccccgggtacgtttaaag

SEQ ID NO: 383836 - DNA, 633 bp, Homo sapiens
  misc_feature: GZ8MTXP02F50UD.21.40.D07.1.454.CMB.2.raw
  modified_base (341)..(341): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctctggattcacctttagtagctattggatgagcgtgggtccgcaggctccgaggggagggctgggaggtgggtgaccaaanataaagccaagataggaagtgaagacatactagtgtgactcgtggtagaaaggggccgtattaccgaacctatcctacccgaaggaacgaaaccgaaaccgacccaaaaggtacgacccttacaacgttagttaactcccgttaagaaacctaaaaagttcgaaaaccgaacggtcccgtaaggaacgtacggtaccggaaagggacccgtaacgggcttagggttacgttaaagtttaccgttggaacggtacggaagtacgtacccgttcccccgtacgggtaataccgg

SEQ ID NO: 383837 - DNA, 611 bp, Homo sapiens
  misc_feature: GZ8MTXP02F8PPT.21.40.D07.1.454.CMB.2.raw
  modified_base (474)..(474): a, c, t, g, unknown or other
  modified_base (542)..(542): a, c, t, g, unknown or other
  modified_base (551)..(551): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcagcctctggattcacctttagtagctattggatgagcgtgggtccgccgaggcctccggaggggaaggggctaggggaggtggggtcgaccaaacgaataaaaggccaaaggagtagggaagtggaagacagtactagtcggtagactcgtggtacggaacggggcctagttccaacctatccctaccaggaacgaacccaacgaccaaaggacncctacacgttgtactcgtagaaccaaagtgaaacacgtccaaggagtacggacgacggacgaccggtnttacgggtnttaaacgttcgttggaacgaccggtaagtaccggtacccttcccccggtaggtagtacgg

SEQ ID NO: 383838 - DNA, 606 bp, Homo sapiens
  misc_feature: GZ8MTXP02GEIJG.21.40.D07.1.454.CMB.2.raw
  modified_base (504)..(504): a, c, t, g, unknown or other
  modified_base (537)..(537): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtgggggtccctgagactctcctgtgcagcctctggattcacttagtagctattggatgagcgtcgggtccgccgaggctacccggaggggaacggggcgtgggaggtggggtcggacccaaacgaagtaaaacgccgaaagagtaggggaagtggaagacatactagtgtggactcgtagtgaacggggcctattccactatctaccaaggacgaaccaacggacctaaagacgacctcaacgttgtactcgtagacctaaaatcgaaaacncgcctaggagtacggcggaaggacgaccgggtnttacgttacgttaacttcggtaggtaacggacggtaacgtaccgtacccgtcccggtacggtactacgg

SEQ ID NO: 383839 - DNA, 649 bp, Homo sapiens
  misc_feature: GZ8MTXP02H2F90.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcgttggtccagccgtggggggtccctgagactctcctgtgcagcctcgtggattcacctttagagtctattggatgagtcgtcgggtccgccgaggccgtaccggaaggggaaacggggcgtaggggaggttggggtcggaaccctaaaagaagtaaaaaggcccgaaaaggtagtaggggaaagttgaagaactataacgtatggtaggtacttcgtgttagggaacggccgaattccaccgatcctaccagacgaacaaccgaccaaagcgactacacgttgtactctacgactaaaagtcgaaacgtacgaccctaggaacgaacggtacggaaacgggaccgaaccggtcgttacggttagttaacgtttacgtaggttaaggacggtaagaccgtaccgttacccccgttacggtttaacgacggg

SEQ ID NO: 383840 - DNA, 570 bp, Homo sapiens
  misc_feature: GZ8MTXP02F72NZ.21.40.D07.1.454.CMB.2.raw
  modified_base (342)..(342): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggctcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagcgtgggtccgcgaggctccgaggggaggggctgggagtgggtgaccaanataaagcaagataggaagtgagacatactagtgtagactcgtgtaggaaggggccgtattccgaacctatcctacccgagaacgaacaaacgaccaagacgacctacacttagtactcgtagaaccaaatcgaaacacgcctaggagacgtacggacggaacgtacggcttaggtacgttaagttacgtaggtgacgaacgacgtacctacccccgtagtaactacgg

SEQ ID NO: 383841 - DNA, 642 bp, Homo sapiens
  misc_feature: GZ8MTXP02JHMOP.21.40.D07.1.454.CMB.2.raw
  modified_base (266)..(266): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcgttggtccagccgtggggggtccctggagactctcctgtgcagcctntggattcactttagagctattggatgagcgtgggtccgccgaggctccggaggggaaggggctggggagtggggtgaccaacaagtaaagccaagagtaggaaggtgaagacatactatggtgacttcgtaggtggaaacggggtccgtattacccaaccattcccgtaccaaggaacgaacccgaaacgacccgaaagacggtacctacaacgttgttaactcgtacgaaccaaaagtacggaaacacggtacccgttaggaaacggtacggtaccgggaaaggaccggtaaccggtcttacgggttagtttaacgttaccgttggtaacggacggtaacggacgtaccctcccccgttacgggttaataacggg

SEQ ID NO: 383842 - DNA, 573 bp, Homo sapiens
  misc_feature: GZ8MTXP02I7ST2.21.40.D07.1.454.CMB.2.raw
  modified_base (470)..(470): a, c, t, g, unknown or other
  modified_base (475)..(475): a, c, t, g, unknown or other
  modified_base (481)..(481): a, c, t, g, unknown or other
  modified_base (485)..(485): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattccacctttagtagctatggatgagcgtgggtccgcgaggctaccggaggggaggggctggggaggtggggtcggaccaaacgaagtaaaacgccgaaagagtaggaagtgagaactagtactagtgtaggaccttgtagtagggaacggggtcctaagttccaactattcccacgacgaagaaccaaccgacgaaagtacncctanaccgtntaanctagaaccaagtacaaccagctagacgagtcgaaaggccaggtctgtagtactagtgaagacgtagcggtacctaccccgtgaatccg

SEQ ID NO: 383843 - DNA, 602 bp, Homo sapiens
  misc_feature: GZ8MTXP02GBHSC.21.40.D07.1.454.CMB.2.raw
  modified_base (344)..(344): a, c, t, g, unknown or other
  modified_base (534)..(534): a, c, t, g, unknown or other
  modified_base (555)..(555): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcgttggtccagccgtgggggtccctgagactctcctgtgcagcctctggattcacctttagtagctattggatgagcgtggtccgcaggctccgaggggaggggctgggagtggggtcgaccaaanataaagccaaagataggaagtgagacatactatgtgacttcgtagtaggaaacggggccctaacttccaaccgtattccctacccgaaggaacgaaccaaaccgaccaaagacgcctacgacttgtaactcgtagaaccaaaagtcgaaaccagccgtaggacgtaggtacggaacggaccaccggggtnttacgggttgttaacttacgnggtaaggacggaacggacgtacccgtcccccgtacgggtaataacgg

SEQ ID NO: 383844 - DNA, 572 bp, Homo sapiens
  misc_feature: GZ8MTXP02FMRLN.21.40.D07.1.454.CMB.2.raw
  modified_base (340)..(340): a, c, t, g, unknown or other
  modified_base (568)..(568): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtggggggtccctgagactctcctgtgcagcctctggattcacctttagagctattggatgagcgtggtccgcaggctccgaggggaggggctgggagtggggtgaccaanataaagccaaagagtaggaagtgaagacatactatggtgactcgtagggtagaaacgggggtcctaatttcgaacctatcccgtaccgagacgaacaaacgccaagacgctacactgtactcgtagaactaaatcgaaactagcctagacgagtacggaggacaccgggtgttaggtagttactacgtggtcgacgtaggacgtacccttacccccggtacggttaanccgg

SEQ ID NO: 383845 - DNA, 682 bp, Homo sapiens
  misc_feature: GZ8MTXP02HLXJ7.21.40.D07.1.454.CMB.2.raw
  modified_base (556)..(556): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggagtcgttggtccgaggccggtcgggggtccctggacgtactctccgtgtgcagtccctcgtggtacttcctaacctttaggtacgcttagttggatggagtcgtcgggtcccgccgaggccgtaccggaaggggaacggggcgtaggggaggtggggtcgaaccgaaacgaagtaaaagccgaaaaggtagtagggaagtgaagactatacgtatggtagacttcgtaggtacgggaaacgggtcccgtattaccaccgtaatccctaccgaaggaacgaacccaacggacctaaaggctcctactacgttgtactcgtagaaacaaagtacgaaaccngaccgtagaacggtaacgtacggaacggacccgtaacggtcgttaggttagtaaccgtttaacgttgggtaacggtacggaacggtaaccgtaacccgtttccccccggtaaggttaaacgtccgg

SEQ ID NO: 383846 - DNA, 543 bp, Homo sapiens
  misc_feature: GZ8MTXP02FNRJI.21.40.D07.1.454.CMB.2.raw
  modified_base (257)..(257): a, c, t, g, unknown or other
  modified_base (262)..(262): a, c, t, g, unknown or other
  modified_base (278)..(278): a, c, t, g, unknown or other
  modified_base (333)..(333): a, c, t, g, unknown or other
  modified_base (358)..(358): a, c, t, g, unknown or other
  modified_base (372)..(372): a, c, t, g, unknown or other
  modified_base (495)..(495): a, c, t, g, unknown or other
  modified_base (511)..(511): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcngcctntggattcactttaganctattggatgagcgtggtccgcaggctcgagggagggctgggagtgggcgccaanataaagccaagataggagtgagacntactatgtagactntggtaggaacggcgattcaaccgtatcctaccaagacaacaaacgaccgaagacgcctacgacgttagtactaccgtagaacaaagtacgaacacggtccaggtacgagacggagacacggtntagtgttaactgttgngcgaacgcgtaccctacccgtacggtatacgg

SEQ ID NO: 383847 - DNA, 579 bp, Homo sapiens
  misc_feature: GZ8MTXP02ITKDZ.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggtcttggtccaggccgtgggggtccctggagactctcctgtgcagcctcgtggattctacctttagagctattggatgagcgtgggtccgcaggcctaccgaggggaaggggctgggagtggggtcggaccaacaagtaaagccgaaagagtaggaagtgaagactatactatggtagactcgtgtaggagggcctatcacatcctacgagacgaacaacgaccgaaagacgctacgacttgaattccgtagacctaaaagtcggaaacacgtccgtaggaaggacgtacggaaggaccgaacggtctagggtgtaacttcgagtcgaacgagtacaaccgttcccccgtaggtactacgg

SEQ ID NO: 383848 - DNA, 653 bp, Homo sapiens
  misc_feature: GZ8MTXP02IXA8V.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctctgtgcagcctctggattctacctttagtagctattggatgagcgtgggtccgccaggcctaccggaggggacggggcgtgggaggtggggtcgaccaacaagtaaagaccaaaggagtagggaagtgaagaactagtaacttagtggttcgacttcgtggtacggaaacgggggcctaacttcgaacctatctactagaagaccaaacgaccaaagacgtacctcaacgttgtaacttcgtacgaacctaaaagtcgaaaaccgacgtacccgttaggaaacgtaggtaaccggaagggaaccgtacggggttacttacggttacgttaaacgttacggtaggtaacggtaacggtaacggtaacccgtacccgtttaccccggttaacggttaacgtacgg

SEQ ID NO: 383849 - DNA, 607 bp, Homo sapiens
  misc_feature: GZ8MTXP02FYX7F.21.40.D07.1.454.CMB.2.raw
  modified_base (343)..(343): a, c, t, g, unknown or other
  modified_base (501)..(501): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagcgtgggtccgccaggctccgaggggaggggctgggagtggggtgccaanataaagccaagataggaagtgagacatactatgtggactcgtgtagggaaacggggcccgtaatttccaaccctattcccgtacgtaggaacgaaccgaaaccggacccaaaggcgccttacaacctggtattcctgaacctaaaagtcgaaaaccgngacccgtaggaagtacgtacggacggacaccggggttcttaggttacgtacgttacgtggtaacggacgaacgtaccgtacccgttaccccgtacggtaactacgg

SEQ ID NO: 383850 - DNA, 765 bp, Homo sapiens
  misc_feature: GZ8MTXP02JXDE0.21.40.D07.1.454.CMB.2.raw
  modified_base (691)..(691): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagcgttgggttttccttgttgcttattttagaaggtgtccagtgtgaggtgcagcgtggtggagtcggtgggggaggtcgtttggtcccgaggtcccggttcggggggttccctggacgtacctcctccgtggtgcgacgtccctcgtggtacttcctacctttaggtagtcttagttggatggacggtcgttcggggtcccgccgaggccgtaccggaagggggaaggggtcgtggggagggttggggtcggaacccaaagaagtaaaaggaccgaaaggagtagggaagtaggaagaactacgttactagtggttacggacttcggtagggtacgggaaacggggtcccttaaattcccgaacctagttccccaccgaaaggaaccgtaaacccaaccggaccaaaaggacgccttacacgttagttactcgtaacgaactaaaacgtggaaaacccgtcggtaccggtaagggacggtaccggtaacggggaaacgggtacccggtacgggttacgttaggtttaacgtttaccgtttacggnggggtaaccggaaccgggttaaacggtaccccggttaccccccgtttaccccgggttaacgggtaacgtcgggg

SEQ ID NO: 383851 - DNA, 620 bp, Homo sapiens
  misc_feature: GZ8MTXP02H108J.21.40.D07.1.454.CMB.2.raw
  modified_base (345)..(345): a, c, t, g, unknown or other
tcagtcgtcgctcgcacgaccggtgctcgatttagtgatagagcgtaacaacagaggggagagaggagcccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattctacctttagtagctattggatgagcgtgggtccgccaggcctccgaggggagggcgtgggagtgggtgaccaanaataaagccaaagataggaagtgagacatactatgtagactcgtgtggaaacggggcctaattccgaacctatcctacccgaagacgaaccaaacgccaaagcgctacaacttgtaactcgtagaccaaaatcgaaacacgtccgtagaagtacgtacggaacgggaacctaccggggtacttagggttagttaaacgttttaacggtggtaacggaccggaaaagtaccgggttaacccttccccccccggtttaacggggtttaagtaaccgg

SEQ ID NO: 383852 - DNA, 775 bp, Homo sapiens
  misc_feature: GZ8MTXP02H4OX3.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtcctgagactctcctgtgcagcctctggattcctacctttagtagtctaagttggatggagtcgtcggggtcccgccgaggcctaccggaggggaacggggtcgtaggggagggttggggtacggaccaaaacgaaagtaaaacggccgaaaggagtagggaaaggttgaagaactattaacgttaagtcgggtaggtaaccttcgtagggttacgggaaacgggggtcccgtaatttcccgaaaccctacgttacccgttacccgaaggaacggaaacccgaaacccgacccgtaaaaggaccggtccttaaccgtaccgtttaggttaacttccgttaagaaacccaaaagttacggaaaccgtaacgtccccgttaaggaacggtaacggttaccgggaacggggaaccctaccggggtacttaggtttaccgttaaagtttaccggtgggttaacgggttacgggggacttttaacggttttaccggttaccccgggtaacccccggggtttaccggggggaaaccccccggggg

SEQ ID NO: 383853 - DNA, 683 bp, Homo sapiens
  misc_feature: GZ8MTXP02HLRNA.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattcacctttagtagctattggatgagcgtgggtccgcaggctccgaggggaagggctgggaggtgggtgaccgaacaagtaaagaccaagagtaggaagtgaagacatactaagtgtaggacttcgtaggtagggaaacggggccgtattcccgaacctaacttcccgtaccaaggaacgaacgaaaccgacccaaaaggacgacctacaccgtttagtaacttccgtagaaacgtaaaacgttacggaaactaacggtcccgttaagggaaacggaacgggttaccggaaacggggtaaccgaaccgggtaccgttacggttaagttaacgtttaaccggtaggttaacggacggtaaacggtaacggttaacccccgttacccccccggttaagggtttaaacgtaacccgggg

SEQ ID NO: 383854 - DNA, 761 bp, Homo sapiens
  misc_feature: GZ8MTXP02HPRNH.21.40.D07.1.454.CMB.2.raw
  modified_base (261)..(261): a, c, t, g, unknown or other
  modified_base (688)..(688): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagctgggttttccttgttgctattttagaaggtgtccagtgtgaggtgcagctggtggaggtcgtgggggaggtcgttggtccgagccgtgggggtccctgagactctcctgtgcngcctcgtggattctacctttagtagtctattggatgagtcgtcgggtccgccgaggcctaccggaggggaacggggctggggaggtggggtacggaccaaacagtaaaacggccgaaaaggagtagggaaaggtgaacgaacgtattaacgtagtaggtggtaacttcgtagggtacgggaaacgggggtccctaaatttacccgaactactttccccgaaccgaaggaaaccgaacccgaaaacccgacccgttaaaaggccgtaccccttaacgtaaccgtttggtaaacttccgggtaacaaacccgtaaaaataccgggaaaacctcggtacccgttaaaggggaaaagtaccgggttaaacgggaaaaccggggtaccgtaaacccgggggttagtttacgggttaacgttaacgtttacgnggggttaaccgggaacggtaaaccggtacccgtaacccccgtttcccccgggtttaaacgggttaactacggg

SEQ ID NO: 383855 - DNA, 671 bp, Homo sapiens
  misc_feature: GZ8MTXP02IMLK7.21.40.D07.1.454.CMB.2.raw
  modified_base (370)..(370): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcgtttggtccaggtccgtcggggggtcccctggagtaccttctcctgtgcacgtcctcgtggtattctacctttagtagctagttggatggagcgtcgggtccgccgaggcctaccggaggggaggggctgggaggtggggtggacccaaanaaagtaaagaccaaagagtaggaagtgagacatactatggtagacttcgtaggtaggaaacgggggtcctaactttaccaaccctagttcccgtaacccaacgggaaacggaaaccaaaacggacccaaagaacgtcctaaccacgttgttactacgtacgaacaaagtacgaaacagtacccgttagggaaacgtacgggtaccggaacggacgtacccgggtagttggttacgtttaactttacggtagtaagtaccggtaaggtaccgtaccgtcccccggttaacgggtaataccgg

SEQ ID NO: 383856 - DNA, 518 bp, Homo sapiens
  misc_feature: GZ8MTXP02I8EBV.21.40.D07.1.454.CMB.2.raw
  modified_base (440)..(440): a, c, t, g, unknown or other
  modified_base (490)..(490): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggggaggcttggtccagccgtggggggtccctgagactctcctgtgcagcctctggattcactttagagctattggatgagctgggtccgccaggctccgaggggaggggctgggagtgggtgccaacataaagccaagatggaaagtgaagactatatatgtgactctgtgaggcgattcacatctacacgagacaacgaccaagagactacactatatctagacaanagacacgacgagagagacgacgacgacgacgtagtacgtattagtagtgngacgacgacgtacccgtacgtacgtacg

SEQ ID NO: 383857 - DNA, 620 bp, Homo sapiens
  misc_feature: GZ8MTXP02JMRDR.21.40.D07.1.454.CMB.2.raw
  modified_base (340)..(340): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtggggggtccctgagactctcctgtgcagcctctggattcacctttagagctattggatgagctgggtccgccaggctccgaggggagggctgggagtgggtggaccaanataaagcaagataggaagtgagacatactatggtaggatacgtgtaggaaacggggccctaattccaacctaattcccacccaaggaacgaaaccgaaacggacccaaaaggtacgccttacgaacctttaggtaaacttccgtaggaacctaaaaagtaacgaaacgaacgaccgtagaggaaggtacggacgggaacggaacggacgtacggttacgttaacgttaacgttaggtggacggaggaacggtacgtaccccgttaccggttacgtaacgg

SEQ ID NO: 383858 - DNA, 833 bp, Homo sapiens
  misc_feature: GZ8MTXP02HQ82M.21.40.D07.1.454.CMB.2.raw
  modified_base (264)..(264): a, c, t, g, unknown or other
tcagtcgtcgctcgcacgaccggtgctcgatttagtgatagagcgtaataacagaggggagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggagtcttggtccagccgtgggggcctcgtagacgtctctcgtgcgacncgtctcggtagttacttaccttaaccgtttagtacgtacttaggtgtataggcgtcgggttccgggcccacggacggtacccgtaccggggaagggggtacgggtcggtaggggtagggttcggggaccgaaacccaaagttaaaacggaacccgaaaggaaagttagggaaggggttaacggaggaaaccggtataaaccgtttaaaagtggttacggggtaaccggttccttacggttagggggtaaacgggggaacccgggtaccctttttaaccaacccggaaacttttccgtcccccgaaaagggaaggaaaccccgaaacccgaacccgaaacccggaaaagggtttcctccctttaaaaccggttacgtttaaaccgttaccgacgaaacaaaaacgttaacgtaaccgaaaccgtcgggtacgtaaacggggaacgggtaaccggggaaacgggaccggtaaccggttcggttagtttaacggtaacttttacgttcgggaacggaacggacgtaaacccggtacccggtttacccccctttaacggggttaacgtaacgg

SEQ ID NO: 383859 - DNA, 613 bp, Homo sapiens
  misc_feature: GZ8MTXP02J1PU6.21.40.D07.1.454.CMB.2.raw
  modified_base (280)..(280): a, c, t, g, unknown or other
  modified_base (384)..(384): a, c, t, g, unknown or other
tcagtcgtcgctcgcacgaccggtgctcgatttagtgatagagcgtaacaacagaggggagagaggagccttagccctggaccccaaggcctttccacttggtgatcagcactgagcacagaggactcaccatggaattggggctgagctgggttttccttgtgctattttagaggtgtccagtgtgaggtgcagctggtggagtcgtgggggaggcttggtccagccgtggggggtccctggagactctcctgtgcagcctctggattcacctttaganctattggatgagcgtgggtccgccgaggctccgaagggagggctggagtggggtggtccaaacataaagcaagagtggaagtgagacatactatgtggactcgngtgaaacgggcgattaccaccaatcctacccaggacacaaacgacccgaaagtacgactctaaaccttgtaagttccaggaccaaaagttagaaaccagaccccggttagaacggacgttacggaacgggacttacgggacctaggtggttaaactttaaccgtggttacggaagaacggaacgggtacccttaccccccggtaacccgggtttaaacgtacggtacgg

SEQ ID NO: 383860 - DNA, 689 bp, Homo sapiens
  misc_feature: GZ8MTXP02HLA6S.21.40.D07.1.454.CMB.2.raw
  modified_base (528)..(528): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgttgggttttccttgttgcttattttagaaggtgtcagtgtgaggtgcagcgtggtggagtcgtgggggagcgttggtccaggccgtcggggggtccctggacgactctcctgtgcagcctcgtggacttcctacctttagtagctagttggatggagtcgtcgggtccgccgaggcctaccggaggggaaggggctgggaggtggggtcggaccaaagaagtaaaacgccaaaggatgggaaatggaagaactataactatggtaggacttcgtaggtacgggaaacggggcccgtaatttcccgaaccctattccctaccgaagaacgaaccgaaaccgaccgaaagacgtcctacaacgttagtactaccggtaanaaactaaaagtacgaaaccgtacggtacgtaaggaacggtacggtaacgggaaacggacccggtacggttacgttacggttacgtttaaacttacggtaggtaacggtaacggtaacggtacccgtaaccccgtttacccccggttaacggtaacgtacgg

SEQ ID NO: 383861 - DNA, 426 bp, Homo sapiens
  misc_feature: GZ8MTXP02JR1CE.21.40.D07.1.454.CMB.2.raw
  modified_base (220)..(220): a, c, t, g, unknown or other
  modified_base (308)..(308): a, c, t, g, unknown or other
  modified_base (403)..(403): a, c, t, g, unknown or other
  modified_base (411)..(411): a, c, t, g, unknown or other
  modified_base (413)..(413): a, c, t, g, unknown or other
  modified_base (415)..(426): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaaccggcccccaaactcctcatctataggaataatcagcggccctcaggggtcccctgaccgattctctggctccaattctggcacctnagcctccctggccatcagtgggctccggtcaggatgaggctgattatactgtgcagcatgtgatgacggcagagtggccgtgttcggnggagggaccaggctgaccgtcctaggtccagcccaaaggtctgcccccctggtcactctgttcccacctccgtccagcgacgactcgagcggcgngcgagcgnanannnnnnnnnnnn

SEQ ID NO: 383862 - DNA, 730 bp, Homo sapiens
  misc_feature: GZ8MTXP02IXB62.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgttgggttttccttgttgcttattttagaaggtgtccagtgtgaggtgcagcgtgggtggaggtcggtgggggaggtcgttggtccaggccggtcgggggtccctgacgtctcctccgtgtgcagtcctcgtggtacttcctacctttagtagtctagttggatggagcggtcgggtccgccgacggccgtaccggaaggggaacggggcgtaggggagggtgggtacggaccaaagaaagtaaagacgaaagagtaggaagtgaagactatactagtgtacgactcgtaggtaggaaacgggtcctaattaccaaccgtattcccgtacccgaaaggaaccaaccgaaacccgtaccgaaaggaccgtaccttacgtaaccgttagttaaccttcggtaacgaaacctaaaaggttacggaaaacccgtacggtacccgtaggaaaaccgggtacggtaaccgggaaacggtaaaccggtccgggtatttacgggttaacgttaacgttacggttgggaacggtcgggtaaaacgtaccggttaacccccgttcccccggtttaaggggtaaactacggg

SEQ ID NO: 383863 - DNA, 530 bp, Homo sapiens
  misc_feature: GZ8MTXP02FHIEF.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctgggtccgccaggctccgaggggaaggggctgggagtggggtggccaacataaaagccaaagatgggaagtgagacatactatgtggactctgtgaaagggggccctaattccaaccatctcccagacacaacgccaaagagctcactgtatctgacaaaatgaaacagcctagagagtcgaaggacacggctgtcgtatacgtgtgcgagacgactcccccgtacggtatacgg

SEQ ID NO: 383864 - DNA, 597 bp, Homo sapiens
  misc_feature: GZ8MTXP02GTFT8.21.40.D07.1.454.CMB.2.raw
  modified_base (434)..(434): a, c, t, g, unknown or other
  modified_base (470)..(470): a, c, t, g, unknown or other
  modified_base (542)..(542): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaggtgtccagtgtgagtgcagctggtggagtcgtgggggagtcttggtccaggccgtgggggtccctgagactctcctgtgcagcctctggattctacctttagtcgtcttagttgatgagtcgtcgggtccgccaggcctaccggaggggaggggtctggggaggttggggtacggaccaataagtaaagacccgaaagagtaggaagtgagactatacgtagtggtagacctgtggtagggaagggccgtatcgaccntcctaccgagacgaacaacggaccaaagacgctacncgtttagacttctacgaacaaattacgaaacgacgtccagggaaccgaggtacggaaagtacgaccgggttntaggtacgttactcggtggaacgtacggacgtacgtacccgtccgtacgtatacg

SEQ ID NO: 383865 - DNA, 450 bp, Homo sapiens
  misc_feature: GZ8MTXP02IDWQ6.21.40.D07.1.454.CMB.2.raw
  modified_base (282)..(282): a, c, t, g, unknown or other
  modified_base (443)..(450): a, c, t, g, unknown or other
tcagtcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtcccctgaccgattctctggctccaattctggcacctcagcctcctggccatcagtggctccggtccgaggatgaggctgattattactgtgcagcatgtnatgacgctgagtggtcggtgttcggcggagggaccaggctgaccgtccgtaggtcccagcccgaaggcctcgccccctcgggtccacttctcgtttcccccacccctccgtccgacgccgacgacctgacggccgggactgggccgaagggccgacagagnnnnnnnn

SEQ ID NO: 383866 - DNA, 645 bp, Homo sapiens
  misc_feature: GZ8MTXP02FNCKJ.21.40.D07.1.454.CMB.2.raw
  modified_base (259)..(259): a, c, t, g, unknown or other
  modified_base (345)..(345): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggtttccttgttgctatttagaggtgtccagtgtgaggtgcagctggtggagtcgtgggggagcttggtccagccgtgggggtccctgagactctcctgtgcagcctntggattcacctttagagctagttggatgagcgtgggtcccgcgaggctccggaggggaaggggcgtgggaggtgggtcgaccaaanaagtaaagccgaaaggagtagggaagtgaagaactatactagtggtacgacttcgtaggtacggaaaggggccctaattaccgaacctataccctaccgaagaacgaaccaaaccgacaaagacgtaccctactacgttgtacttcgagaaccaaagtacgaaacgtacgccgtaggaacgtacggaccggaacgggtaaccaccggggtattaggggtttactttaacgttaccgttcgggaaggaccgtaaacgggtaccgtaccccgtttaccccccggtacgggtttaactaacgg

SEQ ID NO: 383867 - DNA, 536 bp, Homo sapiens
  misc_feature: GZ8MTXP02H83B4.21.40.D07.1.454.CMB.2.raw
  modified_base (342)..(342): a, c, t, g, unknown or other
  modified_base (355)..(355): a, c, t, g, unknown or other
  modified_base (409)..(409): a, c, t, g, unknown or other
  modified_base (430)..(430): a, c, t, g, unknown or other
tcagtcgtcgctcgcacgaccggtgctcgatttagtgatagagcgtaacaacagaggggagagaggagcccttagccctggactccaaggcctttccacttggtgatcagcactgagcacagaggactcaccatggaattggggctgagctgggttttccttgttgctattttagaaggtgtccagtgtgaggtgcagctgggtggagtctgggggaggcttggtccagcctggggggtccctgagactctcctgtgcagcctctggattcacctttagtagctattggatgagctgggtccgccaggctccgaggggaaggggctgggagtgggtgccaanataaagccaaagntaggaagtgagacatactatgtggactctggtagaaggggccattcaaccatcnccagagacaacgcaagagctnactgtatctgacaaatgaacagcctagagagtacggaggacacgggtctaggttgtaactttactggtgcggaaaggacgtaccgtcccccgtacgggtaatacgg

SEQ ID NO: 383868 - DNA, 693 bp, Homo sapiens
  misc_feature: GZ8MTXP02H1E8O.21.40.D07.1.454.CMB.2.raw
tcagtcgtcgctcgcacgaccggtgctcgatttagtgatagagcgtaacaacagaggggagagaggagcccttagccctggactccaaggcctttccacttggtgatcagcactgagcacagaggactcaccatggaattggggctgagctgggttttcctgttgctattttagaggtgtccagtgtgaggtgcagctggtggagtcgtgggggagcgttggtccagccgtgggggtccctgacgactctctgtgcagtcctcgtggacttctaccttagtagcttagttggatgagtcgtcgggtccgccgaggcctacggaggggaacggggcgtagggaggtgggtacggaccaacgaataaacgccgaaagtagtaggagtagaagaactataactagtggtacgtactcgtagtaggaacgggtcctattacccgaacctacgtccctaacgacggaactaacccgaaaaccgacaaacggaccgtccttaacaaccgttagtaactccgacgtaaaccaaaagttacgaaaccaacggtacccgtaaggtaaacggtaaccgtaaccgggaacggtaaccggtaccgggtaccgttaggtttacgttaaaccggtttagtacgggtaacggacggttaaaaggtcccggttaacccttaccccccggttacggttaaagtacccggg

SEQ ID NO: 383869 - DNA, 600 bp, Homo sapiens
  misc_feature: GZ8MTXP02HP7JB.21.40.D07.1.454.CMB.2.raw
  modified_base (306)..(306): a, c, t, g, unknown or other
  modified_base (350)..(350): a, c, t, g, unknown or other
  modified_base (521)..(521): a, c, t, g, unknown or other
  modified_base (551)..(551): a, c, t, g, unknown or other
  modified_base (568)..(568): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtgggttttccttgttgctattttagaaggtgtccagtgtgaggtgcagctggtggagtcgtgggggagcttggtccagccgtggggggtccctgagactctcctgtgcagcctctggattctacctttagagtctattggatgagcgtcgggtccnccgaggctccggaggggaaggggctgggaggtgggtgaccaaanaagtaaagcaaagagtaggaagtgagactatactaatgtggtactcgtaggtaggaaacggggtcctaacttaccaacccgtattccctacccgaaaggaacgaaacccgaaaccgacccgaaaagtaccgtctaccgaactttgtaactccgtagaacaaaatcgaaacngtactaggacgagtacggacgacgacggtnttagtcgttattacggngtcgacgaacgactaccgtcccggtagtatcg

SEQ ID NO: 383870 - DNA, 721 bp, Homo sapiens
  misc_feature: GZ8MTXP02HB6VC.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgcttattttagaaggtgtccagtgtgaggtgcagctgggtggagtcgtgggggagcttgggtccagccgtgggggtccctgagactctcctgtgcagcctcgtggattcactttagacgtctattggatgagcgtgggtccgccgaggcctaccgaggggaagggctgggaggtgggtacggaccaaacaagtaaagccgaaagagtaggaagtgaagactagtactatggtagaccttgtagtagggaaacgggccctaaatttcaaacccgtaattcccgtaaacccgaaagggaacgaaaccccgaaaacggacccccgaaaaaggggtttacccgtacccttaaccgtaaacgtttagtaaccttacggtaaagaaaaccgttaaaagtaaacgtaaacgtaacgtaccgtaacggtaacggtaacggtaacgggtaacgggtaaccggtaaccggtacggttacggttacgtttaacgtttaacgttacggtaacggtacggtaacggtaaccggtaacccggttaccccggttacccggttaacggtaacg

SEQ ID NO: 383871 - DNA, 614 bp, Homo sapiens
  misc_feature: GZ8MTXP02GTCSG.21.40.D07.1.454.CMB.2.raw
  modified_base (348)..(348): a, c, t, g, unknown or other
  modified_base (445)..(445): a, c, t, g, unknown or other
  modified_base (567)..(567): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattctacttagtagctattggatgagcgtcgggtccgccgaggctccggaggggaggggcgtgggaggtggggtcgaccaanagtaagaccgaagagtaggaagtgagactatactagtgtagacttcgtaggtagggaacgggtccctaagttcccaaactctcccgtacgaacgganaaacccgaaccgacaaaggcgtacctactaacttgttaactcgtaaggaacctaaaagtcgaaacacggtcctaagggagtacggacgaacgggactccgggtatggttacgtactttacgnggtaacggcgtagtaaccggtccctaccccggttacgggtataccgg

SEQ ID NO: 383872 - DNA, 641 bp, Homo sapiens
  misc_feature: GZ8MTXP02JVFCB.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctcgtggattctacctttagtagctagttggatgagcgtcgggtccgccgaggcctaccggaggggaacggggcgtaggggaggttggggtcggacccgaaacgaagtaaaagaccgaaagagtaggaagtgaagactatactagtggtagactcgtggtaggaacggggtcctaattccactatcctacgagacgaacaacgaccaaagacgtctactacgtagttactaccgtacgaaacctaaaagttacggaaaaccgacgtacccgttaaggaaacgggtaacggggtaccggaaacgggtaccgaaccggggtctaggtttacgtaagtttaccgtggtaaccgagacggacgtaccctccccgtacggtatacg

SEQ ID NO: 383873 - DNA, 610 bp, Homo sapiens
  misc_feature: GZ8MTXP02JO8E4.21.40.D07.1.454.CMB.2.raw
  modified_base (478)..(478): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggtttcctgttgctattttagaggtgtccagtgtgaggtgcagctggtggagtcgtgggggaggcgttggtccaggccgtggggggtccctggagacctctcctgtgcacgcctctggattcacctttagtagcttattggatgagtcgtgggtccgccaggcctaccgaggggaaggggctgggagtgggtgaccaacagtaaagccaaagatcgggaaagtgaagacatactagtggtagacttcgtagtagggaaacgggtcccgtatttaccaccgtacgttcctacccaaggaacgaaaccaaaccgacccgaaaaggaacncctacacgttagttacttcgtacgacctaaaagtcgaaacagtcctaggaacgcggtaacgacggaccacggtctaggttagtaacttcgtaggtgaccgtaagacggtacctcccccgtagggtactacgg

SEQ ID NO: 383874 - DNA, 680 bp, Homo sapiens
  misc_feature: GZ8MTXP02HWDZN.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctggagactctcctgtgcagcctctggattctacctttagtagtctatggatgagcgtgggtccgccgaggcctaccggaggggaacggggcgtaggggaggtggggtcggaccaaacgaagtaaaacgaccgaaaggtagtagggaagtaggaagaactataacgttagtggtacggtaacttcgtaggtacgggaaacggggtccctaatttacccgaccctattcccgtaccgaaaggaacgaacccgaaaccgacccaaaaggccgtacctacgaactttgtaacttcgacggaactaaaagtcgaaaacgtcggtaccgtaaggaacggtaacggtacggaaacgggtacccgaacgggtcttacgggttagttaactttaccggtggtaacggacggtaacgacgtacccgttcccccgtaggttaacgaccgg

SEQ ID NO: 383875 - DNA, 619 bp, Homo sapiens
  misc_feature: GZ8MTXP02JIWCS.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattctacctttagtagcttatggatgagcgtgggtccgccgaggcctaccgaggggaaggggctggggagtggggtcggccaaacgaagtaaagccgaaagatagggaaagtgaagacagtactagtgtggacttcgtggtagaaacggggcccgaatttcccgacctattcccgtacccaaggaaacgacccaaacgggacccaaagacggcctacgacttgtacttcgagaacaaaagtgaaaccgagcccgtaagagacgtacgggaacggaccgaacgggtcttggttacggttaactttaccgtaggtggacgaaaggtacgaaccttcccccgtaccggtaatacgg

SEQ ID NO: 383876 - DNA, 641 bp, Homo sapiens
  misc_feature: GZ8MTXP02IFR5X.21.40.D07.1.454.CMB.2.raw
  modified_base (537)..(537): a, c, t, g, unknown or other
  modified_base (594)..(594): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggttttcttgtgctatttagaggtgtcagtgtgaggtgcagcgtggtggagtcgtgggggaggtctttggtccgagcccgtcgggggggtccctggacgaccgtcttcctgtcgcagcctcgtggattctacctttagtagtcttaagttggaatgagcgttggggtccgccaggctccgaggggacggggctgggaggtggggtcggaccaaaacgtaaagtaaaagccaaaaggtagtaggggaaagtggaaaggacattaacgtaatggtaggaccttgtgtagggaaacggggtcccgaattacccgaccctagtccctaccgaagacgaaccaacgccaaaagtcgctacaacttgtaatcgtagactaaaatcgaaaccncgacctagaacgacggtacgaaacggcgacggtcgttaggttacgttactttacggnggtaagaccggaaggtaccgtacccgttccccggtaacggttagacg

SEQ ID NO: 383877 - DNA, 620 bp, Homo sapiens
  misc_feature: GZ8MTXP02JCRW4.21.40.D07.1.454.CMB.2.raw
  modified_base (392)..(392): a, c, t, g, unknown or other
  modified_base (468)..(468): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcgttggtccaggccgtgggggtccctgagactctcctgtgcacgcctctggacttctacctttagtagctattggatgagcgtcgggtccgccgaggctaccggaggggaacggggctaggggaggtggggtacggaccaaacaagtaaacgaccgaagagtaggaagtgaaganatactagtgtgactcgtagtaggaaacggggctattaccactatcctaccgaggaacaaccaacgaccgaaagacncgtacactagtactccgtagaacctaaaatcgaaacagaccgtagaacggaggtacggaaacggacgaacgggtcttacggttacggttaattaccgtacgggtggaaccggaggaccgtaacccgtttcccccggtacggttaacgtacgg

SEQ ID NO: 383878 - DNA, 603 bp, Homo sapiens
  misc_feature: GZ8MTXP02HFQKB.21.40.D07.1.454.CMB.2.raw
  modified_base (373)..(373): a, c, t, g, unknown or other
  modified_base (556)..(556): a, c, t, g, unknown or other
  modified_base (602)..(602): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctggttttcctgttgctattttagaggtgtccagtgtgaggtgcagctggtggagtcgtgggggaggcttggtccagccgtggggggtccctgagactctcctgtgcagcctctggattctacctttagtagctattggatgagcgtgggtccgcaggcctccgaggggacgggctagggaggtgggtcgaccaacaagtaaagccaagagtaggaagtgagacntactatggtagactcgtggtacggaacggggccctattccaaccgtattcccgtaccgaagacgaaccaacgaccaaagcgaccttacacttagtaactcgtaagacctaaaagtcgaaaccagccgttaggaacgacggtacggacgggaccgtccgggtattggttacgtaacgtttacgnggtcggaaccgaggtacgtaaccgttcccccgtagggtttaaaccng

SEQ ID NO: 383879 - DNA, 548 bp, Homo sapiens
  misc_feature: GZ8MTXP02IN6Y6.21.40.D07.1.454.CMB.2.raw
  modified_base (358)..(358): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcactttagagctattggatgagctgggtccgccaggcctccgaggggaaggggctgggagtggggtcggccaaacataaagccaaagntggaaagtgaagacatactatgtgactgtgtggaagggccattcaacatctaccagacgacaacgccaaagagtctacacttagtactccgtagaccaaagtcgaaacacgcctagagagtacggaggacacgggctagtgttaactacgttggaacgacgagacgaccttcccccgtacggtaatacgg

SEQ ID NO: 383880 - DNA, 642 bp, Homo sapiens
  misc_feature: GZ8MTXP02I6LSR.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctctggattcactttagagctattggatgagcgtgggtccgccaggctccgaggggaaggggctgggagtgggtcggaccaaacgaataaaagccaaagagtaggaagtgaagacagtactagtgtcggactcgtagtaggaaacggggccctaattccaaaccattccctaccgaaggaacaaaccaaacgacctaaagacgtccttacacttgtaactcgttagaaacctaaaagtcggaaaaccgacgtaccgttaaggaacggtacggtacgggaaacgggaaccggacggggtacttacggttacgttaacgtttacgtagggtaacggacggtaaacggtaccgtacccgtttcccccggttaacggttacgtacgg

SEQ ID NO: 383881 - DNA, 537 bp, Homo sapiens
  misc_feature: GZ8MTXP02FH947.21.40.D07.1.454.CMB.2.raw
  modified_base (442)..(442): a, c, t, g, unknown or other
  modified_base (534)..(534): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctgggtccgccaggctccgaggggaaggggctgggagtggggtggccaaacataaaagccaaagatagggaagtgagacataactatgtgactctggtagaaagggccgattcaaccatcctaccagagacaacgaccaaagagctanactgtatcgtagacctaaaatgaaacagacctgagagtcgaggaccacggctagtagtactactgtgcgagaggtacctccccgtacggtanacg

SEQ ID NO: 383882 - DNA, 680 bp, Homo sapiens
  misc_feature: GZ8MTXP02J199Z.21.40.D07.1.454.CMB.2.raw
  modified_base (279)..(279): a, c, t, g, unknown or other
  modified_base (303)..(303): a, c, t, g, unknown or other
  modified_base (341)..(341): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctctggattcacctttaganctattggatgagcgtgggtccgtnacggctccggaggggagggctgggagtgggtgaccaanaagtaaagccaaagagtaggaagtgaagacataactatggtagtactcgtggtagggaaacggggtcccgtaattacccgaacctattccccgaccgaaggaaccgaaaccaaaccggaccaaaggaccgtcctaccaacttgttaactccgtaagaacctaaaagtccgaaaactacggtccgttaaggaaacggttaacggtaccgggaaacggggaaccctaccgggggtacctttaggggtttaacgttaaaccgtttaaccgtggggttaacgaacccgggtaaggtaaccccggtaccccgttcccccccggtttaaggggtaactaacgggg

SEQ ID NO: 383883 - DNA, 582 bp, Homo sapiens
  misc_feature: GZ8MTXP02FI63A.21.40.D07.1.454.CMB.2.raw
  modified_base (304)..(304): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagcgtgggtccnccgaggctccgaggggaggggctgggagtggggtgaccaaacgataaaagccaagagtaggaagtgagtacatactatgtggactcgtggtagaaacggggtcctattaccacattcctaccagtacgaaccaacggacccaaaggacgcctacacttagtacttcagacctaaagtgaaaccagcctaggagtacggtcgaggaccacggggtctaggttagtacttacgtagtcggcggtaaacgaaccggtcttaccccccgtacgggtatacgg

SEQ ID NO: 383884 - DNA, 653 bp, Homo sapiens
  misc_feature: GZ8MTXP02G25NW.21.40.D07.1.454.CMB.2.raw
  modified_base (512)..(512): a, c, t, g, unknown or other
  modified_base (550)..(550): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggagtcgttggtccgagccgtgggggtccctgacgactctcctgtgcacgcctctggtacttcctaccttagtagtcttattgatggagcgtgggcccgcgaggcctaccggaggggaaggggcgtggggaggtgggtacggaccaaacgtaaagtaaaacgacgaaagtagtaggaaggtgaacgaactagttacgtaagtaggtaggtaccttacgtagggtacgggaaacggggcccttaagtcccaaccgattcccgtacgaggtaaacgaaccgaaaaccgccaaaaggtacncctacgtaacttgtaactcgtaagaaacaagtacgaanacgccgtaagaacgaggtacgaacggaccgacggtacgttagttagttaacgttcggtacggcgaacgtacggacgttacccgtccccggtaacgagttacgg

SEQ ID NO: 383885 - DNA, 613 bp, Homo sapiens
  misc_feature: GZ8MTXP02HH3AJ.21.40.D07.1.454.CMB.2.raw
  modified_base (308)..(308): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggtcgttggtccagccgtggggggtccctgagactctctgtgcagcctctggattctacctttaagtaacttatggatgagcgtgggtccnccgaggcctccgaggggaggggcgtgggaggtggggtggaccaaagaagtaaagcaagagtaggaagtagagacaatctatgtggtactcgtggtagaacgggggcctagttcccacatcctacccgagacgaaacaccgacaagcgcctaccacttgttaaactccgtagaaccctaaaagtacggaaacacggaccctaggaaagtacggacgggaacgacccgaagggcctttagggtcttaaacgttccgtggtacgaacggaacgtaccgtaccgtaccccggtacgtaacgacgtacgg

SEQ ID NO: 383886 - DNA, 635 bp, Homo sapiens
  misc_feature: GZ8MTXP02JPKO1.21.40.D07.1.454.CMB.2.raw
  modified_base (445)..(445): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagagtctattggatgagcgtggtccgccgaggctccgaggggaaggggctgggaggtgggtggaccaaacaagtaaagccaaagatggaagtgagacataactagtggtggactcgtgtagaaacggggccaattcaccatcctaccagacgaacaacgccaaagacnctacgactagtactctagactaaaagtcgaaacacgcccgtagacgtaacggtacgggaacggtaccgaaacggggtccgttacgggtttaggttaaaccctttaacggttacggggtaacgggtaaccgggtaaacggtaccggttaacccccgttacccccgggttaaccggggttaacgtaaccggg

SEQ ID NO: 383887 - DNA, 611 bp, Homo sapiens
  misc_feature: GZ8MTXP02GLQFW.21.40.D07.1.454.CMB.2.raw
  modified_base (303)..(303): a, c, t, g, unknown or other
  modified_base (342)..(342): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggggaggcttggtccagccgtggggggtccctgagactctcctgtgcagcctctggattcacctttagtagctattggatgagctgggtccncaggctccgaggggaggggctgggaggtgggtggccaanagtaaagccaaagatggaagtgagacatactaatggtagactcgtggtaggaaacggggcctaatttccaacccgtattccctaccccgaagaacgaaaccaaacggacccaaaaggacgtcctaccacgttgtatccgtagaccaaaatcgaaacagccctagagtacgtacggaacggacaacggggtcttaggttagttaaacgtttaccgtgggtaacgacgaacggacggttaaccctcccccgttaccggggtaataaccggg

SEQ ID NO: 383888 - DNA, 643 bp, Homo sapiens
  misc_feature: GZ8MTXP02HOWNB.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagcgtgggtccgcaggctccgaggggaaggggctgggaggtggggtcggaccaaacaagtaaaagccgaaagagtagggaagtggagacattactagtgtggactcgtaggtggaaagggggcctagtttccacctagtcctaccgaggaacgaccaaaccggacccaaaggacgccttacacctttaggtaacttcccgtagaaccctaaaagttcggaaaacctaggacccttagggaacggtacggttacgaaacggggtaccgaaccggggtcttacgggttatttaacgtttaccgtggtcggacggtaggacgtacccgttacccccgtacgggttataaccggg

SEQ ID NO: 383889 - DNA, 607 bp, Homo sapiens
  misc_feature: GZ8MTXP02I4WD7.21.40.D07.1.454.CMB.2.raw
  modified_base (497)..(497): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtcccaggccgtggggggtccctggagactctcctgtgcagcctctggtattcctaacctttagacgtcttattggatgagcgtcgggtcccgccgaggcctccgaggggaggggcgtgggaggtggggtcgaccaaacaataaacgcgaagatagggaagtgaagactagtactatggtagctcgtagtaggaaacggggcctattccacatcgtataagacgaacaacgacaaagacgcctacacttagtatcgtagaactaaatacgaaacncggtacgtaggaagcgtacggaaaggaccgtacgggtcttaggttagtaaacttttcgagggtcgaacggtacggacgtacccgttacccccgtacggttaagtacccgg

SEQ ID NO: 383890 - DNA, 552 bp, Homo sapiens
  misc_feature: GZ8MTXP02IKGTS.21.40.D07.1.454.CMB.2.raw
  modified_base (304)..(304): a, c, t, g, unknown or other
  modified_base (342)..(342): a, c, t, g, unknown or other
  modified_base (411)..(411): a, c, t, g, unknown or other
  modified_base (520)..(520): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattctacctttagtagctattggatgagctgggtccncgaggcctccgagggaagggctgggagtgggtgccaanaataagccaaagatgggaagtgagacagtactaatgtagactctgtagaaggcattcacatctacaganacaacgacaagagcctacacttgtactctagacaaaagtcaaacgtagaccctaggaagacggttacggaggtaaaccgcggtctaagttcggtaaatttctgtaacgnggaacgtacgacttccccgtacggtataacgg

SEQ ID NO: 383891 - DNA, 705 bp, Homo sapiens
  misc_feature: GZ8MTXP02JRUIO.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggagtcgttggtccaggcccggttggggggtccctggacgtactcctcctgtgcacgtcctgtggtacttcctaccgtttagagtcttagttggatgagtcgtcgggtccgccgaggcctaccggaggggacggggcgtagggaggttggggtcgaacccaaagaagtaaagaccgaaaggtagtaggaagtgaagactagttactagtcggtagtactcggtaggtacgggaaacggggtccctaaatttcccaactacgttcccgaaaccgaggaaccaaacccgaaaccgacccgtaaaagccgtccctaccgtagttcgtaactccgtaagaaaccaaaagtcgaaaacgcggtaccgtaagggaacgtacggtaaccggacggggaaacctcggggtacttacgggttagttaacctttcggaggtaacgaaccggttaacggaaacccgttccccgtttaacccccgtacggggtatacccggg

SEQ ID NO: 383892 - DNA, 731 bp, Homo sapiens
  misc_feature: GZ8MTXP02IBGF8.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggtcgttggtccaggccgtgggggtccctgagtactctcctgtgcagcctctggtattctacctttagtagtcttagttggatgagtcgtcgggtccgccaggcctccgaggggaaggggcgtgggaggtgggtcggaccaaagaataaagccgaaagagtagggaaggtgaagacagtaacgttatacgggttacggaacttcgttagggtacggggaaacggggtcccgtaacgtttacccaaacccgtacgttcccgttacccgaaacggaaacgaacccaaaaccgggacccaaaggaacgtcccttaccacgtttacgtacttccgttacgaaaccgtaaaagttcggaaaaccgacggtacccgtaaggaacggtaaccgggttacgggaaacggtaaccgaccgggtacgtttacggttacgtttaaccgtttacggtaggttaacggacggtaacggtaccggttaacccgtttaccccccggtttaacggggttaaacttcccggg

SEQ ID NO: 383893 - DNA, 613 bp, Homo sapiens
  misc_feature: GZ8MTXP02JGE8C.21.40.D07.1.454.CMB.2.raw
  modified_base (259)..(259): a, c, t, g, unknown or other
  modified_base (316)..(316): a, c, t, g, unknown or other
  modified_base (504)..(504): a, c, t, g, unknown or other
  modified_base (519)..(519): a, c, t, g, unknown or other
  modified_base (552)..(552): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggagtcgttggtccagccgtgggggtccctgagctctcctgtgcngcctctggtacttcacctttagtagtctagttggatggagtcgtcgggtcccgccgnggccgtccggaaggggaaggggcgtgggaggtggggtacggaccaaacgaagtaaagacgaaagtagtaggaaagtgaagactatacgtatggtgtactcgtggaggaacgggtcccgtattccgaaccattacccgtaccgagaacgaacgaacgaccaaagacgactactacgttagtatacgtanaacaaagtcgaaacncgtccgtagagacgtaacggagtaaacgcggtnttacgtagtttaacgtcgtagtggacgaacgtacgtacccgtcccccgttacggtatacgg

SEQ ID NO: 383894 - DNA, 589 bp, Homo sapiens
  misc_feature: GZ8MTXP02J1LWI.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcgttggtccagccgtggggggtccctggagactctcctgtgcagcctctggattcacctttagtagctattggatgagcgtgggtcccgccgaggcctccggaaggggaaggggctgggaggtggggtggccaaacataaaagccaaagatgggaaagtgagacatactatgtgactcgtagtggaaacggggccattccaacctatcctccgaagaacgaccgaaacgcccaaaaggcgcctcaacgttgtactccgtagacaaaagtgaaaaccagccgtagaagacggtacggaaagggccacgggtcttgggtataacgtttacgtggtcgacggaagacgtaacctcccccggtacggtaatacgg

SEQ ID NO: 383895 - DNA, 633 bp, Homo sapiens
  misc_feature: GZ8MTXP02F7RZC.21.40.D07.1.454.CMB.2.raw
  modified_base (309)..(309): a, c, t, g, unknown or other
  modified_base (346)..(346): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagtcttggtccaggccggtggggggtccctgagacctctccgtgtgcaggcctctggattccacctttagagtctattggatgagcgtggtccncgaggcctccgaggggacgggtcgtgggaggtggggngacctaaaagagtaaacgccaaagagtaggaagtgagacagtactagtgtaggtacctgtagggtaggaacggggtcctaagttcccaaacctctccgtaccgagaccgaacgaaccgaccaaagacgtcctacgacgttgtactcgtagaaactaaagtcgaaacgcgttcccaggaaacgtacggtacggaaacggtaccgacggttccgttaggtacgtttaacgttaaccgtggtaacgggcgaaacgttaccggaccttcccccggtacgtttagtaaccgg

SEQ ID NO: 383896 - DNA, 713 bp, Homo sapiens
  misc_feature: GZ8MTXP02GP6VT.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagctgggtggagtcggtgggggaggtcgttggtccgaggtccggtggggggtccctggagacctctccgtgtgcacgcctcgtggtacttctacctttagtagtcttagttggatgagcgtcgggtccgcgaggtccgtaccggaggggaagggcgtagggtacggtggggtacggaccaaacgaagtaaacgaccgaaaggtagtagggaaaggtgaagaactataactagtggtacgtcctagtagggtagggaaacgggtcctagttaccaacctatccctacgaacgtaacgaaccaaccgaccgaagacgtcctaccgtaacttcgtacttaccgtagtaacctaaagtaccggaaactacggtacccgtaaggaacggaacggtaaccggggaacgggtaaccgtaccgggtcgtttaacggttacgggtttaaactttccgggttagggtaaccggaccggaaagttacccgggtaccctttaacccccggggttggtaaacgttacgg

SEQ ID NO: 383897 - DNA, 569 bp, Homo sapiens
  misc_feature: GZ8MTXP02H6TR1.21.40.D07.1.454.CMB.2.raw
  modified_base (482)..(482): a, c, t, g, unknown or other
  modified_base (535)..(535): a, c, t, g, unknown or other
  modified_base (567)..(567): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcttgttgctattttagagtgtccagtgtgaggtgcagctggtggagtcgtgggggaggcgttggtccgagccgtggggggtccctggagactctccgtgtgcagcctcgtggacttcctacctttagtagtctattggatgagcgtgggtccgtcgaggctccgaggggaaggggctgggaggtggtggaccaaagagtaaagccaagagtaggaagtgagacatacgtatgtagactcgtgtggaaacggtccgattcgaacctatcctacgagacgaacaacgcaagacgctacacttagatcgtagactaaaagtcgaaacncggtacaggaaacgagtccggaagtacgaacggtctaggttactagtttacgngaacgacgacgacgtacccgtcccgtagtacncg

SEQ ID NO: 383898 - DNA, 630 bp, Homo sapiens
  misc_feature: GZ8MTXP02JB3AS.21.40.D07.1.454.CMB.2.raw
  modified_base (313)..(313): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaggtgtccagtgtgaggtgcagctggtggagtcggtgggggaggcgttggtccgaggccgttggggggtccctggacgactctcctgtgcagcctgtggtattctacctttagtagctagtggatgagcgtcgggtccnccgaggcctaccgaggggaaggggctggggaggtggggtcggaccaaacgtaagtaaaagccgaaaagagtagggaaagtggaacgaactagtactaagtgtagactcgtgtaggaaacggggcctattccaacctattcccacaaggtaacaccgaaacgaccaaggagccttacgacgtagtacttcgaacgaacaaagtcgaaaacgtcgacctaggaaagtcggtacggaagaaacccgcggggttcttacggtagttaaccgtttacgaggcggaacgacggtacgtccctacccccggttaggtaactcgg

SEQ ID NO: 383899 - DNA, 610 bp, Homo sapiens
  misc_feature: GZ8MTXP02FKEBZ.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccggtggggggtccctggagactctcctgtgcagcctgtggattcacctttagagctagttggatgagtcgtcgggtccgccaggctccggaggggaaggggctgggaggtggggtggaccaaagaagtaaagaccaaagtagtaggaaagtgaagactatactagtggtagacttcgtagtaggaaacgggggtccctagtttcccaacctactcctacccgaaggaacgaaccgaaaccgacccaaagacgcctacgtactagtactcgtagacctaaaagtcgaacacgcgagaggtaacgcggaacggacgacggtcgtaggttagttacgtacttgaaggtacgaacgacgtaccgtacccgtacccgtagtaacg

SEQ ID NO: 383900 - DNA, 627 bp, Homo sapiens
  misc_feature: GZ8MTXP02FXKND.21.40.D07.1.454.CMB.2.raw
  modified_base (355)..(355): a, c, t, g, unknown or other
  modified_base (370)..(370): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggagtcgttggtccaggccgtgggggtccctgagacctctcctgtgcagcctctggacttctactttagagtctagttggatggagtcgtcggtccgcaggctaccgaggggaacgggctgggaggtggggtcgaccaaanagtaaagccgaaagngtaggaagtgaagactatactagtgtacgactcgtaggtagggaaacgggccttaatccgaacctagtcctaccgaagacgaaaccacgacgtaagaccgctacagtgtactacgagaactaaagtacgaaaccagtccgtaggaagtaccggtacggaaagggccacggggtcttaggttaggttaaacctttcgggaggtaacggaaccggtaacggtaccgttaccccgttacccccggtaggtaacgtaacgg

SEQ ID NO: 383901 - DNA, 678 bp, Homo sapiens
  misc_feature: GZ8MTXP02G6SVN.21.40.D07.1.454.CMB.2.raw
  modified_base (321)..(321): a, c, t, g, unknown or other
  modified_base (371)..(371): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggaggtcgttggtccaggtccggtggggggtccctgacgacctcctcctgtgcagcctcgtggtacttcctacctttagtagtcttagttggatgagcgtgggtccnccgaggcctaccggaggggaaggggcgtagggaggtgggtcggaccaaanaacgtaaagcccgaaagtgtaggaagtgaagactatactagtggtacggacttcgtaggtacggaaagggggtccctaagttaccgaaccctattccctacggaaagaacgaaccaaaccggccgaaaacggctccctacgacgtttagaactttccgaagaaacctaaaagttcgaaaccgtacggtaccctagggaagtaccggtacggaaacggggaccgtacggttactggggttaattaacgttcgtaagggttcgacggtaacggaacgttccccgtacccggtaccggggttaaatacgg

SEQ ID NO: 383902 - DNA, 636 bp, Homo sapiens
  misc_feature: GZ8MTXP02GQ8W0.21.40.D07.1.454.CMB.2.raw
  modified_base (268)..(268): a, c, t, g, unknown or other
  modified_base (499)..(499): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccggtggggggtccctggagacctctcctgtgcagcctntggattcacctttagagtctagttggatgagcgtggtccgccaggcctcggaggggaaggggcgtgggaggtggggtcgaccaaacgtaagtaaaacgccgaaaggagtagggaaagtgaagactataacgtatggtagacttcgtaggtaggaaacggaccgtattaccaccgtatccctacgaagacgaaccaaacccgacaaagacgcctacacgttgtaacttcganaaccgtaaatcggaaactacggcctaggaagtacggtacggaaacggaaccaccggggttattaggtacgtttacgttacggtaggtaacggacggtaacggtaccgtaacccgttccccggtaacggttataccgg

SEQ ID NO: 383903 - DNA, 719 bp, Homo sapiens
  misc_feature: GZ8MTXP02GZPSS.21.40.D07.1.454.CMB.2.raw
  modified_base (280)..(280): a, c, t, g, unknown or other
  modified_base (346)..(346): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcacatggaattggggctgagcttgggttttccttgttgcttattttagaaggtgtccagtgtgaggtgcagctggtggagtcgtgggggagcgttggtccagccgtgggggtccctgagactctctgtgcagcctcgtgacttctactttganctagttggatgagcgtggtccgcgagctaccggaggggagggctgggaggtggggtacgaccaaanaagtaaacgcgaaagagtagggaagtgaagactatacgtatggtacgaacttcgtagtacgggaaacggggtcctaagttacccaaccgttctacccgtaccgaaggtaacgaaaccgaaacccgaccgaaaagtaccgtccttaccgaactttcggtaaattcccgtaaggaaaactaaaacgtaccggaaaaccgtacggacccttaagggggtaaaacgaacgggtaccgggaaaacgggtaaaccccgtaaggggttcctttaagggggtttaacttaaccggtttaaaccggttgggtaaccggtaccggaacgggttaaaccgtacccccgttacccccggtttaccggggttaaaattacccgggg

SEQ ID NO: 383904 - DNA, 730 bp, Homo sapiens
  misc_feature: GZ8MTXP02GCW2K.21.40.D07.1.454.CMB.2.raw
  modified_base (262)..(262): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggagcttggtccagccgtgggggtccctgagactctctgtgcagcctntgattctacttagagctattggatgagcgtcgggtccgccgaggccgtaccggaggggaacggggcgtaggggaggtggggtacggaccaaacgtaagtaaaacggaccgaaagtagtagggaaaggtaggaacggtaactagttaaccgtagttggtacggtaccttcgtagggttaagggaaaccgggggtccctaactttacccgaacctacttaccccgtaaccgaaggtaaaccgaaaacccgaaccgaacccgaaaggtacgtacccttacgtaaccgtttagttaaccttacgacgaaaactaaaacgttacggaaaccgtacgtcccgaaggacggaacggtaacgggaaacggaacctacggggtaccgttagggttaactttaacgttacggttaggtccgaaacggtacggtaaaacccttacccggttcccccggtaaagggttaactaaccgggg

SEQ ID NO: 383905 - DNA, 689 bp, Homo sapiens
  misc_feature: GZ8MTXP02JN8J8.21.40.D07.1.454.CMB.2.raw
  modified_base (298)..(298): a, c, t, g, unknown or other
  modified_base (364)..(364): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcactatggaattggggctgagctgggttttccttgttgcttattttagaaggtgtccagtgtgaggtgcagcgtggtggagtcggtgggggaggtcgttggtccgaggccggtcggggggtccctgacgtacctctccgtgtgcagtcctcgtggtattcctacctttagngtctagttggattggagtcgtcgggtcccgccgaggcctaccggaggggaacggggccgtaggggngggtggggtcggaacccaaaacgtaagtaaaagacccgaaagtagtagggaagtgaagactatacgtagtgtacgacttcgtaggtagggaaacggggtcctaacgttcccaactactccctacgaacggaacgaaaccgaaccgaccgaaaggtacgcctactaccttgtactcgtaagaacctaaagacgaaacgcgtaccgaggaacggtaagtaccgggaaggaccggtacggtaccgttaggttacgttaagtttaccggacgggtaacggaacggtaacggtacccggtacccgttaccccggtacggtaacggtacgg

SEQ ID NO: 383906 - DNA, 563 bp, Homo sapiens
  misc_feature: GZ8MTXP02F3PII.21.40.D07.1.454.CMB.2.raw
  modified_base (319)..(319): a, c, t, g, unknown or other
  modified_base (336)..(336): a, c, t, g, unknown or other
  modified_base (347)..(347): a, c, t, g, unknown or other
  modified_base (353)..(353): a, c, t, g, unknown or other
  modified_base (356)..(356): a, c, t, g, unknown or other
  modified_base (358)..(358): a, c, t, g, unknown or other
  modified_base (373)..(373): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattcactttagagctagttggatgagcgtggtccgccagctcgagggagggcnggaggtgggcgaccaanaataagcaagngagagngananatctaatgtagactntgtagagggtcattcgacatcctacagacgaacacgacctaagacgcacactgattcgagacaaaagtcgaaacacgtccgtagaacgtagtacggaacggaccgacggtacttggttagttaaaccgttgttggtaacgaccggtaaggtaacggtaccctttaccccccggtaggttaaacttacggg

SEQ ID NO: 383907 - DNA, 657 bp, Homo sapiens
  misc_feature: GZ8MTXP02HJFMF.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtgggggaggcttggtccagccggtgggggtccctgagactctcctgtgcagcctgtggtacttctacctttagtagtctagttggatgacgtcgtcgggtccgccgacggcctaccggaggggaaggggcgtagggaggtggggtacggaccaaacgaagtaaagaccgaaagagtaggaagtgaagactatactagtggtagactcggtagtagggaaacgggtcctaagttccaaccgtatccgaccaaggaacgaaccgaaaccgaccaaaggacgtacctacgacgttagtactcgtaacgaactaaaagtacgaaaaccgtcgtaccgtaaggaaggaccggtaaccggaacggggaccaacggggtcttagggttaacgtttaacttaccgtggtaacgacggtaacgacgttacccgtcccccgtaaggtaacgtaccgg

SEQ ID NO: 383908 - DNA, 611 bp, Homo sapiens
  misc_feature: GZ8MTXP02I0QN3.21.40.D07.1.454.CMB.2.raw
  modified_base (309)..(309): a, c, t, g, unknown or other
  modified_base (339)..(339): a, c, t, g, unknown or other
  modified_base (346)..(346): a, c, t, g, unknown or other
  modified_base (357)..(357): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgtagctggtggagtcgtgggggagtcttggtccaggccgtggggggtccctgagactctcctgtgcacgcctctggtacttcacctttagtagctagttggatgagcgtgggtccncgaggctccgaggggagggctggagtgggngaccaanataaagcaagntagggaagtgagacatactagtggtcggacttcgtggtagggaacggggtccgtatttcccaaccgattcctacccgaagacgaaccaaacgacccaaagcgacctactacgttattactccttaggaacaaagtcgaaacgacgtaccgtagaacgaggtaccggaagggacctaccgggtcgttagttacgttagttacgtggtagaacggtaacgtacggtacccttccccggtacggtaaactggtaccg

SEQ ID NO: 383909 - DNA, 704 bp, Homo sapiens
  misc_feature: GZ8MTXP02F0F8R.21.40.D07.1.454.CMB.2.raw
tcagtcgtcgctcgcacgaccggtgctcgatttagtgatagagcgtaacaacagaggggagagaggagccttagccctggaccccaaggcctttccacttggtgatcagcactgagcacagaggactcaccatggaattggggctgagtcttgggttttccttgttgcttattttagaaggtgtccagtgtgaggtgcagcgtgggtggaggtcggtgggggaggtcgttgggtccgaggtcccggttcggggggtcccctggacgtaccttccttccgtggtcgccacgtcccttcgtggtacttcctacctttaaggtatcttagttggatggagtccgttcgggtcccgccgaggtccctaccggaagggggaaggggcgtggggagggtggggtacggacccaaaacgaagtaaaacgcgaaagtagtaggaagtgaagacaatactagtgtagactcgtggtacgggacgggccctattacccactactcccacgagaccgaacaaccgaccaaagcgtacctacacgttgtactcgtaacgaaactaaagtacgaaaactcgtaccgtagggaacgtaggaaccggaacggaccgtacgggttacttacggttacgtttaaattaaccggtggttacggaacggtaacggtaaccggttaccccgttacccccggttaggtaacgttaccggaacggg

SEQ ID NO: 383910 - DNA, 669 bp, Homo sapiens
  misc_feature: GZ8MTXP02GPMV3.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcgttggtccaggccgtgggggtccctgagactctcctgtgcagcctcgtggacttcctacctttagtagtcttattggatgagtcgtgggtccgccgaggcctaccgaggggaaggggcgtgggaggtcggggtcggaccaaacgaagtaaagaccgaaagagtaggaaagtgaagactatactagtgtaggactcgtgtaggaaacggggtcctaagttcccaaccgtattcccgtaacccaaggtaaacgaaacccgaaaccggacccgaaaaggacgtacccctacgaaccgtttaggtaacttaccgtagaaacctaaaagtcgaaaacctacgccgtaaggacggacgtacggaacggacgacggtcttaggttacgttaaagtttaccgtggtaacgaccggtaacgtacgtaccccgttcccccgttacggggtaataaccggg

SEQ ID NO: 383911 - DNA, 678 bp, Homo sapiens
  misc_feature: GZ8MTXP02GSOB4.21.40.D07.1.454.CMB.2.raw
  modified_base (556)..(556): a, c, t, g, unknown or other
  modified_base (603)..(603): a, c, t, g, unknown or other
  modified_base (626)..(626): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggaggtcgttggtccagccgtgggggtccctgagactctcctgtgcagcctctggattctacctttagtagctattggatgagtcgtcgggtccgccgaggcctaccggaggggaacggggcgtggggaggtggggtcggacctaaacgaagtaaagaccaaagagtaggaagtgaagactataactagtggtacgtactcgtagggtagggaaacggggtcctaattcccgaacctattccctaccgaaaggaacgaaaccgaaaccgaccgaaaaggccgtccttaccgaacgtttacggtaacttccgtaagaaaccctaaaaagttccggaaaaccncggtaccgtaaggaacggtacggtacgggaacggaccgtaccgggtnttaggttacgttaacgttacggnggtaacggaacggtacgtacgtaccccgtacccccggttacggtaactacgg

SEQ ID NO: 383912 - DNA, 600 bp, Homo sapiens
  misc_feature: GZ8MTXP02F86Y8.21.40.D07.1.454.CMB.2.raw
  modified_base (537)..(537): a, c, t, g, unknown or other
  modified_base (555)..(555): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtggggggaggcgttggtccaggccgtggggggtccctgagactctcctgtgcagcctctggattccactttagtagctattggatgagctcgggtccgcaggctacgaggggaaggggctgggagtggggtggaccaaacgataaagccaaagatagggaagtgaagacatactagtgtacggactcgtgtaggaaacggggccctaattcccaacctattccctacccgaaggaacgaacccaaacggcccaaaagtcgccttacactgtaactcgagacaaaatgaaacacgcctagaagacgtacggaacggactaccgggttntaggttagttaacttcgnggtaacgacggaacgtaccgtaccctacccccggtacggtaatcg

SEQ ID NO: 383913 - DNA, 670 bp, Homo sapiens
  misc_feature: GZ8MTXP02IDIEK.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctggagactctcctgtgcagcctctggacttctacctttagtagctattggatgagcgtgggtccgccaggcctccgaggggaaggggctgggaggtggggtggaccaaacaagtaaagccaaagagtgggaagtgaagacataactatggtaggtaacctcgtaggtagggaaacggggtcccgtaatttacccgaaccctattccctacccgaaaggacgaaaccgaaaccgcccaaaaggacgcctaccaacgtttagtaacttcgtagaacctaaaagtacgaaacgacggtacccgtaggaaacggtaacggtacggaaacgggtaccgaaacggtccgttaggttacgtttacgtttaaccgtggtaacggtaccggaaaggtaccgtacccgtttcccccccggtaaggttaactaaccggg

SEQ ID NO: 383914 - DNA, 584 bp, Homo sapiens
  misc_feature: GZ8MTXP02HHL32.21.40.D07.1.454.CMB.2.raw
  modified_base (252)..(252): a, c, t, g, unknown or other
  modified_base (255)..(255): a, c, t, g, unknown or other
  modified_base (275)..(275): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggtttcgtgtagcgtatttagaaggtgtccagtgtgaggtgcagctggtggagtgtgggggagcttggtccagccgtgggggtccctgagctctccgtgtncgngcctgtgtcttctacttagngtctagtgatgagtcgtcggccgcgacggccgtacggagggaggcgtgggaggtgggtcggacgaacgaaagtaagacgaagagagagagagatatatagtgtagtacgtcgtagaggacgtacgtactacactactactacgacgacgaacgaaccgacgaacgacgtacgtacgtacgtacgtacgtacgtacgtaacaaacgtaacgaacgacgtacgacgacgacggacggacggacgtacgtacgtacgtacgttacgttacgtagtaagacgacgtacgtaccgtacccgtaccgtacgtacg

SEQ ID NO: 383915 - DNA, 589 bp, Homo sapiens
  misc_feature: GZ8MTXP02FL8K3.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtgggggtccctgagactctcctgtgcagcctctggattctacctttagtagctattggatgagcgtgggtccgccgaggctccggaggggaggggctgggaggtggggtgaccaacaataaagcaagagtagggaagtgaagacataactagtgtaggactcgtggtaggaacggggccgtaattccacatcctacgagacgacaacgaccaagacgctacacgtagtatcctagactaaaagtcgaaacacgacccgtaggaacggtaacgacgggaaggaaccgacgggacttggttagttaacttcgttggaacggtcggaagtaccgtacccgtccccgtacgggtactacgg

SEQ ID NO: 383916 - DNA, 704 bp, Homo sapiens
  misc_feature: GZ8MTXP02H61VT.21.40.D07.1.454.CMB.2.raw
  modified_base (516)..(516): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcggtgggggagtcgttggtccgaggtccggtcgggggtccctggagtacctctccgtgtcgcacgccctctggtattcctaacgtttgtagtctagttaggatgagcgtcgggtccgccgaggccgtacggaggggaacggggtcgtggggtaggtggggtcgaaccaaacgtaaagtaaagccgaaagagtaggaaggtgaagtactagttactagtacggtagaccttgtaggtagggtaaacggggcccttattacccaacctacttcccaccgaagaacgaaccgaaacccgcaaaggtaccnctactaacgtttgtacccttagacgaaaacctaaaaggcgaaaacggaccttaccggagaaacggacggtaaccgggacggtaaaccggcggttacgttagggtttaaccgttaattttaccgggaggtaaccggacggtaaaacgtaccccggttaccccgtttacccccggtacggttaaacgtcg

SEQ ID NO: 383917 - DNA, 692 bp, Homo sapiens
  misc_feature: GZ8MTXP02JI53M.21.40.D07.1.454.CMB.2.raw
  modified_base (618)..(618): a, c, t, g, unknown or other
  modified_base (689)..(689): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggtacttcctacctttagtacgtcttagttggatggacgtcgttacgggtcccgccgaggccgtacccggaagggggaacggggcgttaggggacggttggggtaccggacccaaacgaaagtaaaacggacccaaaggtagtagggaaacgtgaacgactatacgttagtggtaggtactcgttaggacgggaaacgggccgtaattcccgaactactccgtaccgaaggacgaacccgaaacgacccgaaagtaccgtccttaccgacttaggtactcgtacgaacctaaaagtcggaaaccacgtaccgtggtaaacgacggggttacgacgggtaaccgaaccggggttnttaacggtttacgtaactttacggtgaacggtacggaacgtaccggtacccgtttaccccggtacggttanacg

SEQ ID NO: 383918 - DNA, 602 bp, Homo sapiens
  misc_feature: GZ8MTXP02JDZYX.21.40.D07.1.454.CMB.2.raw
  modified_base (545)..(545): a, c, t, g, unknown or other
  modified_base (575)..(575): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattcgacctttagagctattggatgagcgtcgggtccgccgaggcctaccggaggggaacggggctgggaggttggggtggaccccaaacgaagtaaaaggcccgaaaaggagtagggaaagtggaacgacattaaccgtagtggttacggaccttgtggttagggaaacgggggccctaaattcccaacctagttccccgtaccaagggaacgaaccgaaacggcccaaaaggtcgctacacgttgtactcgtagacaaagtgaaactgccgtagagngtacggagaccacggctgtcgtaatcgtgngacgagacgcctcccgtacggtatacg

SEQ ID NO: 383919 - DNA, 622 bp, Homo sapiens
  misc_feature: GZ8MTXP02GBMNY.21.40.D07.1.454.CMB.2.raw
  modified_base (357)..(357): a, c, t, g, unknown or other
  modified_base (558)..(558): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctgggtccgcaggcctccgaggggaggggctgggagtggggtgaccaacagtaaagccaaagntagggaagtgaagacatacgtaatggtaggaccttcgtggtagggaaacggggcccgtaatttcccaccgtaattcccgtaccaagacggaaccaaaccgggacccaaaggacgtaccctacgaccttaggttactccgttagaacctaaaagttcgaaacctaggccctagggacgacggtacggaggaccaccggggtnttaggttacgttaacttacgtggaacggacgacgaccgtacccgttccccggtacggtatacgg

SEQ ID NO: 383920 - DNA, 680 bp, Homo sapiens
  misc_feature: GZ8MTXP02G2ZYR.21.40.D07.1.454.CMB.2.raw
  modified_base (529)..(529): a, c, t, g, unknown or other
  modified_base (547)..(547): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcgttggtccgaggtcccggttcggggggtccctggacgtacctcttcctgtcgcagcctcgtggtacttacctacctttagtacgtctagttggatgacgcgtcgggtccgccgaggcctaccggaggggacggggcgtgggaggtgggcgaccaacaagtaaacgccgaaagagtaggaagtgaagactatactagtcggtagtactcgtaggtacgggaaacggggtccctaagttcccacctagttcccaccgtaggaacaacccaaacggcccaaagacgtcccacgtacttagtaacttcggaaanaaccgtaaacacgaaacncggtacgtagggaaacgtacggtacggaacggtaccgtacggttcggttaacgttacgtttaacgtacggttacggaacgggttaaccggaacgtacccgtacccccgtttaccccgggtaaggttaagtcgg

SEQ ID NO: 383921 - DNA, 641 bp, Homo sapiens
  misc_feature: GZ8MTXP02FL10F.21.40.D07.1.454.CMB.2.raw
  modified_base (199)..(199): a, c, t, g, unknown or other
  modified_base (483)..(483): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaagttggggctgagcttgggttttccttgttgcttatttagaaggtgtcagtgtgaggtgcagngtggtggagtcggtgggggaggtcgttggtccagccggtgggggtccctggagactctcctgtgcacgcctctggtattcctaacctttagtagtcttagttggatggagcgtgggtcccgccgaggctccggaggggaaggggcgtagggaggtggggtacggaccaaacgaaataaaagaccaaagagtaggaaagtgaagacatactagtggtacgactgtgtagggaaacgggtctaatccacattcccaccgagaacaacgaacgaccgaagacgctanactgtaattcgaagaacaaaagtacgaaacgcggaccgtaaggaacggaacgtaccgggaaaggaacccgacgggtcgttaggttacttaaaacgtttccgagggtaacgaacgggtaaacgtaccggttaccccgttacccccggtaaggtaatcgg

SEQ ID NO: 383922 - DNA, 649 bp, Homo sapiens
  misc_feature: GZ8MTXP02I1M76.21.40.D07.1.454.CMB.2.raw
  modified_base (346)..(346): a, c, t, g, unknown or other
  modified_base (588)..(588): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcgttggtccagccgtggggggtccctgagactctccgtgtgcagcctctggattctacctttagtagctattggatgagcgtgggtccgcaggctccgaggggaggggctgggaggtgggtgaccaanaataaagccaaagataggaagtgaagacatactatggtgactcgtagtagggaacgggcctattcccgaacctatccctaccgaaggaacgaaccgaaacccgccaaaaggccgtactcgtaacttagtaacttccgtaagaacctaaaagtacggaaacgacggtaccgtaaggaaacgtacgggtaccgggaaaggtaacccgaccgggtacgttaggttagtttaaaaccgtttacggnggtaaccggacggtaacggtaaccgttaccccgtttacccccggtaacggttaacgtacgg

SEQ ID NO: 383923 - DNA, 575 bp, Homo sapiens
  misc_feature: GZ8MTXP02G4GCW.21.40.D07.1.454.CMB.2.raw
  modified_base (177)..(177): a, c, t, g, unknown or other
  modified_base (257)..(257): a, c, t, g, unknown or other
  modified_base (322)..(322): a, c, t, g, unknown or other
  modified_base (360)..(360): a, c, t, g, unknown or other
  modified_base (373)..(373): a, c, t, g, unknown or other
tcagtcgtcgctcgcacgaccggtgctcgattttagtgatagagcgtaacaacagaggggagagaggagccttagccctggactccaaggcctttccacttggtgatcagcactgagcacagaggactcaccatggaattggggctgagcgtgggtttctgtgctatttagaaggtntcagtgtgaggtgcagcgtggtggagtcgtgggggagtcttggtccaggccgtggggggtccctaggagactctccttgngcagcctgtggattcacttagagctagtggatgagcgtggccgccaggctacgaggggaaggtcngggaggtggggtagaccaaagaataaagctaaagtagnggaaagtcgaaanactatatatgtagtacgtgtagtagacgacgtacgtacactactacgtacgacgaacgaacgaacgaacgaacgacgactactactagtacgtacgtacgaactaaacgtaacgaacgacgacgtacgagaggacggacgacgacgtacgtacgtacgtacgtagtagaacgacgacgacgtacgtaccgtacgtacgtacg

SEQ ID NO: 383924 - DNA, 592 bp, Homo sapiens
  misc_feature: GZ8MTXP02IAT2U.21.40.D07.1.454.CMB.2.raw
  modified_base (492)..(492): a, c, t, g, unknown or other
  modified_base (539)..(539): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagctgggttttccttgttgctattttagaaggtgtccagtgtgaggtgcagctggtggagtcgtgggggaggcgttggtccagccgtgggggtccctgagactctcctgtgcagcctcgtggattcctactttagtagctagttggatgagtcgtgggtccccgcgaggtcctaccggaggggaacggggctaggggtaggtggggtcggacccaaacgaagtaaaacggccaaaagagtagggaaagtgagacagtactagtcgtagactcgtgtagaacgggtccagttccaccagtctacccgaaggacaacaacgcccaagacgtctacacgttgtacttcgngaacaaatgaaaccgtagcctaggacgtacgacggacgacgacggtntagttcgtatttcaggtaacgcgaacgacgacctcccccggtagtaactacgg

SEQ ID NO: 383925 - DNA, 711 bp, Homo sapiens
  misc_feature: GZ8MTXP02IAGNE.21.40.D07.1.454.CMB.2.raw
  modified_base (282)..(282): a, c, t, g, unknown or other
  modified_base (291)..(291): a, c, t, g, unknown or other
  modified_base (301)..(301): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgtggtttctgtagctatttagaagtgtccagtgtgaggtgcagctgggtggagtcggtgggggagcgttggtccagccgtggggggtccctgagtctctcctgtgcagccctgtggattctacctttagagtntagtgatgngcgtcggccncgacggccgacggaggggagggtcgtagggaggtgggacgaaccaaagtaaagtaagacgaaagtagtaggaagtagaagaactattaacgtagtacggtacgtacgttcggtaggtacggaaccggggtacctacgttacccaaccgtactacccgtacgaaagaaccgaaacccgaaaccggtaccgaaaggtaccgtaccttaaccgtacgtttacgtactacgtacgtaacgtaaacgtaacgtaacgtaacgtacgtacggtaacgggtaacgggtaaccgggtaacgggtaaccggtaccggttacggtttacggttacggtttaacgtttaacggttacggtaacggtaacggtaacggtaaccggtaacccggttaccccggttaccggttaacggtaacgg

SEQ ID NO: 383926 - DNA, 629 bp, Homo sapiens
  misc_feature: GZ8MTXP02IQAVQ.21.40.D07.1.454.CMB.2.raw
  modified_base (284)..(284): a, c, t, g, unknown or other
  modified_base (585)..(585): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcggtgggggaggtcgttggtccaggccgtgggggtccctgagctctcctgtgcagcctcgtggattcacctttagngctagttggatgagcgtcgggccgccgaggcctaccggaggggaacggggcgtgggaggtggggtacgaccctaaacgaaagtaaaacgccgaaaggtagtagggaaagtgaacgactagttaacgttaagtttcgggacttcgtagggtaacgggaaacggggtcccgtaatttcccgaacctatcccgtacaagacgaaccaaacgaccaaaggcacctcatgtatcgtagaaacaaagtgaaacctggcctaggaagtacggcgaaacgggcacgggtcgtagttacggttattacgnggtacgcgtaaagcgtaccttcccccggtacgttaagacgtagg

SEQ ID NO: 383927 - DNA, 815 bp, Homo sapiens
  misc_feature: GZ8MTXP02FKH3V.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagtcgttggtccagccggtgggggtccctgagactctcctgtgcagcctcgtggtacttcctaaccgtttaggacgtcttagttggatggacgtcggtcgggtccccgaccgaggtcccgtaccggaagggggtaacggggtcgtaggggaacggggttgggggtaccgaaccccgaaaactaaaggttaaaaacggacccgtaaaaggtaggtaaggggtaaaacgggttaggaaacggaactaattaaccgtaagttacgggtacggtacttcgtaggggttaacgggaaaaccgggggtccctaaactttacccgaaaccttacgtccccgtaacccgaaaggaaacccgaaaccgaaacccggaacccgaaaaggacgtcccctactaaaccgttgttaacttacccgggaaacgtaaaccgtaaaagtaccgaaaccgtacggtaccgtaagggaaacggtacggtaccgggaaacgggtaacccggtacgggtacgtttacgggttaaacgtttaacgttacggtacgggtaaccggaacggtaaaccggtacccgttacccccggtttacccccggtacgggtaaactaccgg

SEQ ID NO: 383928 - DNA, 586 bp, Homo sapiens
  misc_feature: GZ8MTXP02H0T8S.21.40.D07.1.454.CMB.2.raw
  modified_base (259)..(259): a, c, t, g, unknown or other
  modified_base (377)..(377): a, c, t, g, unknown or other
  modified_base (409)..(409): a, c, t, g, unknown or other
  modified_base (416)..(416): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcngcctcgtggattcacctttagtagtctattggatgagcgtcgggtcccgcaggcctccgaggggaaggggctgggaggtgggtggccaaacagtaaagcaaagataggaagtgagacntactatgtgactgtgtgaagggcattcactanctacagngaacacgccaagacgctacacgttgaacttcgtagaacctaaaagtcgaaacgaacgccgtaggaaacggtacggtaccggaagggtaacccgacggtccgttaggttacgttaattaaccgtggtgaccggaagtacgtaacccgttcccccgtacggggtaataccgg

SEQ ID NO: 383929 - DNA, 602 bp, Homo sapiens
  misc_feature: GZ8MTXP02IMSGH.21.40.D07.1.454.CMB.2.raw
  modified_base (310)..(310): a, c, t, g, unknown or other
  modified_base (352)..(352): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcagcctctggtacttctactttagtagctagttggatgagcgtggtccgcgnggcctccggaggggaggggctgggaggtgggtcggaccaaanaagtaaacgaccaaagagtaggaagtgagacatactatggtagactcgtaggtacggaacggggtctaattccaccgtatccacaggaacgaaccaaccggaccaaagacgcctactacgtagtactctagaacctaaagtcgaaacgtcgccgtaggacgacggtacgaggaccacgggtcttaggtacgtttaacgtcgttggtaagacggtaacgacgtaccccttacccccggtaggtaactacgg

SEQ ID NO: 383930 - DNA, 820 bp, Homo sapiens
  misc_feature: GZ8MTXP02JSUNM.21.40.D07.1.454.CMB.2.raw
  modified_base (291)..(291): a, c, t, g, unknown or other
  modified_base (577)..(577): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggaggtcttggtccaggccggtcggggggtccctggagactctcctgtgcagcctctggattctaacctttagtancttagttggtatgagtccgtcgggtcccgccgaggcctcccggaaggggaggggcgtgggaggtggggtacggaccaaacaagtaaacgaccaaaggagtaggaaaggtggaacgaactacgtaacgttagttaggtacggttactacggttgggtaacggggaaacggggttccctaaacgtttaccccaaccttacttacccgacccggaaaggtaaacccgaaacccgaaacccggtaaacgaaaacgggacgtaccttaaccgtacgttaacggtttaaccnccggttaaacggaaacccttaaaaaggtaacccggaaaacgtacccggggtccgtttaaaacgggggaaaggttaaccgggggtaacccggggaaaacgggttaaacccggccgggggtttactttagggggtttaaacctttaaaccgttacggggtggggtaaccggaaccggttaaaacgggttacccccgttaacccccggtttccccccgggggtttaaaacgttaaaggtacccggg

SEQ ID NO: 383931 - DNA, 636 bp, Homo sapiens
  misc_feature: GZ8MTXP02FUBB6.21.40.D07.1.454.CMB.2.raw
  modified_base (387)..(387): a, c, t, g, unknown or other
  modified_base (466)..(466): a, c, t, g, unknown or other
  modified_base (492)..(492): a, c, t, g, unknown or other
  modified_base (513)..(513): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggagtcggtgggggaggtcgttggtccgacggtcccggttcggggggtccctaggacgaccttcctccgtgtcgcacgcctcgtggtactttctacctttagtagtcttagttggatggagtcgtcgggtccgccgaggcctaccggaggggaaggggcgtagggaggtgggtcgaccaaanagtaaagccaaagagtaggaagtgagaactatactagtggtagtacctgtagggtaggaacggggtcctattccaactntccacagacgaccaacgaccagtacnctacacgttgtactcgtaaanaactaaagacgaaacgcgacgtaggaacggtacggtacggacggacgtacggttacttaggttacgttacgttacgtggtaacgacggaacgtaccgtacccgtaccccggtacgtacgtacg

SEQ ID NO: 383932 - DNA, 730 bp, Homo sapiens
  misc_feature: GZ8MTXP02FLDYS.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagccctctggacttcacctttagtagcttattggatgagtctggggtccgccaggcctccgaggggaaggggctgggagtggggtggacccaaacgaagtaaaagccgaaagagtagggaaagtgaagaacatacgattggtaggacgttactggttagggaaacgggggtacccggtaactttaccaacccgtaactcccgttacccaaacggaccggaaaaccaaccggaaaccccgaaagtaaccgggacccttaccgtaaccttaggttaacttacccgttaggaaaccctaaaaagttaacgaaaaccgtagaccccgttagggaaaggaacgttaaccgggaacggggaaaccaccggggtacgttcggttaacggttaagtttaaccggttacggggtgttaacccggggaagtaacccgggaccgtttacccccccggtaaccccggggtttaagtaaaccggg

SEQ ID NO: 383933 - DNA, 531 bp, Homo sapiens
  misc_feature: GZ8MTXP02F88UA.21.40.D07.1.454.CMB.2.raw
  modified_base (264)..(264): a, c, t, g, unknown or other
  modified_base (304)..(304): a, c, t, g, unknown or other
  modified_base (358)..(358): a, c, t, g, unknown or other
  modified_base (373)..(373): a, c, t, g, unknown or other
  modified_base (380)..(380): a, c, t, g, unknown or other
  modified_base (391)..(391): a, c, t, g, unknown or other
  modified_base (442)..(442): a, c, t, g, unknown or other
tcagtcgtcgctcgcacgaccggtgctcgatttagtgatagagcgtaacgaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagcctggggggtccctgagactctcctgtgcagccctntggattcgacctttagagctattggatgagcgtggtaccncaggctccgaggggaaggggctgggagtggggtcgccaacgataaagccaaagntggaacgtgacgacntacatgngactcgtaggngacgcatcacatcacagacgactacgctaagacgtctacagtgtactcganacaatagacgacgacgtagagagacgacggacgacgacgtacgtacgtacgtagtgtgtcgacgacgtacgtaccgtaccgtacgtacg

SEQ ID NO: 383934 - DNA, 585 bp, Homo sapiens
  misc_feature: GZ8MTXP02IUH4H.21.40.D07.1.454.CMB.2.raw
  modified_base (290)..(290): a, c, t, g, unknown or other
  modified_base (307)..(307): a, c, t, g, unknown or other
  modified_base (361)..(361): a, c, t, g, unknown or other
  modified_base (366)..(366): a, c, t, g, unknown or other
  modified_base (417)..(417): a, c, t, g, unknown or other
  modified_base (423)..(423): a, c, t, g, unknown or other
  modified_base (431)..(431): a, c, t, g, unknown or other
  modified_base (465)..(465): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggagtttgggctgagctgggttttccttgttgttattttacaaggtgtccagtgtgaggtgcagctggtggagtcgtgggggagacttggtccagccgtgggacgggtccctgagactctcctgtgcagcctctgctattcaccttcagtcgaccanaacatggactgggtccncaggcctccgaggggacgggcgtgggaggtgggtcgccgtaatacgaacggaanctaanagttacagtacagaatcggcgcgtctggtagaaaggtaagtcacgtatcanaagagntagattanaaaagctacatagtatctgactaaaagtcgaaanacgtcaaaacggaaaacccgaggaaccgaacggtccgttagttaatttagttaggtaacggtaagaaaactaaaaggtagtaagggtaattgggttagggtaggtaccgtcgtagtaacg

SEQ ID NO: 383935 - DNA, 565 bp, Homo sapiens
  misc_feature: GZ8MTXP02FIO18.21.40.D07.1.454.CMB.2.raw
  modified_base (344)..(344): a, c, t, g, unknown or other
  modified_base (480)..(480): a, c, t, g, unknown or other
tcagtcgtcgctcgcacgaccggtgctcgatttagtgatagagcgtaacaacagagggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcactttagagcttattggatgagcgtgggtccgccaggctccgaggggaggggctgggagtggggtgaccaanataaagcaaagataggaagtgagacataactagtggtgactcgtagtaggaaaggggcctaattccaacctatcctaccagaacgaacaacgaccaaagagcctacactgtatctagaacctaaaagtcgaaaacngcctagacggaagtcggaaggaccacgggtcttagtacgttaattcgtaggcgacgagaacggccttccccgtacggtataacgg

SEQ ID NO: 383936 - DNA, 565 bp, Homo sapiens
  misc_feature: GZ8MTXP02FJM2K.21.40.D07.1.454.CMB.2.raw
  modified_base (349)..(349): a, c, t, g, unknown or other
  modified_base (380)..(380): a, c, t, g, unknown or other
  modified_base (447)..(447): a, c, t, g, unknown or other
  modified_base (476)..(476): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgtgctattttagaaggtgtccagtgtgaggtgcagctggtggagtcgtgggggagcttggtccagccgtggggggtccctgagactctcctgtgcagcctctggattcaccttagtagctattggatgagccgtggggtccgccgaggctaccgaggggaaggggtctgggacgtggggtgacccaanataaacgccaagagtgggaaagtggagactntacctagtgtggactcgtgtaggaaacgggccgtattcaccatcctccagacgacgacgccaaagcnctacactgtactcgagactaagacgaacncgcgagacgacggtacgaacggacgacggtcttgtacgttactacgagtcgacggacgaccggtaccttaccccggtacgtacgtacgg

SEQ ID NO: 383937 - DNA, 720 bp, Homo sapiens
  misc_feature: GZ8MTXP02HUYLC.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgcagcgtggtggagtcggtgggggagtcgttggtccaggccggttcggggggtccctggacgtacctctccgtgtcgcagccctcgtggacttcctaaccttttagagtctagttggaatggagtcgtgggtcccgaccgtaggcctaccggaaggggtaacggggctaggggacggttggggtacggaccaaaaacgagtaaaacgccgaaagtagtgggaaagtgagacattactagtgtgaactcgtaggtacggaaacgggtcccaaatttcccaactactccctaccgaagacgaaccaacccgtcaaaaggcaccttcaattggtaaactccggttaaacaaacgtaaaagtaacgtaacgacgtaccgtacgtaacggtaacggtaaccgggtaacggaaccggtaaccggtacggttacggtttaacggtttaacgtttaacggttacggttaaccggtaacggtaaacggtaaccggttaacccgtttaccccggttaacccggttaacggtaacgg

SEQ ID NO: 383938 - DNA, 656 bp, Homo sapiens
  misc_feature: GZ8MTXP02HK383.21.40.D07.1.454.CMB.2.raw
  modified_base (314)..(314): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggaggcgttggtccagccggtgggggtccctgagactctcctgtgcagcctcgtggacttctacctttagtagtctagttggatgagtcgtcgggtccncgaggccgtaccggaggggaacggggcgtgggaggtggggtacggaccaaacaagtaaacgaccgaaagagtaggaagtagagacatactagtgtagtacttcgtaggtacggaacggggtcctacgttaccgaaccctattcccacgaaacggaacgaaaccgtaaacccgaccgaaacggtacggtaccctacgtaacgtttacggtactccgtaaggaactaaaagtacgaaactacgaccgtgaaacggtacggtacgaacggacgtacggtacgtttaggtacgttacgttcgtaggtcgacgaacgtacgacccttccccggtaaggtttacacgg

SEQ ID NO: 383939 - DNA, 671 bp, Homo sapiens
  misc_feature: GZ8MTXP02JS3Q5.21.40.D07.1.454.CMB.2.raw
  modified_base (548)..(548): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggctcaccatggaattggggctgagctgggttttccttgttgctattttagaaggtgtccagtgtggaggtgcagcgtggtggagtcggtgggggacggtcgttcggtaccgacggtccgggttcggggggtccctggacgtacctcctccgtggtcgctacggccctcgtaggtattccgtaaccgtttagacgtctagttggatggagtcgtcggggtccgaccgaggcctaccggaagggggaacggggtcgtaggggaggttggggtcggaaccaaacgtaaagtaaaacggaccgaaaggtagtaggggtaaaaggtgaacgaacgtataaccgtatagggtcggacttcggtggtaggaaacggggtcctaattccacctagtccacgaagacgaacaaccgacaaagtcgctacacgtntatcgtacgaacagttaacgaaccgacgccgtaaggagacggtacggaaacggccgaacggtcttagggtctaaacgttcgtgaacgacggcgaaacgtcccgtccccggtagttacgaccgg

SEQ ID NO: 383940 - DNA, 659 bp, Homo sapiens
  misc_feature: GZ8MTXP02GMCSH.21.40.D07.1.454.CMB.2.raw
  modified_base (308)..(308): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttatttagaaggtgtccagtgtgaggtgcagcgtggtggagtcgtgggggagcttggtccaaccggtgggggtccctgacgactctctgtgcacgcctcgtggacttcactttagagcttagtggatgagcgtgggtcccncgaggcctaccggaggggaacggggtcgtgggaggtggggtcgacccaaaacaagtaaaacggacaaagtagtagggaacttaggaacgaacaattacgtagttggtaggtacttcgtaggtagggaaacgggcgtaacttccaacctacgtactacccgaagtacgaaaccaaaccgaccaaaggactaccttacaccgttagttatccgttagaactaaaactcgggaaacaccgaccgtaggaacgtagtaccgggaagaccgtaacgggtcgttagttacgttacgttacggtggacgaacggtaagtaccgtacccgttaccccggtacggtaacgtacggtacgg

SEQ ID NO: 383941 - DNA, 655 bp, Homo sapiens
  misc_feature: GZ8MTXP02F4LWW.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgcttattttagaaggtgtccagtgtgaggtgcagcgtggtggagtcgtgggggaggtcgttggtccagccggtggggggtccctgagactctcctgtgcagcctcgtggattcctacctttagtagtctagttggatggagcgtcgggtccgcgaggcctcggaggggaggggctgggagtgggtggaccaacgaagtaaagcgaagagtaggaagtgaagacatactatggtggtactcggttaggtagggaaacggggccgtaacttcccaacccgtattccctaccgaaaggaacgaaacccgaaaccggacccaaaaggaccgtacctaacctacgttagttactacgttaagaacctaaaagtacggaaacaacggtcctagggaagacggtacggaacgggaccacggggtctaggttagttacgtttacgtggtaacggaccggtaaggtacctaaccgttcccccgtaggggttaacacgggg

SEQ ID NO: 383942 - DNA, 720 bp, Homo sapiens
  misc_feature: GZ8MTXP02F7HK2.21.40.D07.1.454.CMB.2.raw
  modified_base (267)..(267): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagcttgggttttccttgttgctattttagaaggtgtccagtgtgaggtgcagctgggtgggagtcgtgggggagtcgttggtccaggcccggttggggggtccctgagacctctcctgtgcngcctcgtggattcctacctttagtagtcttaagttggatgagtcggttcgggtcccgccgaggcctaccggaaggggaggggcgtagggagggtggggtcggaccaaagaataaaacggaccaaagagtagggaaagtgaagaacagttactagttggtaggacttcgtggtacgggaaacggggtcccgtaatttcccgaaacctattcccgtaacccgaaaggaacgaaacccgaaaccggaccgaaaacgggacgtccctaacgtaacgtttcggtaacttaccgtaggaaaaccttaaagtacgaaacctaggacccgttaagggaacggtaggtaaccggggaggaaaccgtaccgggttacgtttaggttacgtttaaaacttcgggttaggtaaggaccggtaaaggtacccgtacccgttcccccggtttaacgtaaacgttcgg

SEQ ID NO: 383943 - DNA, 688 bp, Homo sapiens
  misc_feature: GZ8MTXP02IH74M.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgacgactctcctgtcgcacgcctcgtggtattcacctttagtagcttagttggatggacgtcgtcggggtccgccgacgggcctaccggaagggggtaacgggggcgtaggggaggttcggggtcggacccaaacgaaagttaaaaggacccaaaggagtagggaaagtggaacgactatactagtggtacgacttcgtagtaggaaacggggcctagttcccacctatcctaccaggacgaacgaaccgtaccaaaggtacgtacctacaaacgttgtaacttccgtagaaacctaaaagttcggaaacttaccgggacccttagggaacgggtacggtaacggaaacgggacccgtacgggtaccgttggttaacgttaacttccggttaggccggaacggtacggacgttaccccgttacccccggttacgggtaagtaccgg

SEQ ID NO: 383944 - DNA, 532 bp, Homo sapiens
  misc_feature: GZ8MTXP02FGXKQ.21.40.D07.1.454.CMB.2.raw
  modified_base (462)..(462): a, c, t, g, unknown or other
tcagtcgtcgctcgcacgaccggtgctcgatttagtgatagagcgtaacaacagagggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggaggcttggtccagccgtggggggtccctgagactctcctgtgcagcctctggattcacctttagtagctattggatgagctgggtccgccaggctccgaggggaaggggctgggagtggggtggccaacataaagccaagatggaagtgagacatactatgtggactctgtgaaaggggccgattccaccatcctccagagacaacgacccaaagagctcacttgtaatctgacaaaatgaaacngcctgagagtcggaggacacgggctgtcgtacttacgtgtgcgagacgacttcccccgtccggtatacgg

SEQ ID NO: 383945 - DNA, 712 bp, Homo sapiens
  misc_feature: GZ8MTXP02IRZ4K.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtgggggaggtcgttggtccgagccgtggggggtccctgagactctcctgtgcagcctcgtggacttcctacctttagtagtctagttggatggagtcgtcgggtccgccgacggcctaccggaaggggaacggggcgtggggtaggtggggtcggaccaaacgaagtaaacgaccgaaaggagtagggaagtgaagaacattactagtggtgacttcgtagtaggaacggggtcccgtattaccgaccgtagttaccctaccgaaaggacgaaacccgaaacggaccctaaaaggaacgtcctaaccgtacgttaagttacttaccgtaaggaaccctaaaagttacgaaaccgaccggtaccgtaggaaaacgggtaacgggtacggaaaacgggtaccgaacccgggttcgttacggttagtttaacgtttaaccggtggtaacggacggtaacggtaaccggtacccttacccccggttacggttaaaacgtaaccggg

SEQ ID NO: 383946 - DNA, 626 bp, Homo sapiens
  misc_feature: GZ8MTXP02IHRD5.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcctgttgctattttagaaggtgtccagtgtgaggtgcaggctggtggagtcgtgggggaggcttggtccaggccgtgggggtccctgagactctcctgtgcagctctggattcacttagtagctagttggatgagctgggtccgccaggcctccgaggggaaggggctggggaggtggggtggaccaacaagtaaagccaaaggatagggaagtgagacagtactagtggtggactcgtgtaggaacgggtcgattccgaccatctccgagacgaacaacgaccaagacgctacacttgtaactctagacctaaaagtcgaaacgtacggtaccgtaggaaaggtacgggttacggaaacgggacccgaacggggttccttaacggtttgttaaaacgtttccggtggttcgggtacggaacggtaccgtaaccgttacccccccggtttagggttaacgtaaccgggg

SEQ ID NO: 383947 - DNA, 607 bp, Homo sapiens
  misc_feature: GZ8MTXP02FE0WY.21.40.D07.1.454.CMB.2.raw
  modified_base (485)..(485): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctctggattcacctttagagctattggatgagctgggtccgccaggctccgaggggaggggctgggagtggggtgaccaacagtaaaagccaagatgggaagtgagacatacgtatggtggaactcgtggtaggaaaggggcctattccaaccatcctacccaaggacaaccaacgacccaaggacgcctacacttgtattccgagaccctaaaaagcggaaaacncggcccttagggaacggaacggtaccggaaagggacccgaacgggtcgtttacggtagttaacttaaccgtgggtaacgaccggtaaggaaacgcccttacccccgtacggggttataacgg

SEQ ID NO: 383948 - DNA, 632 bp, Homo sapiens
  misc_feature: GZ8MTXP02F02AQ.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagctgggttttccttgttgcttatttagaaggtgtccagtgtgagtgcagctggtggagtcgtgggggaggcgttggtccagccggtgggggtccctgagactctcctgtcgcacgtcctgtggtacttctacctttagacgtcttagttggatggacgtcggtcgggtcccgccgacggcctaccggaaggggaacggggcgtaggggaggtggggtcgaacccgaaataaagtaaaacggaccaaaaggagtaaggaagtgaaacgactagtactagtggtacggtacttcggtaggtagggaaacgggtccgtaattccaaccgtatccgtacgagacaaccgaacgacaaagacgctacacgttatacgttcagaacctaagtacgaactacgactagaacggacgtacgacggacgacggtctaggttacgttaactcgtggtcggacgaacgaccgtaacccgtcccgtacggtaatacgg

SEQ ID NO: 383949 - DNA, 611 bp, Homo sapiens
  misc_feature: GZ8MTXP02HQW19.21.40.D07.1.454.CMB.2.raw
  modified_base (483)..(483): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcctgttgctattttagaaggtgtccagtgtgaggtgcagctggtggagtctgggggaggcttggtccagccgtgggggtccctgagactctcctgtgcagcctctggattcacctttagtgctattggatgagtctgggtccgccgagctccgaggggaaggggcgtgggaggtggggtgaccaaacataaagcccaaagagtagggagtagacgacattactatcggtggtaacttcgtagggtacgggaaacggggtccgtaacgtttccaaccgtactctacccagacgaacaacgaccaagacgctacacttagtattacgngaccaaaagtacgaaacgacgacccgttagacggtaggtaccggaaggaaccgacggaccgttacgtacggttatttaaccgtggttaacggcgaagtacgaactccccccggtaggttacgtaacgg

SEQ ID NO: 383950 - DNA, 621 bp, Homo sapiens
  misc_feature: GZ8MTXP02JVOA2.21.40.D07.1.454.CMB.2.raw
  modified_base (346)..(346): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctggttttccttgttgctattttagaaggtgtccagtgtgaggtgcagctggtggagtcgtgggggagcgttggtccagccgtgggggtccctgagactctcctgtgcagtcctcgtggattcacctttagagctagttggatggagcgtcggtccgcaggctaccgaggggaagggctagggagtgggtgaccaaanagtaaacgccaaagtgtaggaagtgagacagtactagtggtagacttcgtgtacgggaaacggggtcctattaccgacctaatcccgtaccagaagaaccctaaacgggaccaaagttacgcctccgtaaagtgtaactccgtaagaacctaaaagttcgaacgaacgtccgtagaaacggtacgacggaacggaccgtacggtgtggttacgttaagttaccgtaggtcggaccgtaaggtacgaccgttccccccgtaaggttagtaacccgg

SEQ ID NO: 383951 - DNA, 664 bp, Homo sapiens
  misc_feature: GZ8MTXP02JS8NC.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaagttggggctgagcttgggttttccttgttgcttattttagaaggtgtccagtgtgaggtgcagcgtggtggagtcggtgggggaggtcgttggtccaggccggtcggggggtccctgacgactctcctgtgcacgcctctggtacttctacctttagtagtctagttggatgagtcgtcgggtccgccgacggctaccggaggggacggggcgtgggaggtgggtcggaccaacaataaagcaagagtaggaagtgagacatactagtgtagtactcgtgtacgggaacgggccctaattccgaactatccgtacaaggacgaaccaaccgaccgaaagacgtcctacaacgttgtactccgtaagaactaaaagtacgaaaccgtacggaccgttaagaacggtacggtaccggaacgggtaccaacggggttccttaagggttaccgtttaacgttttccggaggttggaacggtaacggtaccgtacccccgtttacccccggttacggggtaaaattcccggg

SEQ ID NO: 383952 - DNA, 675 bp, Homo sapiens
  misc_feature: GZ8MTXP02I6YS2.21.40.D07.1.454.CMB.2.raw
  modified_base (487)..(487): a, c, t, g, unknown or other
  modified_base (496)..(496): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcagcctcgtggtattctacctttagtagtcttattggatgagcgtcgggtccgccgaggctccggaggggaaggggctgggaggtcggggtacggaccaaacgaagtaaacgaccgaaagagtagggaaagtgacggaactattaactagtggtcgacttcgtggtaggaaacggggcctagtttacccaaccgattccctacgagacgaaccgaaacgacccaagacnctacacttntacgtactgaaaccaaaagtcgaaacacgtccgtaggaacggtaacggtacggaacggggaacccgaccgggttacgttaaggttaccgttaaagttttaccggttaggaacggggtacccggaaaggtaacccggtaaccctttacccccccggttaggggttaaacgtttaaccggg

SEQ ID NO: 383953 - DNA, 732 bp, Homo sapiens
  misc_feature: GZ8MTXP02ILGIL.21.40.D07.1.454.CMB.2.raw
  modified_base (289)..(289): a, c, t, g, unknown or other
  modified_base (314)..(314): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagctgggttttcctgttgctattttagaggtgtccagtgtgaggtgcagctggtggagtcggtgggggaggtcttcggtccgaggccggttgggggtccctggacgactctcctgtgcagtcctctggattctacctttagtancttagttgatgagtcgtcgggtccnccgaggtcctaccggaaggggaaggggtccgtaggggaggttggggtacgaaccctaaacgaaagtaaacggacccgtaaaaggtagtaagggaaacgttggaaacgtaacctagttaaccgttagtacgggtacggtaccttcggtgggttaacggaaacgggggtacctaacgtttacccgaactacgtaccctaccgaaacggaacgaaaccgaaaccgaccgaaacggtacaccgttacctacgttcgttacttcgaacgtaacgaaaagttacgaacgacgtaccgttaggaaagacggttaacggaacggtacgaccggttaccgttaggttacgttaaactttcgggtacgtaacgggtaacgtaaccggtacgttaacccgtccccccggtttaaggtaacgttaccggg

SEQ ID NO: 383954 - DNA, 666 bp, Homo sapiens
  misc_feature: GZ8MTXP02GO1GE.21.40.D07.1.454.CMB.2.raw
  modified_base (596)..(596): a, c, t, g, unknown or other
  modified_base (638)..(638): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcgttggtccaggccgtggggggtccctgagactctcctgtgcagcctctggacttctacctttagtacgtctattggatgagcgtgggtccgcgaggctccggaggggacgggctgggaggtgggtggaccaacataaagccgaaagagtaggaagtgaagactatactagtggtacggactcgtagggtacgggaaacgggggtccccttaaattacccgaaccctagtttccccgacccgaagggaacgaaacccaaaccggggacccaaaaggtacgtccctaaacgacgtttaggtaactccgtagaaacctaaaagtcggaaactacggaccgttaggaaagggtaccgtacgggaacgggacctaccgggtnttacggttagttaacttacggtggaacggtcgaaagggtacncccgttcccccggtaacgggtataccgg

SEQ ID NO: 383955 - DNA, 661 bp, Homo sapiens
  misc_feature: GZ8MTXP02GSPSM.21.40.D07.1.454.CMB.2.raw
  modified_base (366)..(366): a, c, t, g, unknown or other
  modified_base (509)..(509): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtgggggaggcttggtccaggccgtggggggtccctggacgactctcctgtgcagcctcgtggattctacctttagtagtctattggatgagcgtgggtcccgccgaggcctaccggaaggggaaggggcgtgggaggttggggtacggacccaaanaagtaaaagaccaaagagtaggaagtggaagacatactagtggtagactcgtggtagggaaacggggccgtaattccaaccgtatcccgtacgaagaacgaaccaaaccgaccaaagaccgctacacgttagtactccgtaanaactaaagtacgaaacgtcggtaccgtagggaaacggtacgggtaaccggaaacgggaccgtaccgggtgttacggttacgtttacgttacggtaggtaacggaacggtaacggtaccgtaccccgttacccccggtacggttaacgtacgg

SEQ ID NO: 383956 - DNA, 611 bp, Homo sapiens
  misc_feature: GZ8MTXP02HIS3A.21.40.D07.1.454.CMB.2.raw
  modified_base (437)..(437): a, c, t, g, unknown or other
  modified_base (560)..(560): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggtcgttggtccaggccgtggggggtccctgagacctctcctgtgcagcctgtggattctactttagtagtctagttggatgagtcgtcggggtccgccgacggcctaccggaggggtaaggggcgtaggggaggtggggtcggaccaaagaagtaaagaccgaaagagtaggaagtgaagacatactagtggtgactcgtgtggaaacggtcattcactntcacagacacaacgacaagacgctacacttgtactccgtagaacaaagtacgaacgaacgcctaaggaacgtacggtaacgggaaaggaccaacggggtcttaggtacgttaacgtttacggngggtaacgacgtaacggtacccgtacccgttacccggtacggttaacgcgg

SEQ ID NO: 383957 - DNA, 671 bp, Homo sapiens
  misc_feature: GZ8MTXP02I1WA8.21.40.D07.1.454.CMB.2.raw
  modified_base (595)..(595): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggtcgttggtccgaggccggttggggggtccctggacgactctcctggtgcagcctcgtggtattcctacctttagtacgtctagttggagtgagcgtcgggtccgccgaggctaccgaggggaaggggcgtgggaggtggggtcggaccaaacgaagtaaacggacgaaagagtaggaaaggtgaagactatactaatagtggacttcgtaggtacgggaaacgggtcccgtaagtttacccaaacctacgttaccctacgaacggaaacaaacccgaaaccgaaccgaaggaacgtacctacctaacgttagtactacctagaaacaaagtacgaaacacgtcccgtaagacggacgacggaacggtacgaccggtnttagggttacttaaacgttcgtaggtcggaacgaacggtaccgtaccctttacccccggtaccggtaagtaaccgg

SEQ ID NO: 383958 - DNA, 655 bp, Homo sapiens
  misc_feature: GZ8MTXP02GNGTA.21.40.D07.1.454.CMB.2.raw
  modified_base (353)..(353): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctatttagaaggtgtccagtgtgaggtgcagcgtgggtggaggtcgtgggggaggcgttggtccaggccgtggggggtccctggacgactctccgtgtgcagcctcgtggtacttcctacctttagtagtctagttggatggagcgtcgggtccgccgaggccgtccggaaggggaggggctaggggnggtggggtacggaccaaacgaataaagccaaagagtaggaagtgaagacatactagtggtagtactcgtagggtagaacggggtcctacgttccaacctacgttccctaccgaagaaacgaaccgaaaccgaccgaaacggacgccttaccacgttgtatctaggaacctaaaatagaaaccacggccgtaggaaagtccggtacggaacgggaccgacgggtcgttaggtacgtttaacgttacgtggtaacgaccggtaaggtaaccgtacccgtttcccccggtacggttagtaacggg

SEQ ID NO: 383959 - DNA, 630 bp, Homo sapiens
  misc_feature: GZ8MTXP02GTAN6.21.40.D07.1.454.CMB.2.raw
  modified_base (267)..(267): a, c, t, g, unknown or other
  modified_base (305)..(305): a, c, t, g, unknown or other
  modified_base (352)..(352): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgcttattttagaggtgtccagtgtgaggtgcagctggtggagtcgtgggggagtcttggtccaggccgtgggggtccctgagctctcctgtgcagcctctggnttcactttagtagtctagttggatgagcgtcgggtccncgacggctccggaaggggaaggggcgtgggaggtggggcgaccaaanaagtaaacgccaaagagtaggaagtgaagacatactagtcggtagtaccttcgtagggtacgggaaacggggtcccgtaattacccgaacctagtaccctaccgaggaagaccccgaaaacgccgtaaaggacgttccacggtaacttgtacttacgtagaaactaaagtcgaaacacgtccaggtagacggtaccgaaggacctacgggtctaggttacttacgtagttcgaacggtacgacgaacgttacccgtacccccggttagttaacgacgg

SEQ ID NO: 383960 - DNA, 631 bp, Homo sapiens
  misc_feature: GZ8MTXP02GCHBE.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtgggggaggcgttggtccagccgtgggggtccctgagactctcctgtgcagcctctggattctacctttagtagtctagttggatgagcgtcgggtccgccgaggcctccggaggggaaggggcgtggggaggtggggtcggaccaaacgaagtaaagccaaagagtagggaaagtgaagactatactagtggtggtactcgtggtaggaaacggggcctaattccaacctatcctaccgagacgaacaacgaccaaagacgctacacgttagtactcgtagaacctaaaagtcgaaaactacgcccgtaaggaacgtacggtaacggacggtaccgaccgggtcgttacggttagttaacttacgttggaaggaccgaaaggtaccgtacccgtttacccccggtacggttagtaaccgg

SEQ ID NO: 383961 - DNA, 663 bp, Homo sapiens
  misc_feature: GZ8MTXP02IL7J2.21.40.D07.1.454.CMB.2.raw
  modified_base (287)..(287): a, c, t, g, unknown or other
  modified_base (352)..(352): a, c, t, g, unknown or other
  modified_base (609)..(609): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggagtcgttggtccaggccggtcgggggtccctgagtactctcctgtgcagcctctggattcctacctttagntctattggatgagcgtcgggtccgcgaggcctacgaggggaagggctgggaggtgggcgaccaanaagtaaagaccaaagagtagggaagtgaagactattactagtgtaggaccttcgtaggtagggaaacggtccgtattaccgaacctactcccgtaccgaaggtaccgaaaccaaccgacccgaaaaggaccgacctacgtaaccgttagtaacttccgtaacggaaactaaaacgtacggaaaccacggtacctagggaacgtaacgggtcggaaaacggaccgtaccggtagttcggttaagttacgtttaaccgnggtaacggaacgaacggtaccgtaacccttcccccggtaaggtttacaaccggg

SEQ ID NO: 383962 - DNA, 621 bp, Homo sapiens
  misc_feature: GZ8MTXP02GY8BX.21.40.D07.1.454.CMB.2.raw
  modified_base (387)..(387): a, c, t, g, unknown or other
  modified_base (538)..(538): a, c, t, g, unknown or other
  modified_base (553)..(553): a, c, t, g, unknown or other
  modified_base (559)..(559): a, c, t, g, unknown or other
  modified_base (578)..(578): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgcttattttagaaggtgtccagtgtgaggtgcagcgtggtggagtcgtgggggaggcgttggtccgagccggttcgggggtccctgagacctctcctgtgcagtcctctggtacttctaccgtttagtagtctattggatgagcgtggtccgcgaggcctcggaggggaacgggctgggacggtggggtcgaccgaaacaagtaaagacgaagagtaggaagngaagacagtactagtgtagtactcgtaggtaggaaacggggcctaattcccgaaactctcctaccgaagaacgaaccaaaccgccaaagtaccgcctacgacgttgtaatcgtaagaactaaacgtcgaaaccagtcctagaaccgggtanaccgggaggaacccncgggtnttaggtagtactttacggnggaacgacggtaacgtccgtacccttcccggtacgtagtacgg

SEQ ID NO: 383963 - DNA, 605 bp, Homo sapiens
  misc_feature: GZ8MTXP02JPSOL.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattcacctttagtagtctagttggatgagcgtgggtccgccgaggcctccggaggggaaggggcgtggggaggttggggtcggaccaaacaataaagaccaagataggaagtggaagactataacgtatggtagactcgtggtaggaaaggggccctattccgaaccgtatcctaccagaacgaacaaccgacaaagacgctacactgtactcgtagacaaagtcgaaacagaccgtagaaggacgtacggaacggaccgtacggacgttggttacgttagttacgtcggtggacggtaaacggacgtaccgtacccccgtttacggggtaattacggg

SEQ ID NO: 383964 - DNA, 839 bp, Homo sapiens
  misc_feature: GZ8MTXP02J0S8Z.21.40.D07.1.454.CMB.2.raw
  modified_base (785)..(785): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttggttttccttgttgcttattttagaaggtgtccagtgtgaggtgcagctggtggagtcggtgggggaggtcgtttcgggtccgacggtcccggttcgggggggttccctggtacgtaccgttccgttcccgttggtcgccgacggtccccttcgttacggtactttccgtaaccccttttaaggtacgtcttaagttgggaattggacggtccggttcggggtcccgacccgtacggccctacccgggaaagggggaacgggggtccgtaggggtagggttcgggggtccgggaaacccctaaaacggaaagttaaaaacggacccgaaaaggtaagttaaggggtaaaaggtcggaaacggtaactaagtttaaccgttaaaggttcgggttagggttaaccgttcgttagggtaacgggaaaccggggtcccgttaaactttcccgaaccctaagtccctaaaccgaaagaacccggaaacccgaaaccgggaccgaaaacggtccgtacttacctacgtttagtactaccgttaacgaaaccaaaagttacgaaaaccgcgtccgttaagggacgtaacgggtccggaaaacggtcgaaccggggttcttaggttacgtttacgttacggnggtaacggacggtaaacgtaccgttacccgttaccccggttacggtactaccgg

SEQ ID NO: 383965 - DNA, 700 bp, Homo sapiens
  misc_feature: GZ8MTXP02H3KUD.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcttgttgcttattttagaaggtgtccagtgtgaggtgcagctggtggagtcgtgggggaggcttggtccagccgtggggggtccctggagtactctccgtgtgcagcctcgtggacttctacctttagagtctaattggatgagctcgggtccgccaggcctaccgaaggggaacggggctaggggaggtggggtacggacctaaaacgaataaaacggaccgaaaaggagtaggaaaaggttgaacggaactattaaacgttaagtggttagggtaaccttcgtagtacggaaggggtacccgaattccaacccgaatcctaccgagaacgaaccaaaccgccgaaaagacgtacctacacgttatagtacccgttagaacctaaaagtacgtaaaacgacgaccgttagaaagggaacgttaccggaaagggtaaccgacggtaccgttacggttacgttaagtttaccggttaggtaacggtacccggaaaggtacgtaacccggtttccccccgttaaccgggggtttaaaacgtacgg

SEQ ID NO: 383966 - DNA, 628 bp, Homo sapiens
  misc_feature: GZ8MTXP02JA9A1.21.40.D07.1.454.CMB.2.raw
  modified_base (356)..(356): a, c, t, g, unknown or other
  modified_base (474)..(474): a, c, t, g, unknown or other
tcagtcgtcgctcgcacgaccggtgctcgatttagtgatagagcgtaacaacagaggggagagaggagccttagccctggactcccaaggcctttccacttgggtgatcagcactgagcacagaggactcaccatggaattggggctgagcttgggttttccttgttgcttattttagaaggtgtccagtgtgaggtgcagcgtggtggagtcgtgggggagtcttggtccaggccgtgggggtccctgagctctcctgtgcagcctctaggtacttcacctttagacgtctagttggagtgagtcgtggtccgcgaggcctccggaaggggagggctgggagtgggtagcccaanagtaagacaagagtaggaagtgaagacatatgtagtggtacctgtaggtacggaaacggggcctaattcccaaccgtactcgtacccgaagacgtaaccaaccgacctaaaggacccnctacacgttagtactacgtacgaaacaaagtaacgaacgacgtacgtacggaacggtaacggtacggacggaaccggacggtacgttacgttacgttacgttacgtacggtaacggacggaacggtacgtaccgtacccgtaccggtacgtacg

SEQ ID NO: 383967 - DNA, 639 bp, Homo sapiens
  misc_feature: GZ8MTXP02FEXKB.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggagtcttggtccaggccgtgggggtccctgacgactctcctgtcgcagcctcgtggacttcacctttagagctagttggatggagtcgtgggtccgccgaggcctccggaaggggacggggtctaggggaggtgggggtacgacccaaagtagtaaaaggccaaaggagtagggaagtgaacgactatacgtaagtggtacgacttgtagtaggaaacggggtcctaattacccaacctattcccgtacccaagggaacaaacccgacgacccgaaagttccgcctacacgttatacgtcctagaacctaaaagcgaaacgtcgaccgtagacggtaaacgcggaaaggaccgtacggtgtacggttataacttcgaggcgaacgaacggaccgtacccgttcccccggtaacggttagtacgg

SEQ ID NO: 383968 - DNA, 638 bp, Homo sapiens
  misc_feature: GZ8MTXP02GYXDR.21.40.D07.1.454.CMB.2.raw
  modified_base (343)..(343): a, c, t, g, unknown or other
  modified_base (435)..(435): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtgggggaggcttggtccagccgtggggggtccctgagactctcctgtgcagcctctggattcacctttagagctagttggatgagcgtgggtccgcaggctccgaggggagggctgggagtgggtggaccaanataaagcaaagatggaagtgagacatactatgtagactgtgtaggaaggccgtattccacatcctaccagacgaacaacgaccaaaggtacnctactacgttagtactacgaagaaactaaaagtacggaaaaccacggtacccgtaagggaaacggtaacgggtaaccgggaaaacgggaacccggtacgggttacgttacggttaacgttaacgtttacggtagggtaacggaaccggtaaacggtaaacccgttaccccgtttaccccccggttaacgggttaacgtaacgg

SEQ ID NO: 383969 - DNA, 581 bp, Homo sapiens
  misc_feature: GZ8MTXP02FWHKW.21.40.D07.1.454.CMB.2.raw
  modified_base (423)..(423): a, c, t, g, unknown or other
  modified_base (525)..(525): a, c, t, g, unknown or other
  modified_base (541)..(541): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggtcttggtccaggccgtggggggtccctgagactctcctgtgcagcctctggattcacctttagagctattggatgagcgtgggtccgcaggctccgaggggaaggggctgggagtggggtcgaccaaacaagtaaacgccaagataggaagtgagaactatattagtgtgactcgtggtaggaacggggtcctattcccaaccgnttccctacccgaaggaacaaaccaacgacccaaagggactcctacacgttgtactctagaaccaaatcgaaacagcctagagtacgtacgaggaccgcggtnttcggtagtaacttgngtaacggacgaagactaccgtcccccgtagggtaactcgg

SEQ ID NO: 383970 - DNA, 558 bp, Homo sapiens
  misc_feature: GZ8MTXP02FGE8R.21.40.D07.1.454.CMB.2.raw
  modified_base (261)..(261): a, c, t, g, unknown or other
  modified_base (268)..(268): a, c, t, g, unknown or other
  modified_base (349)..(349): a, c, t, g, unknown or other
  modified_base (361)..(361): a, c, t, g, unknown or other
  modified_base (462)..(462): a, c, t, g, unknown or other
  modified_base (475)..(475): a, c, t, g, unknown or other
  modified_base (504)..(504): a, c, t, g, unknown or other
tcagtcgtcgctcgcacgaccggtgctcgatttagtgatagagcgtaacaacagagggggagagaggagccttagccctggacttccaaggcctttccacttggtgatcagcactgagcacagaggactcaccagtggaattggggctgagctgggttttccttgttgctatttagaaggtgtccagtgtgaggtgcagctggtggagtcgtgggggaggcttgggtccagccgtggggggtccctgagactctcctgtgnagcctcngattcaccttagagctagttggatgagcgtcgggtccgccaggcctccgaagggggaggggctgggagtggggtgaccaanataaagcaaagngtaggagtgaagacatactagtgtggactgtgtgaaacggggcaattccactatcgtacccagagaaccacgaccaaagccgctacgacgtagtactcganacaaagtcgaacncgcgtagacgacgacggacgacgacggtnttacgtacttactcgtaggaacgacgaagaccgtaccctccccggaggtagacg

SEQ ID NO: 383971 - DNA, 618 bp, Homo sapiens
  misc_feature: GZ8MTXP02I6638.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagagtgtccagtgtgaggtgcagctgggtggagtcgtgggggaggcttggtccaggccgtggggggtccctggagactctcctgtgcagcctctggattcctacctttagtagctagttggatgagcgtgggtccgccgaggctccgaggggaggggcgtgggaggtgggtcggaccaacgaaagtaaagaccgaaaggagtagggaagtaggaagtaacagtactagtggtggtactgtaggtggaaacggggccgtacttccactactaccctccgaagaacgaaccaacgaccaagacgcctacacgttgtactctaagactaaaatcgaaacgacgtccgtaggaacggacggtacggaacggacggacggtcgtaggttacggttacttacggttggtcgtacggagaacgtacccgttcccccggtacggttaacgtacg

SEQ ID NO: 383972 - DNA, 683 bp, Homo sapiens
  misc_feature: GZ8MTXP02GVXB7.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagagtgtccagtgtgaggtgcagctggtggagtcgtgggggaggtcttggtccaggccgtggggggtccctgagactctcctgtgcagcctctggattccacctttagagtctagttggatgagcgttcgggtccgccgaggctccggaaggggaggggcgtgggaggtggggtcggacctaaacgaagtaaacggaccaaaggagtagggaacgtgaagaacagttactagtggtaggtacttcgtagggtacgggaaacggggccgttaacttaccaaccctagttacccgtaccgaaggaaccgaaaccgaaaacccggacccgaaaaggcggtacctaccgaaccgtttagtaacctttacgtacggaactaaaaacgtacgaaacgaacggtcccgtaaggacgtacgggtaacggaacggacggacgggttacgttacggttaagttaaccgttaggtagtaacggacgaacggtacgtacccgtaccccggtacggtaagtcgg

SEQ ID NO: 383973 - DNA, 663 bp, Homo sapiens
  misc_feature: GZ8MTXP02JZAOW.21.40.D07.1.454.CMB.2.raw
  modified_base (328)..(328): a, c, t, g, unknown or other
  modified_base (526)..(526): a, c, t, g, unknown or other
  modified_base (610)..(610): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagcttgggttttccttgttgcttattttagaaggtgtccagtgtgaggtgcagcgtggtggagtcggtgggggagtcgttggtccaggccggttcggggggtccctggacgaccttcctccgtgtgcacgcctcgtggtattccacctttagtagctagttggatgagtcgtgggtccgacgnggctccggaaggggagggcgtgggacggtgggcggacccaaagaagtaaagaccgaaagagtagggaaagtgaacgactagtaactagttggtaggtacttcgtaggtacgggaaacggggtcctaaattcccgaactactccgtacgaagacgaaccaacgaccgaaagcgtccacgtacttagtaactccggtaanaaacgtaaagtacgaaacgacgtaccgtaagggaagaccggtacggaacggaccgtacggtcgttaggttacgttacttacggnggtaacgaacggtaacgaccggttacccgttaccccggttacggtaacgtccg

SEQ ID NO: 383974 - DNA, 549 bp, Homo sapiens
  misc_feature: GZ8MTXP02IU6W9.21.40.D07.1.454.CMB.2.raw
  modified_base (424)..(424): a, c, t, g, unknown or other
  modified_base (436)..(436): a, c, t, g, unknown or other
  modified_base (451)..(451): a, c, t, g, unknown or other
  modified_base (498)..(498): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggtcgttggtccagccgtgggggtccctggagactctcctgtgcagcctctggattcacctttagtagcttattggatgagctgggtccgccaggcctccgaggggaaggggctgggagtggggtggaccaagaagtaaagccaaagatggaaagtgaagacatactatggtgactcgtggtagaagggcctatcacatctacaganacaacgcaaagngctacagtgtactcngaacaatacgaacacgctagagtagaccggaggacacggcttaggtntaacttcgtaggtgacgaagacgtaccgtacccccgttcgggtaactacgg

SEQ ID NO: 383975 - DNA, 659 bp, Homo sapiens
  misc_feature: GZ8MTXP02GY4JI.21.40.D07.1.454.CMB.2.raw
  modified_base (463)..(463): a, c, t, g, unknown or other
  modified_base (492)..(492): a, c, t, g, unknown or other
  modified_base (532)..(532): a, c, t, g, unknown or other
  modified_base (579)..(579): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagcgtggtgggagtcggtgggggaggtcgttggtcccgaggcccggttggggggtccctggacgtacctcctcctgtgcagcctcgtggtacttcctacctttagagtctagttggatgagcgtcgggtcccgccgaggcctaccggaaggggacggggcgtggggaggtggggtacgaccaaacgaaagtaaagaccaaagagtagggaagtgaagaactagtactagtggtagtactgtaggtaggaacgggcctatccaactntccacaggaacaccaaaccgcaaaggacncctacacgttgtaactccgtaagaaccaaaagtcgaaacncgtaccgtaggaacggtacggacgggaacggtaaccaccggggtttnttaggttaacgtttaacgttacgagggtaacggacggaacggtacccgttaccccgtttaccccggtaaggtaactacgg

SEQ ID NO: 383976 - DNA, 779 bp, Homo sapiens
  misc_feature: GZ8MTXP02HLCS0.21.40.D07.1.454.CMB.2.raw
  modified_base (291)..(291): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggaggtcggtgggggagtcgttggtccaggccggttcgggggtccctgagtacctctcctgtgcagcctcgtgattctacttagtnctagtggatggagtcgtcgggtccgccgaggccgtaccggaggggaacggggtcgtagggtagggtggggtacgacccaaagtaaacgtaaaggaccgaaagagtaagggaagtagaacgaactagtacttagtggtacggtacttcgtaggtacgggaacggggtcctactttaccaccctacgttcccgtaaccgaggaacgaaaccccgaaccgaaccgaacggaacgcccttaccaccgtttagtacttacccgtagtaaacccgtaaaagttcccggaaaacgtaccggtacccgtaagggtaaaccggaaaaccgggttacgggaaaacccggggtaacccggtaaacccggggtttcggtttaaagggtttaccggttttaaacgtttaaaccggttgggggttaaccggaccggggtaaaaccgtacccgggttaacccccgtttacccccccgggttaaggtttaaaaccggtccgggg

SEQ ID NO: 383977 - DNA, 614 bp, Homo sapiens
  misc_feature: GZ8MTXP02I5QO5.21.40.D07.1.454.CMB.2.raw
  modified_base (427)..(427): a, c, t, g, unknown or other
  modified_base (480)..(480): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcgttggtccaggccgtgggggtccctgagactctcctgtgcacgcctctggtattctacctttagtagctagttggatgagcgtcgggtccgcgaggcctaccggaggggaaggggcgtgggaggtggggtcggaccaagaataaacgaccgaaagagtaggaagtgagactatactagtgtagctcgtgtaggaacgggcctatcacntccacagacacacgacaagcgctcacttgtactcgtagaacaaagtcgaaacncgtaccgtagggaacgtacggtacgggacggtaaaccgcgggttacgttacggtttagttaaacctttcggtgggtaacggtaacggtaacggtacgttaccccgttacccccggttaacggtaagtaacccgg

SEQ ID NO: 383978 - DNA, 774 bp, Homo sapiens
  misc_feature: GZ8MTXP02IT9PH.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctatttagaaggtgtccagtgtgaggtgcagctggtggagtcgtgggggaggcgttggtccaggccggtgggggtccctggagactctccgtgtcgcacgcctcgtggtacttccaaccgttttagacgtctagttggacttggagtcgtcggggtccccgcgacggtccgtaccggaagggggaaacggggtcgtaggggacgggttcggggtacggaaccccaaaacgtaaaagtaaaaaaggaaacggtaagtaagggtaaaggtaaggtaacgaaacgtaacttacgttaagtaggttacgggtaccgtcgttacgggtaggggtaaacggggtacccggtaacttacccggtaccctaacgtcccgttaacccgaaggtaaaccgaaaccgaaaaccgaaacccgaaaggaacgtaccctaaaccgtacttacggttaataccgtacggtaaacaaaacgtacggaaacgtaaccgtacgtaccggtaagaacgggtacggaaacggggaccacgggttacggttaggtaccgtttagtaccgttaggaggaacggtacgtaaacgtccccgttacccgttacggtaacgtacggttaaccggg

SEQ ID NO: 383979 - DNA, 654 bp, Homo sapiens
  misc_feature: GZ8MTXP02JN267.21.40.D07.1.454.CMB.2.raw
  modified_base (330)..(330): a, c, t, g, unknown or other
  modified_base (383)..(383): a, c, t, g, unknown or other
  modified_base (391)..(391): a, c, t, g, unknown or other
  modified_base (516)..(516): a, c, t, g, unknown or other
  modified_base (577)..(577): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgcttattttagaaggtgtccagtgtggaggtgcagcgtggtgggagtcggtgggggagtcgtttcggccgaggtccggtcggggggtccctggacgacctccgtcctgtgcaggccctgtaggattcctactttaggagtctagttaggatgagtcgtcgggtccncgaggcctccggaggggtaacgggctgggaggtggggacggaccaatagtaanccgaaagngtaggaaagtgacgactgtactagtggtcgtaactcgtaggacggtaaacgggcttacgtacccaccgattcccgacaagtacgaaaccacgcgtaagactctaacggtactgattcgaacgtanaaaacggttcgaacctaggtcctaagggaccggtagttacggaacggacgacccgggtttnttaacgggtacgtttaaacgttggacggtaacggacgtaaccgttaccgtaccccgttcccggtttaagacgtccgg

SEQ ID NO: 383980 - DNA, 689 bp, Homo sapiens
  misc_feature: GZ8MTXP02FIHB3.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtgggggaggtcgttggtccgacggccgtggggggtccctggacgacttcctcctgtgcacgcctctggtacttcctacctttagagtcttattggatggagcgtgggtcccgccgaggcctccggaggggacggggcgtggggaggtggggtcggacccaaagaagtaaaacggccaaagggagtaggggaaacgtgaacgaactagttaactagttcggtagtaccttcgtagggtagggaaacgggggtccctaattacccacctagttccctaccgaaggaacgaaacccgaacccgaaccaaaggaccgtacctacaacgttagtacttccgtacgaactaaaactcgaaaacgtaccgaccgtaaggaggtaacggggtacggaacgggaccgaaacgggtcttaggttactttaacgttacgtgggtcgaaccggagtaccggtacccgttcccccggttaaggtacgaacgg

SEQ ID NO: 383981 - DNA, 617 bp, Homo sapiens
  misc_feature: GZ8MTXP02GYAFS.21.40.D07.1.454.CMB.2.raw
  modified_base (371)..(371): a, c, t, g, unknown or other
  modified_base (403)..(403): a, c, t, g, unknown or other
  modified_base (408)..(408): a, c, t, g, unknown or other
  modified_base (559)..(559): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttattttagaggtgtccagtgtgaggtgcagcgtggtggagtcgtgggggagtcgttggtccgaggccgtggggggtccctggacgtcctctcctgtcgcacggcctcgtggattctacctttagtactcttatggatggacgcgtgggtccgcgaggcgtaccggaggggaagggtcgtagggtaggtggggtcgacccaaanaagtaaacgaccgaaagagtaggaaagtgganaacgnttaactagtggtgaactgtaggtgggaaacggtcgtaactacaaccgatcctacaacggaacgaccgaaacgaccctaaaggaactcctaacgattacggtacttaggacaacgtaaatggaacaacggtcaggagacgtcggacgtaacncggtatggttagttactagttgaacgagaacgtactaccgtacccgtagtaagtccgg

SEQ ID NO: 383982 - DNA, 601 bp, Homo sapiens
  misc_feature: GZ8MTXP02G3JJY.21.40.D07.1.454.CMB.2.raw
  modified_base (344)..(344): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctctgtgcagcctctggattctactttagagtctattggatgagcgtggtccgcgaggctccgaggggaggggcgtgggaggtgggtcggaccaaanagtaaaagccgaaagagtagggaagtgaacgacagtactagtggtagacctgtgtagggaaacgggtccagttacaccgtatccgacgagacgaacaaccgaccaaagacgcctacacgttagtatccgtagaaccaaaagtcgaaacacggtaccgtaggagacggtaaccggacggaaccgtacgggtcttaggtacgttaaacgttcgtggtaacggacgtaaggaccgtaccgtcccccgtaggtacgtacgg

SEQ ID NO: 383983 - DNA, 668 bp, Homo sapiens
  misc_feature: GZ8MTXP02I3P8F.21.40.D07.1.454.CMB.2.raw
  modified_base (568)..(568): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagtcgttggtccagcccgtgggggtccctgagacctctcctgtcgcagcctctggattcacctttagtagcttagttggatggagcgtcggggtccgccgaggcctcccggaaggggaacggggtcgtaggggtaggtggggtacggaccaaacgaagtaaaagcccgaaagagtagggaaagtcgaacgactatactagtcgtaggaccttggtaggtagggaaacggggtcccttaaagttcccaaccgtacttacccgacccgaaggaaacgaacccgaaaccgacccgtaaaagcccgtactaaccaccgtttagtaccttacgtacgaaacctaaagtcggaaaaccncgtcgtaggaagtacggacggacggaccgtacggtcgttagtacgttaaccgttggagtcggacgaacgtacccgtacccgttccccggtaggtacgtcg

SEQ ID NO: 383984 - DNA, 770 bp, Homo sapiens
  misc_feature: GZ8MTXP02I0V9P.21.40.D07.1.454.CMB.2.raw
  modified_base (704)..(704): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcttgggttttccttgttgcttatttagaaggtgtccagtgtgaggtgcagcgtggtggagtcggtgggggaggtcgttggtccacggtccggttcggggggtccctggacgtacctcctccgtgtcgccacggccctcgtaggtacttcctaacctttagtagtctatttgggattggagtcgtcggggtcccgcgtacggccgtaccggaggggaggggcgtggggtaggtggggtcggaccaaacaagtaaaacgccgaaagagtacgggaaaggttagaaggtaactattaacgttagtcgggttacggaccgttacgttgggtaggggtaaaccgggggcccttaaacgtttacccaacccgtacttacccgtaacccgtaacggaacggaaacccgaaacccgaccgaaaaggtaccgtaccttcaaaccgtttgtacgttacctagaaaaccgtaaatacgaaacgtacgacccgttaagaaacggtacggttaacggacgggaaacccgttcgggtaaccgtttggttaaccgtaaagtttttaccggngggttaaggcccggaaaaggtaccggtaaccccgtttacccccggttcggggtttaaaatccgggg

SEQ ID NO: 383985 - DNA, 641 bp, Homo sapiens
  misc_feature: GZ8MTXP02I1ZLU.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtgggggaggcttggtccagccgtggggggtccctgagactctcctgtgcagcctctggattcacctttagagctattgatgagctgggtccgccaggctaccgaggggaaggggctgggagtggggtgaccaacaagtaaacgccaaagagtaggaaagtgaagacagtactagtaggtacgacctgtaggtaggaaacgggggccaatttaccaaccctaatccctacccgaaaggacgaaacaaacccggaccaaaagtacggccttacgaacctgtaactcgtagaaccaaaatgaaaccgagtccctagaaagacgttacggaaaggaaccaccggggttactacggttacggtaaaactttcgtagggtaacggaaccggacggtaaaaccggtacctttacccccccaccggggttaaaactacg

SEQ ID NO: 383986 - DNA, 674 bp, Homo sapiens
  misc_feature: GZ8MTXP02FKVDI.21.40.D07.1.454.CMB.2.raw
  modified_base (311)..(311): a, c, t, g, unknown or other
  modified_base (385)..(385): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccaggcccgtggggggtccctgacgactctcctgtcgcagcctctggtattcaccttagtacgctattggatggacgcgtggggtccnccgaggcctaccgaggggaaggggctgggacgtggggtcgaccaacataaagccaagagtaggaagtgagactntaactagtggtcgggtactcgttggtacggaaacggggcccgtaagtttacccaaccctattcccgtacccaaagggaactaaacccgaaacccggacccaaacgtacgaccttaccaacttcggtactaccgttggaacctaaaacggtacgaaaccacggtacccgtagggaaacgtaacggttacggaaacggggtaacaccgggtcctaggtttacggttaactttacgttagggtcggacggacggtaacgtacccgtttacccccgtacggggttataccggg

SEQ ID NO: 383987 - DNA, 619 bp, Homo sapiens
  misc_feature: GZ8MTXP02H1CRS.21.40.D07.1.454.CMB.2.raw
  modified_base (393)..(393): a, c, t, g, unknown or other
  modified_base (472)..(472): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtccctgagactctcctgtgcagcctctggattcacctttagagctattggatgagctgggtccgcaggcctccgaggggaaggggctgggagtggggtgccaaacataaagccaaagatggaaagtgaagacataactaagtcggtaggacttcgngtacgggaaacggggccctaattccaaccatcccgtaccaaggacaaccgaaaccgaccaaaagcggtccactacgttntaactcgtacgaaaactaaaataacgaaacgacgtacgtagaagtaacggtacggaacggaaccggacggtacggttacggttacgttacgttacgtacggtaaggacggaacggacgtaccgtaccccggttaccggtaacgtacg

SEQ ID NO: 383988 - DNA, 815 bp, Homo sapiens
  misc_feature: GZ8MTXP02H64WW.21.40.D07.1.454.CMB.2.raw
  modified_base (250)..(250): a, c, t, g, unknown or other
  modified_base (270)..(270): a, c, t, g, unknown or other
  modified_base (282)..(282): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgttgggttttccttgttgtcttatttagaaggtgtccagtggtgaggtgcagcgtggtggagtcggtgggggagcttggtccgagtccggtcgggggtccngacgtctcctccgtgtgacncgtcctctggtnttctaccgtttagtagtctagtggtatggacggtcggttcgggtcccgcgacggccgtaccggaggggaacggggtcgtaggggaggttggggtacggaccaaacgtaaagtaaaaggacccgaaaggtaacgtaggggtaaaggtacggaggtaactaacgttacgtttaagttacgggtacgggtaacccgtttggtacgggttaacgggaaaccgggggttcccgtaacggtttacccaaacccttaaccttacccgttaaaccgaaacgggaaccgaaaaccccgtaaacccgaaacccggaaaacggtaccggtaacccttaaccgtaaccgtttaacgttaaccgttacgttaaccgaaacgtaaaaacgtaacgaaaccgtaacggtacccggtaagacgggtaacgggttaacggaacggggaaaccggtacggttacggtacgtttagttacgttttacgtacgggttaaggacggtaacggaccggttaacccgtcccccggttacggttaacgtaaaccggg

SEQ ID NO: 383989 - DNA, 625 bp, Homo sapiens
  misc_feature: GZ8MTXP02H1VJG.21.40.D07.1.454.CMB.2.raw
  modified_base (580)..(580): a, c, t, g, unknown or other
  modified_base (623)..(623): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggtattctacctttagagctagttggatgagcgtgggtcccgccgaggcctaccggaggggaaggggcgtagggaggttggggtacggaccaaacgaagtaaaacggccaaagagtagggaaagtggagactagtactaagtggtacgtacttcgtggtagggaacggaacctattacccgaacctatcccgtaccaaggacgaaccgaaacgccaaagacgcttacaacttgtaatccgtagacaaagtacgaacacgacctaggaagacggtaccggaagggtacccgacggtcttaggtacgttattaccgnggtcgacgaacgtcggtaccctcccccggttacgggttaaacncg

SEQ ID NO: 383990 - DNA, 659 bp, Homo sapiens
  misc_feature: GZ8MTXP02H8ANT.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttctgttgctattttagaaggtgtccagtgtgaggtgcagcgtgggtggagtcggtgggggaggtcgttggtccaggccggtgggggtccctgagtctctcctgtgcagcctgtggtattctacctttagtagtctagttggatgagcgtcgggtccgccgaggcctccggaggggaacggggtctgggaggtggggtcgaccaacgaataaacgccaaagtagtacggaaagtgaaggtacacgttaactaagtggtagacgttcgtagggtaggaaacggggtcgattaccaccgtatcccgtacgaacgaacgaaccgaaacgcccgaaagacgtcctacaacgttgtactcgtacgaactaaaagtcgaacgaacgccgtaagaaggtacggtacggacggtaaccgacggtacgtaggtttacgaacgttttaccgaggttaacggacggtaaacggaccgttaccccgttacccccggtaagggtttaactaaccggg

SEQ ID NO: 383991 - DNA, 811 bp, Homo sapiens
  misc_feature: GZ8MTXP02HHA8G.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgcttattttagaggtgtccagtgtgaggtgcagcgtgggtggagtcgtgggggagtcgttcggtccgaggtccggttcgggggtccctggacgtacctctccgtgtcgcacgtcctagtggtaacttcctaacgtttagtagtcttaagttggatacgaggtccgttacggggtccgacccgaggccctaccggagggggtaacggggtcttagggggtacgggttggggtaccggaaaccctaaaacgtaaagtaaacggacccgaaaggtacgtaggggaatagggaacacgtagttacgttagtggtacgtaccgttgtagggtacgggaaaccgttcctaacttcgaaccgtacttacccgaccgacgggtaaccaaccaaaccggacccgaaaaggtccgccctttaaacgaccgttttagtaaccgtaccgtaacggaaaccttaaaagtaccgggaaacccttaggttacccggtaagggaaaacgggtacgggttaaacccggaaagggggtaaccccgtcggggtttaaactttcggggtaaattttaaaacccggttcggtttaggggtaaccgacgggtaaaccggtacccgttaaccccctttcccccgggggtaaaacggtttacctaccgggg

SEQ ID NO: 383992 - DNA, 548 bp, Homo sapiens
  misc_feature: GZ8MTXP02FLR2A.21.40.D07.1.454.CMB.2.raw
  modified_base (261)..(261): a, c, t, g, unknown or other
  modified_base (292)..(292): a, c, t, g, unknown or other
  modified_base (327)..(327): a, c, t, g, unknown or other
  modified_base (357)..(357): a, c, t, g, unknown or other
  modified_base (461)..(461): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtcctgagactctcctgtgcagcctnggattcacttagagctatgatgagctggccncaggctacgagggaggctggagtgggtcgaccaanaagtaaagaccaagataggaagtgaagacntacagttgagtactgtggtagaaacgggtctaattcgaacctatcccacgaagacaacaacgacaagtagctacgacgtgtatctaagaaccaaagtcaaaacncggtcctaaggaagacggtcggaaacgtacgacggtcgtagtacgtacttagtgaagacgagacgcccttaccggtacgtataccgg

SEQ ID NO: 383993 - DNA, 593 bp, Homo sapiens
  misc_feature: GZ8MTXP02FHO7F.21.40.D07.1.454.CMB.2.raw
  modified_base (188)..(188): a, c, t, g, unknown or other
  modified_base (306)..(306): a, c, t, g, unknown or other
  modified_base (362)..(362): a, c, t, g, unknown or other
  modified_base (373)..(373): a, c, t, g, unknown or other
  modified_base (377)..(377): a, c, t, g, unknown or other
  modified_base (500)..(500): a, c, t, g, unknown or other
  modified_base (559)..(559): a, c, t, g, unknown or other
tcagtcgtcgctcgcacgaccggtgctcgatttagtgatagagcgtaacaacagagggggagagaggagccttagccctggactccaaggcctttccacttggtgatcagcactgagcacagaggactcaccatggaattggggctgagctgggttttccttgttgctattttagaaggtgtccagtntgaggtgcagctggtggagtcgtgggggagcttggtccagccgtggggggtccctgagactctccgtgtgcacgcctctggattcaccttagtagctattggatgagtcgtgggtccnccgaggctccgagggaggggctgggagtggggtcggaccaacataaacgctaaagntaggaagtganacgntactaagtgttgactcgtagtggaaagggtcccgaatttcccaacctgttcccaccagaacggaacctaacgacccaaagacgcctacaaccttgtaactctagaccaaaagtacaaaaccgngtaccgtagacgaacggtacggaacggaccgtacggtcgtcgttaacgttactacgtgngacgacgacgtaccgtacccgtaccgtacgtacg

SEQ ID NO: 383994 - DNA, 861 bp, Homo sapiens
  misc_feature: GZ8MTXP02HED97.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagagtgtccagtgtgaggtgcagctggtggagtcggtgggggagtcttgggtccaggtccggtcgggggtccctggacgactctccgtgtcgcagcctcgtaggtacttcctaccgtttagtagtactagttaggatggagtccgtcggggtccccgccgacggcccgtaccgggaaggggtaacggggtcgtaggggtacggggtggggtaccggaccaaaacgtaaacgtaaaacggacccgtaaaagtaggttaggggaaaaggttacggaaacggaaccctaacgttaacgtttaaaggtcgggttaccgggtaaccgtttacggttagggtaaaccgggggtaaaccggtcccggttaactttaaacccggaccccttaaaccgttccccgttaaacccgaaacggggtaaaaccgtaaacccgaaaccccgggtaaacccgaaaagggttccgtaccccttaaaccgtacgtttacggttaaccctcgttaaccgaaacgtaaacgttacggaaaaaccgtttccggaccgtaaggggtacggaaaccgttacggggaaagtaaacccggttacgggggactttagggttaacgtttaacggtttacccgtaggtaaccggggtaacggtaaacgttaaccggaacccccgttttacccgggtaaccgttaaaggttacccgg

SEQ ID NO: 383995 - DNA, 810 bp, Homo sapiens
  misc_feature: GZ8MTXP02IFHL7.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaatgggctgagctggttttcttgttgctattttagaaggtgtccagtgtgaggtgcagcgtggtgggagtcggtgggggaggtcgttggtcccgaggtccggttacggggggttcccctaggacgtaccgttccgttcccgttggtacgccgtaacggcccttcgttcggtactttcctaaccgttttagtacgtccttagtttggattggtacgtccgttcgggtccgccgaggccgtaccggaagggggtaacgggggcgttaggggacggttgggggtcggaacccaaaacgtaaagtaaaaacgccgaaaagggtagtaggggtaaaacgggttcggaaaacggaaccgttaagtttaaccgttaaggttacggggtttaacggggtaacccgtttaccggtttaggggttaaggggaaaacccggggggttcccaaacgttttaccccgaaacccttaaacgttcccgtaaccccgtaaagggtaaaccgaaacccgaaaaccccggaccgtaaaacggaccggtacctttacccgaaccgtttagtacttacgtacgaacgtaaaatcgaacgtaacgccgtaagaacgtaggtacggaggaaccgtcggtctagtacgttactttagtgtaacgacgagtaccgtaccgttccccgtaggtactacgg

SEQ ID NO: 383996 - DNA, 806 bp, Homo sapiens
  misc_feature: GZ8MTXP02GD6L1.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgcttatttagaaggtgtccagtgtgaggtgcagcgtggtggagtcggtgggggaggtcgttggtccgaggtcccggttcggggggtcccctggacgtaccttccttccgtggtcgcacgtccctcgtggtacttcctaccgtttagtacgtcttagttggatggagtcgtcgggtccgccgacggtccgtaccggaagggggaacggggtcgtaggggtacgggttcggggtaccggaaccgaaaacgtaaagtaaaacggaccgtaaaaggtagtaaggggaaaggttacggaaacgtaaactagttaaaccgttaggttagggtacggtaccttcggttaggggtaacgggaaaacgggggtcccttaaacttacccgaaacccgtaatttccccgaaccgaaacggaaaccgaaaacccgaaaaccccgggacccaaaaagggtaccgtccttaaacccgaacgtttagtaaccttccgtaacgaaaccgtaaaacgtaccggaaacctacggtacccgtaagggaaaccggtacggggtaacggacgggtacccgtaacgggtcgttaggtttacgttaacgttacgtggtaaccggacgaacggtaccgtacccttaccccggtacggtagtaccgg

SEQ ID NO: 383997 - DNA, 621 bp, Homo sapiens
  misc_feature: GZ8MTXP02HKR34.21.40.D07.1.454.CMB.2.raw
  modified_base (317)..(317): a, c, t, g, unknown or other
  modified_base (375)..(375): a, c, t, g, unknown or other
  modified_base (432)..(432): a, c, t, g, unknown or other
  modified_base (458)..(458): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcctgttgcttattttagaaggtgtccagtgtgaggtgcagctgggtggagtcgtggggggagtcgttggtccaggcccgttggggggtccctggagacctctcctgtgcagcctcgtggacttcactttagagcttagttggatggagtcgtcgggcccnccgaggccgtaccggagggggtaaggggcgtgggaggttggggtacgaacccctaaanagttaaaagcccgaaaggtataggggaacgtgaagactagtactagtggtgacttgngtaggaacggctagttaccaccgtancccgtacgagacgaaccgaacgacgaagtagcctacacgttgtactactagactaaagtgaaactcgcgtaggaagacggtacggaacgtacgacggtctggttaagtacgttcgttaggcgaggaacgtaccgtaccgttcccccggtaaggttacacccgg

SEQ ID NO: 383998 - DNA, 723 bp, Homo sapiens
  misc_feature: GZ8MTXP02JUNEZ.21.40.D07.1.454.CMB.2.raw
  modified_base (180)..(180): a, c, t, g, unknown or other
  modified_base (317)..(317): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtntccagtgtgagtgcagctggtggagtcgtgggggagctagtggtccagtccgtgggggtccctgagtacttctcctgtgcgagccctgtaggcttacgtaccttagagtccttagtggatgacgtcgtacgggtccncgaggacctccggaaggggtaacgggtcgtgggtaagggtgggtccgacccgaaataacgtaaacgacgaaagacgtagggaagtcggaatacctaatagtactagtgtaaccgtgtacggtagtaaccggggacgtacgttaccgactaacgttcgtacccgaaaggtaacgaaccgaaacccgaacgttaaacggactaccgtactaacccggtagtttaacccaggttactaacccgtaaaagtaccgggtaaactaacgtacccgtaggtaaaacgtaccgggtaaacgaccgggaaaccgtttcgggtaaccctttacgggttacggttaacttttaaaccggggtaacgtacggtaacggtacggtaaccgtaccccgtttaaccccggttacggtaacg

SEQ ID NO: 383999 - DNA, 650 bp, Homo sapiens
  misc_feature: GZ8MTXP02IWYA2.21.40.D07.1.454.CMB.2.raw
  modified_base (373)..(373): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattgggctgagctgggttttccttgttgctattttagaaggtgtccagtgtgaggtgcagctggtggagtcgtgggggaggcgttggtccaggccggtcggggggtcccctggacgtaccttcctcctgtcgcgacgccctcgttggattctaccgtttagtagctagttgatgacgcgtcgggccgcgaggccctacggaggggaaggggcgtagggaggtggggacggaccaaanaagtaaacgacgaaagagtaggaagtgaagacagttacgtatcggtacgtactcgtagggagggtaacgggcgtacgttaccactacgttaccgtacgagaaaccgaccgaaaccgaccgaaagtaccgaccttaacaacgttagttaccttcggaataaccgaaattacggaaacacgtaccgagaggtacgtacggacggacgtcggtcgtagttcgttaacgttcgtaggtcgacggtacgtacggtaccctcccccggtaaggtacgtaacgg

SEQ ID NO: 384000 - DNA, 552 bp, Homo sapiens
  misc_feature: GZ8MTXP02GJAAA.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcaacactgagcacagaggactcaccatggaattagggctgagctgggtttccttgttgctatttagaaggtgtccagtgtgaggtgcagctggtggagtcgtgggggaggcttggtccgagcctgggggggtccctgacgactctcctgtgcagcctctggattcacctttagtagctattggatgagctggggtccgccgaggctccgaggggaaggggctgggagtgggtgcaaacataaaagcaagatggaatggagacatacatggtgactctgtggaaacggcgattcaccatctccagacgacaacgccaaagagcacacgtgtaacgtctacggacaaagtagaacgagtccgtgaagagtacggaaggacgacgggacttggacgttaattaccgtgttaggcgtaaggagccctacccgtaccggtataacggtacg

SEQ ID NO: 384001 - DNA, 863 bp, Homo sapiens
  misc_feature: GZ8MTXP02F6FOP.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcaacagaggactcaccatggaattggggctgagcttgggttttccttgttgcttattttagaaggtgtccagtgtgaggtgcagcgtggtggagtcggtgggggaggtcgttgggtaccgacggtccggtcggggggtccctggacgtacctcctccgtgtgcacgtccctgtggtacttcctacctttaggacgtcttagttggatggacgtcggttcgggtccgccggacggccgtaccgggaagggggtaacgggggtcgtggggtagggttgggggtaccggaacccaaaagtaaagtaaaacgaccgaaaggtagtaaggggaaggtaggaaacgtaactacgttaacgtagttaggggttaccgtaccttacgggttacggggtaacggggttaaaccggggacccgttaacgttaccccgaacccttaacggttaccccgtaaacccgaaacgggaaaccggtaaaacccccgaaaaccgggaaacccccggaaaaggtaccggtacccttaaaccgtaaccggttacgtttaacgttaccgtaacggaaaacccttaaaaaagcccggaaaaaccgtacggtaccccggtaaggtaaacgggtacgggtaacgggaaggaacccggtaccgggttagtttaacgggttagtttaaaccggttccgttaggggtaacggttaaccggggaaacgacccggttaacccgtttacccccggtagggtttaacgtaaccgggg

SEQ ID NO: 384002 - DNA, 839 bp, Homo sapiens
  misc_feature: GZ8MTXP02GC6UT.21.40.D07.1.454.CMB.2.raw
  modified_base (178)..(178): a, c, t, g, unknown or other
  modified_base (203)..(203): a, c, t, g, unknown or other
  modified_base (828)..(828): a, c, t, g, unknown or other
tcagtcgtcgctcgcacgaccggtgctcgatttagtgatagagcgtaacaacagaggggagagaggagccttagcctggactccaaggcctttccacttggtgatcagcactgagcacagaggactcaccatggaattggggctgagcttgggttttccttgttgcttatttagagtntcagtgtgaggtgcagcgtggtggnggtcggtgggggaggtcgttcggtccgaggtccggttcggggggtccctaggacgtaccttccgttcctggtcgaccacggtcccgttacgttcggtaacttttaccgtaacccgttttaaggtacggttacctttaagtttggggaaagttcggacggttccggttcggggttaccccggccgtaacgggtccgtacccgggaaggggtaacgggggtcgttacggggtacggtggggtacgaaccgaaagtaaacgtaaaggaccaaaggtacggtaagggaacggttagaacgtaactattaaccgtgttacgggttacgtacgttacggttggggtaaacgggtaaacccgggggtaccttaaacggtacccgtaaaccctacggtttacccgtaacccgaaacggggtaaaacaaccccggtaaaaccccggacgaaaacgggtttaccaaacccgttaccgggtttaaaaccctttggggttaacttaaccgttaacggaaaccgttaaaaggaaccgtaaacgaaccgttaccgttaggggaacgtaggtaaaacggcgaaacgtcggtaacgtggttactaacggtagtcgtaaggacgacgaacgtccgtaacccnggttaactcgg

SEQ ID NO: 384003 - DNA, 675 bp, Homo sapiens
  misc_feature: GZ8MTXP02HBSMM.21.40.D07.1.454.CMB.2.raw
  modified_base (620)..(620): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagcgttgggttttccttgttgcttattttagaaggtgtccagtgtgaggtgcagctggtggagtcggtgggggagtcttggtaccaggtccggtgggggtccctaggacgtacctctcctgtcgcacgctcgtaggtacttcctacctttagtacgtcttaattggataggacgtcgtcgggtcccgcgacggtcctaccgggaggggaacggggtcgtaggggtacggtcggggtacggaaccaaaacgaagtaaaacggaccgaaagtagtaggggtaaatggaaagacctagttacgtagtggttacggacgtttcgaggttacggggaaacgggtccgtaacgttacccacgtaacctcccgtacccgaaggaaccgaaccgaacgacccgaaagactacccgtacaagttgtaactacgtacgactaaagacaacgacgactagagtacggtacggacgtacgacggtnttagtgttaaacgtcgttaaggcgacgaggtacctacgtccccggtagtacacgg

SEQ ID NO: 384004 - DNA, 715 bp, Homo sapiens
  misc_feature: GZ8MTXP02IH7I5.21.40.D07.1.454.CMB.2.raw
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttcctgttgctattttagaaggtgtccagtgtgaggtgcagcgtgggtggagtcgtgggggagcgttggccagccggtggggtccctgacgtctctcctgtgcacgtcctgtggtacttctaacctttagtagtcttagttggatcggacgtcggtcgggtcccgaccgacggccgtaccggaggggaacggggtcgtaggggaggtcggggtacggaacccaaagaaagtaaacgccaaaaggtagtaggaagtgaacgactatacttagtcggtaggtaccttcgtagggtaagggaaccgggtcgtaacgttacccgaacctactacccgtaaccgaacggaaacgaaaccgaaaccgaccgaacgtaaccgaccgttacctaacggttattaccgtacgtacgtaaactaaaacgtacgaaacgtaccgtacgtaacggaacggtacggtaccggtaaacggaccgaacggttaccgttaggttagttaaacgtttcgtacggtaacggtaccgtaacggtaccgtacccgttacccccgttaggtaacgtaacgg

SEQ ID NO: 384005 - DNA, 709 bp, Homo sapiens
  misc_feature: GZ8MTXP02HOJZO.21.40.D07.1.454.CMB.2.raw
  modified_base (295)..(295): a, c, t, g, unknown or other
  modified_base (335)..(335): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggaggcttgggtccaggccgtggggggtccctgagactctcctgtgcagcctcgtgatctacctttagtacgtctattggntgagcgtgggtccgcgaggctcgaggggacgggtgtgggnggtggggtcgaccaaacgaagtaaacgaccaaagagtacgggaaggttgaacggactacgttaaactagtcgggtaggtaacctttcggtaaggttcggggaaaacgggggtccctaaactttccccgaaacccgtaagttcccgttaaccggaaagaaccggaaaacccgaaaccgggaacccctaaaagggcgtaccccgttacacccgggttttagtaaccttccggttacgaaacccgtaaaagttacggaaaaccttccggaaccttggggaaacgtaccggtacggggaaacggacgtaccccggtaagtttcggtaaggttaccttacgtggaagtacgagtacgtacctccccgtaacggttagcg

SEQ ID NO: 384006 - DNA, 586 bp, Homo sapiens
  misc_feature: GZ8MTXP02H564R.21.40.D07.1.454.CMB.2.raw
  modified_base (261)..(261): a, c, t, g, unknown or other
  modified_base (269)..(269): a, c, t, g, unknown or other
  modified_base (301)..(301): a, c, t, g, unknown or other
  modified_base (321)..(321): a, c, t, g, unknown or other
  modified_base (327)..(327): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcaggctgggtggagtcgtgggggaggcttggtcccagccgtgggggtccctgagactctcctgtgcngctctggnttcactttagatctatggatgagctgggtccnccaggctccgaggggagggntagggnggtgggcgaccaagaataagccaagagtgaagtgagacatatgtagtgactcgtggtacgaggcgtaattccacatcctacgagaccgactaaccggctaaacgagtcctacgacgttagtactcgttacgaacgttaaagacgaaaacgtcgtaccgagggaaacggttaagtcggaaacgggccacgggtattacggttgttaaccgtttgtggtccgaggtaaccggtacgtacgttcccccgtggggtaaactcg

SEQ ID NO: 384007 - DNA, 610 bp, Homo sapiens
  misc_feature: GZ8MTXP02JOXK1.21.40.D07.1.454.CMB.2.raw
  modified_base (459)..(459): a, c, t, g, unknown or other
  modified_base (487)..(487): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctatttagaggtgtccagtgtgaggtgcagctggtggagtcgtgggggagcgttggtccgagccgtgggggtccctgagactctcctgtgcagcctctggacttctaccgtttagtagcttagtggatgagcgtgggtccgcccgaggtcgtccggtaggggaaggggctgggacggtggggtacggccgaaactagtaaaggaccaaggaatgggaagtacgaggaacatacgtatggtacggatcgtaggtgaaagggcctaacttcaccatccctacagacaaccgtaacnccaaagacgcgtcacgtagtactcgtanaccgtaatagaacgacgtcccagggtaagtacgacggtaggaacgtcgggaccgttagttcggtatttttaacggcggttaaggaccaggtaccggtaacttccccgtccgggtaacttacgg

SEQ ID NO: 384008 - DNA, 680 bp, Homo sapiens
  misc_feature: GZ8MTXP02IKQPL.21.40.D07.1.454.CMB.2.raw
  modified_base (210)..(210): a, c, t, g, unknown or other
  modified_base (310)..(310): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagtctgggttttccttgttgctattttagaagtgtccagtgtgaggtgcagctggtggagtcgngggggaggcttggtccagtccgtggggggtcccctgagtacctctcctgtcgcgagcctcgtgattcacctttagtagctattggatgagcgtgggtccnccgaggcctccggaggggaaggggctaggggtagtggggtcggaccctaaacaaacgtaaaacgccgtaaaaggagtacgggaaagtggaaacgaactatacgtatggtacgacctcgtagtacgggaaacgggtccgaaatttcacccgtaagttccccgtacgaaacggaacgaacccgaaaacccggacccaaggggaaactccccttacgaacgttcgtattaccgtacgaacctaaaatcggaaacctaaggccctaggaaaagtcgtacgtaaacggaccgaacggtttccaaggttcgtaaaacgtttctaagggtcgtaccgggaagtaccgtaaccgtcccccgttaacggtacgtaccgg

SEQ ID NO: 384009 - DNA, 538 bp, Homo sapiens
  misc_feature: GZ8MTXP02H94TO.21.40.D07.1.454.CMB.2.raw
  modified_base (498)..(498): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccgaggggaaggggctgggacgtggggtggccaacataaagccaaagatggaagtgagacatactatgtgactctgtgaagggccgattcaccatctcagagacaacgccaagagctacactgtatcgtagacaaaatgaacagcctagagagtcggaggaaccgacgggtctaggttgtaactttacgnggttgaccgagacgtaccttcccccgtacgggtataccgg

SEQ ID NO: 384010 - DNA, 572 bp, Homo sapiens
  misc_feature: GZ8MTXP02JF0HW.21.40.D07.1.454.CMB.2.raw
  modified_base (280)..(280): a, c, t, g, unknown or other
  modified_base (301)..(301): a, c, t, g, unknown or other
  modified_base (450)..(450): a, c, t, g, unknown or other
  modified_base (455)..(455): a, c, t, g, unknown or other
  modified_base (487)..(487): a, c, t, g, unknown or other
  modified_base (534)..(534): a, c, t, g, unknown or other
  modified_base (570)..(570): a, c, t, g, unknown or other
tcagtcgtcgctcgcacgaccggtgctcgatttagtgatagagcgtaacaacagaggggagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggagcttggtccagccgtggggggtccctgagactctcctgtgcagcctctggatcacctttaganctatggatgagcgtgggtccncgagctccgagggaagggctgggaggtgggtcgaccaacagtaaacgcccaagagtggaacgtgagacagtactagtcgtaggacttcgtagtgaaacgggggtcctaaagttccacgatcctaccagacgtaaccaacgcaaaggtancctanaaccgtgtaattccgtagacaaagtgaaaccngacgtgacgacgtacgacggacgtacgtcgttacgtacgttactcgngtaacggacgaacgtcgtaccgtacccgtaggtacncg

SEQ ID NO: 384011 - DNA, 568 bp, Homo sapiens
  misc_feature: GZ8MTXP02GKP5J.21.40.D07.1.454.CMB.2.raw
  modified_base (255)..(255): a, c, t, g, unknown or other
  modified_base (263)..(263): a, c, t, g, unknown or other
  modified_base (288)..(288): a, c, t, g, unknown or other
  modified_base (298)..(298): a, c, t, g, unknown or other
  modified_base (303)..(303): a, c, t, g, unknown or other
  modified_base (312)..(312): a, c, t, g, unknown or other
  modified_base (357)..(357): a, c, t, g, unknown or other
  modified_base (364)..(364): a, c, t, g, unknown or other
  modified_base (368)..(368): a, c, t, g, unknown or other
  modified_base (374)..(374): a, c, t, g, unknown or other
  modified_base (382)..(382): a, c, t, g, unknown or other
  modified_base (398)..(398): a, c, t, g, unknown or other
tcagtcgtcgctcgcacgaccggtgctcgattttagtgatagagcgtaacaacagagggggagagaggagccttagccctggactccaaggcctttccacttggtgatcagcactgagcacagaggactcaccatgaattggggctgagctgggttttccttgttgctattttagaagtgtccagtgtgaggtgcagctggtggagtctgggggagctgggtcagccgtgggggtcctcggaaaactctcctgtncgagctcngatcacttagtagctatggatgagntggcgcaggntaccnggaacgggntacggagtgggtaggcaaagataaacggaccaacggataggaagngacgacntaanattagngctattgngaaaaggccgttaaanacaacgacttacgtacgaagtacaacgaacgacgaaagaacgcttacgtaactacgtactaccgtagaactaaggagtaacgtacgtcgtagacgagtacgtaacggaacgacgtacgtacgtacgtactacgtagtcgacgacgacgtaccgtacccgtacgtacgtag

SEQ ID NO: 384012 - DNA, 480 bp, Homo sapiens
  misc_feature: GZ8MTXP02IV3TE.21.40.D07.1.454.CMB.2.raw
  modified_base (167)..(167): a, c, t, g, unknown or other
  modified_base (267)..(267): a, c, t, g, unknown or other
  modified_base (445)..(445): a, c, t, g, unknown or other
  modified_base (447)..(474): a, c, t, g, unknown or other
  modified_base (476)..(480): a, c, t, g, unknown or other
tcagtcgtcgctcgcacgaccggtgctcgattttagtgatagagcgtaacaacagagggtcaccatcccttgttctggaagcagctccaacatcggaagacattatgtgtactggtaccagcagctcccaggaacggcccccaaactcctcatctataggaataatnagcggccctcgaggggtccctgaccgattctctgctccaattctgcactcagcctcctgccatcagtgggctccggtcgaggatgagctgattatatgtnctagcatgtagatggacgctggagtggtccggtgttcgggcggtagggacccaggctcgaccgtcgaggtcccagaccccgaagcctcgcccccgtgtccacttctcgtccccacccttccgtccgagaccgcgtactcgacggcggtcccgtagggaccgaacggcgactagacggngnnnnnnnnnnnnnnnnnnnnnnnnnnnncnnnnn

SEQ ID NO: 384013 - DNA, 512 bp, Homo sapiens
  misc_feature: GZ8MTXP01CQMWY.17.27.C05.1.454.CMB.2.raw
  modified_base (295)..(295): a, c, t, g, unknown or other
  modified_base (314)..(314): a, c, t, g, unknown or other
  modified_base (368)..(368): a, c, t, g, unknown or other
tcagcgtagactagcacgaccggtgctcgatttagacgcgatcgaagggtttgggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagtggtaccagcagaagccaggacaggcccctgtacttgtcatttanggtaagaataaccggcctnagggatcccagacccccgattctctggctccgactcaggaaagacagcttcccngacccatcactgggctcaggcgaagatgaggctgactattacgtgtaactcccgggacagcagtgactgaccaggtgtattcgggcgagggacccacgtgaccgttcgttggcaagcccaaggctcgcccctcggttctaaccg

SEQ ID NO: 384014 - DNA, 528 bp, Homo sapiens
  misc_feature: GZ8MTXP01ECQKR.17.27.C05.1.454.CMB.2.raw
  modified_base (295)..(295): a, c, t, g, unknown or other
  modified_base (314)..(314): a, c, t, g, unknown or other
  modified_base (373)..(373): a, c, t, g, unknown or other
  modified_base (499)..(499): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagtggaccagcaagaagccaggacaggcccctgtactgtcatttanggtaagaataaccggcctnagggactcccagaccccgattctctggcctaccgactcgaaggaaagacagccttcccngacccatcacgtggggctcgaggacggaagatgaggctagactattacgtgtaacctccgggacagcagtgctgacctaggtgtagtcgggcggacgggacccacgtgaaccgttcgttaggttcngcccaaggctacgcccctcggttctaacc

SEQ ID NO: 384015 - DNA, 546 bp, Homo sapiens
  misc_feature: GZ8MTXP01DW9UV.17.27.C05.1.454.CMB.2.raw
  modified_base (245)..(245): a, c, t, g, unknown or other
  modified_base (292)..(292): a, c, t, g, unknown or other
  modified_base (312)..(312): a, c, t, g, unknown or other
  modified_base (369)..(369): a, c, t, g, unknown or other
tcagcgtagactagcacgaccggtgctcgatttagacgcgatcgaagggtttgggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattangcaagtggaccagcagaagcaggacaggcccctgtactgtcatttanggtaagaataaccggcctanagggactcccagaccccgattctctggcctaccgactcaaggaaagacagcttcccngaccatcacgtggggctacgaggacggaagagtgaaggcctagacttattacgtacgtaaccgtcccgggacagcagtgcgtgaccgaggtggtagttcgggcggacgggacccaccgtcgtacccggttcgttaggcaacgcccaacggcctccgcccccgtcggttcctaacccg

SEQ ID NO: 384016 - DNA, 800 bp, Homo sapiens
  misc_feature: GZ8MTXP01CW4PS.17.27.C05.1.454.CMB.2.raw
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaaagctattatgcaagtgacagaagaagcaggacaggcccctagtacttgtcaatttatagggtaaagaacgtaaacccgggcccctacgaaggggtactaccccgaagaccccggtaatttccgtcgtcggggtaccctaccccggaaaccgttacccgaaggggtaaaaacgaccctaaacgggtaccccctttttacccccgacgggtaaaccccaacttaccccgtaaaccgttacggggggcccttaccggaacggggaacccggggaaaacggaacgttacgggaaggggtacctagggtaacccttaaagtttaaccgtacggggttaaacccggttacccccgggggtaaccaacggaccgtaaacggtacggtccgttacggaacccgtaaacggggttagggtacggtttaccggggaaccggggtaacggggaaccccggtacccgttacggtaaacccggttccgtttaaaccggggttccgaaccggtaaccccgtaaaacgggccccgttacccggccccccgttccggggtaacccttccgtttccccg

SEQ ID NO: 384017 - DNA, 560 bp, Homo sapiens
  misc_feature: GZ8MTXP01BPVSO.17.27.C05.1.454.CMB.2.raw
  modified_base (449)..(449): a, c, t, g, unknown or other
tcagcgtagactagcacgaccggtgctcgatttagacgcgatcgaagggtttgggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagtggaccagcagaagccaggacaggcccctgtacttgtctatttagtggtaagaactaaccggcctcgagggactcccagaccccgattctcgtggcctcccgactcgaaggaaacgacagtccttccctagacccatcacggtggggctcgagggacggaagatggaggctagactattacgtgtaaccgtcccggganagcagtcgctgaccgtagggtcggtagttcgggcggttacgggaccccacgtcggtaccgttcgttacggttcaacggtcccgaacggctccggcccctcggttctaaccg

SEQ ID NO: 384018 - DNA, 559 bp, Homo sapiens
  misc_feature: GZ8MTXP01CLHXB.17.27.C05.1.454.CMB.2.raw
  modified_base (455)..(455): a, c, t, g, unknown or other
tcagcgtagactagcacgaccggtgctcgatttagacgcgatcgaagggtttgggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagtggaccagcagaagccaggacaggcccctgtacttgtctatttataggtaaagaacttaaacccggccctacgagggactccccgagacccccgattctctggcctacccgactcgaagggaaaacgacacgccttccctgaacccatcacgtggggctcgaggacggaagatgaggctgactattacgtcgtaactcccggganagcagtgctgaccagggtcgtagtcgggacggacgggaccccacgtacgccgttcgttcggttccaacgccccgaaggcctcggccccctcggttcctaacccg

SEQ ID NO: 384019 - DNA, 571 bp, Homo sapiens
  misc_feature: GZ8MTXP01CWTQ3.17.27.C05.1.454.CMB.2.raw
  modified_base (246)..(246): a, c, t, g, unknown or other
  modified_base (465)..(465): a, c, t, g, unknown or other
  modified_base (509)..(509): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggttttcttctgagctgactcaggatcctgctgtgtctgtggccttgggacagacagtcaggatcacatgccgaggagacagcctcagaagctatangcaagtggacagcagaagccaggacacggcccctgtacttgtctatttagaggtaaagaacttaacccggcctacgaagggactacccgagacccccgtattctcgtcggcctacccgactcgaagggaaacacacgccttccctacgacccatacgacgtggggctcgagggacggaagagtgaggctagtacttattacgtcgtaaccgtcccgganagcgagtgctgaccgtaggtgtacgtcgggacggacgggacccncgtacggaccgttcgttaggccaacgacccgaaggcctccggcccccgtcggttcctaaccg

SEQ ID NO: 384020 - DNA, 585 bp, Homo sapiens
  misc_feature: GZ8MTXP01BTLPV.17.27.C05.1.454.CMB.2.raw
  modified_base (246)..(246): a, c, t, g, unknown or other
  modified_base (271)..(271): a, c, t, g, unknown or other
  modified_base (292)..(292): a, c, t, g, unknown or other
  modified_base (299)..(299): a, c, t, g, unknown or other
  modified_base (561)..(561): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctacagaagctatangcaagtgacagcagaagccaggacnggcccctgtactgtcatttanggtaaanaactaacccggcctagagggactccccgagaccccgattctcgtggcctaccgaactcgaaaggaaacgcacgccttccccagacccatcacgtcgggctacgaggacggaagatggacggactagaacttacttaacggtacgtaaccgtcccgggaacgagccgtagtcgacgtcgaaccgtagggttcggtaacgtcgggacgggacgggaccccacgtacggtaccgttcgttacggaccgaacgcccgaacggtccnccggcccctcggttccgtaacccg

SEQ ID NO: 384021 - DNA, 829 bp, Homo sapiens
  misc_feature: GZ8MTXP01C9XDG.17.27.C05.1.454.CMB.2.raw
  modified_base (234)..(234): a, c, t, g, unknown or other
  modified_base (246)..(246): a, c, t, g, unknown or other
  modified_base (295)..(295): a, c, t, g, unknown or other
  modified_base (302)..(302): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctnagaagctattangacaagtgaccagcagaagccaggacaggcccctgtacttgctatttanaggtaanaactaacccggccctagagggactcccgagacccccgtattctcgtcggcctaacccgaactccgaaagggaaaaacaccgtaacggtcccttttacccccgacgaaacccctaacttaccgaaaccggttcggggggacccttaccgggaacgggggtaaccggggaaaaggtacgtaggggaacgggtaccgttaacgggtaaacctttaaaacgtttaacccggggtaaacggtttaaaacccccgggttacccccgggggaaacgtaaccggtaccgtaacgggttccggtaaccgtaaccgggtaacccgggtaagggggtttaccgggttaaccgggttaacccgggggaacccgggggttaaacccgggggtaaacccccgttaaccgggttaacccgggtaaccccgggtttacccggtttaaccggggttaccccgtaacccgggtaccccgggtaaccgggtccccggttacccccgggttaccccccggttaaccgggttaaccccgtaaccccgg

SEQ ID NO: 384022 - DNA, 570 bp, Homo sapiens
  misc_feature: GZ8MTXP01C3V6U.17.27.C05.1.454.CMB.2.raw
  modified_base (291)..(291): a, c, t, g, unknown or other
  modified_base (367)..(367): a, c, t, g, unknown or other
  modified_base (377)..(377): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagtgacagcagagcaggacacggcccctgtactgtcatttanaggtaagaacgtaacccggcctacgagggactccgacgaccccgtattctcgtcggcctaccgactcgaaggaaanacagcctccngaccatcacgtcgggctcgagggacgaagagtggacgctagacttaagttacgtacggtaaccgtacccggggacacgctagtcgacgtcgaccgtagggtcggtacgtcggggcggacgggccccacgtcggacccgttcgttacggccaacgcccgaacggtccctcgttcccccgtcggttcctaacccg

SEQ ID NO: 384023 - DNA, 554 bp, Homo sapiens
  misc_feature: GZ8MTXP01B1ICE.17.27.C05.1.454.CMB.2.raw
  modified_base (356)..(356): a, c, t, g, unknown or other
  modified_base (389)..(389): a, c, t, g, unknown or other
  modified_base (431)..(431): a, c, t, g, unknown or other
tcagcgtagactagcacgaccggtgctcgatttagacgcgatcgaagggtttggggacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgagggtctcctgcaaggcttctgcaggcacctttagcaactatgcttcagctgggtgcgacacggcccctggacagggcttgagtggagtggggaggatcgtattcctatccgttggactagtaaggtatccganagaaagttccgaaggacaaagtccacataccgngacgaactcacgagcacagactacatgagttgagcagcctanagtatcgtgacggacacggtccgtagtacttacgtggtgcggaaggacgggttaccggaagaccgaacgaagttcgggactaagggtaggtaagggtaattggttagtttggtttttcgtaag

SEQ ID NO: 384024 - DNA, 676 bp, Homo sapiens
  misc_feature: GZ8MTXP01EAXRK.17.27.C05.1.454.CMB.2.raw
  modified_base (235)..(235): a, c, t, g, unknown or other
  modified_base (299)..(299): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctanagaagctatatgactaagtggtaccagcaagaagccaggacaggcccctgtactgtctatttanggtaacataaccggcctagacggactcccgagtacccccgattctcgtcggccttacccggaactccgaaagggaaaacaccaagtccctttacccagtaacccaatccgtaacgtcgggggccttacgaaggggaccggaaagtacgtgggacgggtacctaggtaaacctttaacgtttaaccgggttacggttaaaacccggttaccccggggaactaacggacccgtaaggttcgaccgttacggaacccgtagggtttggtaacgttccgggacgggaacggggaccccttacgtacggacccgttacgttacggaccaacggtaccccgaaggtccgttcccggacccccgttcgggttaaccgttccccg

SEQ ID NO: 384025 - DNA, 655 bp, Homo sapiens
  misc_feature: GZ8MTXP01DTHW5.17.27.C05.1.454.CMB.2.raw
  modified_base (230)..(230): a, c, t, g, unknown or other
  modified_base (241)..(241): a, c, t, g, unknown or other
  modified_base (246)..(246): a, c, t, g, unknown or other
  modified_base (427)..(427): a, c, t, g, unknown or other
  modified_base (637)..(637): a, c, t, g, unknown or other
  modified_base (649)..(649): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggttttcttctgagctgactcaggatcctgctgtgtctgtggccttgggacagacagtcaggatcacatgccgagggacancgcagaagagntatangacgtagtacgacagacgaaagacgacgaacggacgacccgtcccgttagtacttgtacttaagtttagtaaacggtaaacgtaaacccgtaaccccggtacccgaaggaacggtaaccctacccgaacgtaaccccgttcttcgtcgtcggtaccctaaccgaccaagaaaacggaaacnccgtactccccttaccaacgtactacgtcgtacgggcgggtacacgggacggaaaggagtacgaggaccgtagtaacgtaactttaacgttaaccggaacggttaacccggaccggacagccgtagtcgtacgtacggaacggtaggttacggtcggcggacgggacccgaccgttcgacgtacgttcgttcgaccaacgacgcgtcccncccgcccgttcnccgtcc

SEQ ID NO: 384026 - DNA, 518 bp, Homo sapiens
  misc_feature: GZ8MTXP01BLKAN.17.27.C05.1.454.CMB.2.raw
  modified_base (400)..(400): a, c, t, g, unknown or other
tcagcgtagactagcacgaccggtgctcgatttagacgcgatcgaagggtttgggagctgtgggctcagaagcagagttctggggtgtctccaccatggcctggacccctctctggctcactctcctcactctttgcataggttctgtggttttcttctgagctgactcaggatcctgctgtgtctgtggccttgggacagacagtcaggatcacatgccgaggagacagcctcagaagctattatgcaagtggtaccagcagaagccaggacaggcccctgtacttgtcatttatggtaagaataaccggcctgagggactcccagaccccgattctctggctaccgactcgaggaaagacagccttcctgaccatcacgtgggctcgaggacggaagntgagctgactattacgtgtaacgtccggacagcagtgctgaccaggtggtgtcgggcggacgggcccacgtgaccgttcgttacggttcaacgccgaaggctcgcccctggttctccg

SEQ ID NO: 384027 - DNA, 570 bp, Homo sapiens
  misc_feature: GZ8MTXP01A02J1.17.27.C05.1.454.CMB.2.raw
tcagcgtagactagcacgaccggtgctcgatttagacgcgatcgaagggtttgggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcgcatgccgaggagacagcctcagaagctattatgcaagtggaccagcagaagccaggacacggcccctgtacttgtctatttataggtaaagaactaacccggcctacgagggactcccgacgaccccgtattctcgtcggcctacccgactcgaaagggaaacgacacgccttcccctagacccatcgacgtcggggctacgagggacggaagagtggaggctagacttattacgtacgtaacgtccggacagcagtcgacgtgaccgagggtcggtagtcgggcggacgggacccacgtcgaccgttcgttcggttcgaacgcccgaacggcctccgccccgtcggttcctaaccg

SEQ ID NO: 384028 - DNA, 659 bp, Homo sapiens
  misc_feature: GZ8MTXP01CFA4C.17.27.C05.1.454.CMB.2.raw
  modified_base (506)..(506): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgttggtttcttctgagctgactcaggatcctgctgtgtctgtggccttgggacagacagtcaggatcacatgccgaggagacagcctacaagaagctaattatgactaaggttcggaaccagacaaggaacgccaaggacacggccccctgtacctttgtctaatttagtaggtaagaactaacccggcctagagggactcccaagtacccccgtattctcgtcggcctacccgactcgaaagggtaaacgacacgtccttacccagacccatccgacgtggggacctacgagggacggtaaagagtgacggacctagaacgttaactttacggtaacggttaaaccgtccccgggaanacgcgtagtcgacgtcggtaaccggtaggggtacggttacggtaaccggggaccgggaaccgggtaccccttacggtacggtaccgttacggttacgggttaccgaaccggtacccgaacggtcccgtcccggccccgttccggttcctcccg

SEQ ID NO: 384029 - DNA, 553 bp, Homo sapiens
  misc_feature: GZ8MTXP01COR7O.17.27.C05.1.454.CMB.2.raw
  modified_base (246)..(246): a, c, t, g, unknown or other
  modified_base (287)..(287): a, c, t, g, unknown or other
  modified_base (293)..(293): a, c, t, g, unknown or other
  modified_base (407)..(407): a, c, t, g, unknown or other
  modified_base (487)..(487): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattangcaagtgacagcagagcaggacagccctgtactgcatttanggtaanaataaccggcctagagggactcccagaccccgattctcgtggcctacccgactcgaaaggtaaacgacacgtcttaccccgtgacccatcacgtggggctacgagggcgaaagntggaggctagacttattacgtagtaaccgtccgggacagtccagtgcgtgaccgaggtgtgtccgggcggacgggacccncgtacgacccgttcgttcgggaccaacgacccgaagggtcctcggcccccctggttccctaacccg

SEQ ID NO: 384030 - DNA, 693 bp, Homo sapiens
  misc_feature: GZ8MTXP01BL7PG.17.27.C05.1.454.CMB.2.raw
  modified_base (245)..(245): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttggacagacagtcaggatcacatgccgaggagacagcctcagaagctattangcaagtggacagcagagccaggacacggcccctgtacttgctatttagtaggtaagaactaacccggcctacgagggactcccgagacccccgattctcgtggcctaccgactcgaaggaaacgacacgtccttccctgacccatccacgtcggggctcgagggtacggaagagtggacggctacggtacttaagttaccggtacggttaaacccggttccccggggaacacggtaccgtaacggttcgaccgttacggaaccccggtaggggttcgggttaacggtttcccgggggaccgggggttaaccggggtacccccgttaaccggttaccggggtaaccccggtttcgtttaaccggggttacccgaaccgggtacccccggtaaaccggggtcccgtccccgggttaccccccccggtttcggggttccccttaaccccgg

SEQ ID NO: 384031 - DNA, 651 bp, Homo sapiens
  misc_feature: GZ8MTXP01DPQVS.17.27.C05.1.454.CMB.2.raw
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcaagaagctattatgactaagtgtacagcaagaagccaggacacggcccctgtacttgtctaatttagtaggtaaacgaacgtaacccggcctacgagggactcccgaacgtacccgatttctcgtacggtcctacccgactcgaaaggaaacgacacgtcccttacccgtacgaaccctactccgaacggtcgggggacctacgaggggaacggaaagagtggaacggcttaggaacttaacgttaccgtacggttaaacccgtaccccgggaacacgaccgtagttacggccgttacggaaccggtagggtcggttaacgtcggggaccggacgggtaccccacgtcggtacccgttcgttaacggttccaacggacccgtaacggcccttccggcccccgtggttccctaacccg

SEQ ID NO: 384032 - DNA, 530 bp, Homo sapiens
  misc_feature: GZ8MTXP01DJOAG.17.27.C05.1.454.CMB.2.raw
  modified_base (410)..(410): a, c, t, g, unknown or other
  modified_base (421)..(421): a, c, t, g, unknown or other
  modified_base (434)..(434): a, c, t, g, unknown or other
  modified_base (461)..(461): a, c, t, g, unknown or other
  modified_base (463)..(463): a, c, t, g, unknown or other
tcagcgtagactagcacgaccggtgctcgatttagacgcgatcgaagggtttggggacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgagggtctcctgcaaggcttctgcaggcacctttagcaactatgcttcagctgggtgcgacaggcccctggaccaagggcttgagtggagtgggaggatcattcctatcgtggacagtagtatcacagaaacgttccaagggacaaagtcaacagtaccgacgaacgaatccacgagcaacagacctanattgagttgancagctcagatcgngagacgacggccgtgtatacgtgtcgngnggacgggtccgagaacgacgaagttcggagaaggtaggtaagggtaattgttagttgtttttgtaag

SEQ ID NO: 384033 - DNA, 763 bp, Homo sapiens
  misc_feature: GZ8MTXP01BV2Y2.17.27.C05.1.454.CMB.2.raw
  modified_base (272)..(272): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttctctgagctgactcaggactcgtgtcgtgtcgtcgtggtcggtccggttaggacacgacgtagtacgagtactacaactagtccggaccggaggacgacgacgtcctagaaggtactnttaattagcgaacgttaagggtaccgaaccagacgaaaggaccgcgaacggaacgcccggtcccttagtttacttgtactttaagtttaggtaaggtaaagtaaccgtacccggtcctagggaacggcctaccgacgtaccgtcttccgtggtccgcctaacccgactaacggaaaggaaacacgtaccgtcccttacgacgacctactacgacgggtcgggccacgggacgggtaacggaagtacgtgggaacgttcgtaacgtaacgtttaacgtttacggtaacgtaacccggtccgggaacgaacgcgtaacggttgacccggttacgtaacccggtacgggttagggtttaaccgttccgggggaacggggttaaccggggaacccccttaccgtccgggtaaccggttccgttacggttaccggaaccgacccggttaaacgcccggttcccgccccccgggtttaacggttaacccgttccccg

SEQ ID NO: 384034 - DNA, 654 bp, Homo sapiens
  misc_feature: GZ8MTXP01D1NW3.17.27.C05.1.454.CMB.2.raw
  modified_base (233)..(233): a, c, t, g, unknown or other
  modified_base (296)..(296): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttctctgagctgactcaggatcctgctgtgtctgtggccttgggacagacagtcaggatcacatgccgaggagacagcctnagaagctatatgcaagtgacagcagagcaggacagcccctgtactgtctatttataggtaaanaacgtaacccggcctacgagggactcccgagaccccgtattcgtcgtacggccctaacccggactccgaaagggaaaacgaccacgtaccctttccccagaacccctaatccgaacggtcggggactaccgaaggggaccggaaaggtacaggacgggactacggtaaacctttaacgttaacggtaaccggtaaaccgtaccccggggaaacgacggacgtacggtacgaccgtacggtaaccggtagggttacgggtaacggtccggggacggaccggtacccttaccgtacggtaccgttacggttccggaccgaaccgaccgtaacggcccgtcccgccccgtcgttccctccg

SEQ ID NO: 384035 - DNA, 642 bp, Homo sapiens
  misc_feature: GZ8MTXP01A0PT9.17.27.C05.1.454.CMB.2.raw
  modified_base (249)..(249): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctacaagaaagctattangactaaggtggaaccagacaagaacgccaggacacggcccctgtacttgctaatttagaggtaaagaactaacccggcctagaagggactcccgaagaccccgtattctcgtggcctacccgaactcgaaaggaaacgacctacgtcctttacccccgagtaaccccaatccgaacggtcgggggacctacggaagggaccggaaagtagtcggaggctagaactattacgtacgtaaaccgtccgggaacagccgagtcgacgtacgacgtaggtcggtacggttccgggacgggaaccgggtaccccaacggtcgtaacccggttcgttacgggaccgaacggaccccgaacggtccccgtacccggttccccctcgggttaacctccccg

SEQ ID NO: 384036 - DNA, 661 bp, Homo sapiens
  misc_feature: GZ8MTXP01AKFE8.17.27.C05.1.454.CMB.2.raw
  modified_base (390)..(390): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctatatgcaagtgacagcagagcaggacaggcccctgtacttgtctatttataggtaaagaactaacccggcctagagggactcccgagaccccgtattctcgtacggcctaaccgactcgaaagggtaaacgactacgtcctttacccgngaacccctaattccgaacgttcgggggcctacgagggtaccgggaaagacgtggaacggctacggaacttagttaaccggtacggttaaacccggtccccggggaacacggccgtaaggttcggacttacggaacccgtagggtacgggttacggttccggggacgggaaccggggtacccccttaccggtcggtaaccccggttgtttacgggaccgaaccggcccgaacgggtcccgtaccggttccccccgtcgggttcctaaccccg

SEQ ID NO: 384037 - DNA, 849 bp, Homo sapiens
  misc_feature: GZ8MTXP01CCEK5.17.27.C05.1.454.CMB.2.raw
  modified_base (282)..(282): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttctctgagctgactcaggatcctgctgtgtctgtggccttgggacagacagtcaggatcacatgccgaggagacagcctacaagaaagctattatgactaagtcggaaccagacagaacgccgaggacncggcccctgtacttgtactatttagtacggtaaagaaacgtacccggcctacgacgggactcccgaagtaccccgtatttcgtacgtcggtccctaccggaactcgaaaggtaaaacgaccgtaacggtccctttaccccgaacgacccctagttacccgaacgggttacgggggccttaaccgggaagggggaaccggtaaaaggtcgttacggggaacggtaccgttaaacggtaacgtttaaacccggtttaaacggttacccgggttaaaaccccggttaccccgggggaaacttaacgggacccgtaaacggggttccgtaaacccgggtaccggtaaaccccgggttaagggggttaccggtttaaccgggggttaacccggggggaaacccggggttaaacccggggtaaaccccccgttaacccgggtttaccgggtaaacccccggttttaccgggtttaaacgggccccgtaaaccccgggggacccccgttaaccgggggtccccttacccccgggttccccccgggtttaaccgggttcccctttaacccccggg

SEQ ID NO: 384038 - DNA, 576 bp, Homo sapiens
  misc_feature: GZ8MTXP01EGVMN.17.27.C05.1.454.CMB.2.raw
  modified_base (299)..(299): a, c, t, g, unknown or other
  modified_base (305)..(305): a, c, t, g, unknown or other
  modified_base (343)..(343): a, c, t, g, unknown or other
  modified_base (384)..(384): a, c, t, g, unknown or other
  modified_base (418)..(418): a, c, t, g, unknown or other
  modified_base (460)..(460): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggttttcttctgagctgactcaggatcctgctgtgtctgtggccttgggacagacagtcaggatcacatgccgaggagacagcctcagaaagctattatgcaagtggaccagcaagaagccaggacacggcccctgtacttgtcatttanggtaanaactaaccggcctagaggactcccagaccccgtattcnctggcctaccgactcgaaggaaacacacgcctttaccccgngaacccatcgacgtggggctacgaggacggaagngtaggaggctaggaacttacttacgtagtaaccgtccggganagcagtcgctgtaccgaggttcggtagtcgggcggacgggaccccttacgtagtacccgttacgttcggccaacgcccgaacgggtcctccggttcccccgtcggttcctaacccg

SEQ ID NO: 384039 - DNA, 739 bp, Homo sapiens
  misc_feature: GZ8MTXP01ASRIL.17.27.C05.1.454.CMB.2.raw
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggttttcttctgagctgactcaggatcctgctgtgtctgtggccttgggacagacagtcaggactcacatcggccgaggagacagccctacaagaaagcttaattatgactaaaggtcggtaaccagcaaggaacgccgaaggacacggtcccctagtaccttgtactagtttagtaggtaaacgaacgtaacccggcctacgaacgggacctacccgacgacccgtattcgtcgtcggcctaacccgactcgaaacggaaacgtaccacgtcccttacccgacgaccctacgtccaacggtcgggcctacggaacggggaaccgggtaaacgagttagggaacgtcgttacggaactttacgttaacgtacggtaacccgtacccgggaacgagtaccgaggttacgaccgtacgggaaccgtagggggttacgggtaacggttccgggggacggggaaacccggggtaaccccaccgggttaccgggtaacccgtttacggtttaaccgggttaccgtaaacccggtccccggaaacggggtcccctacccgggttccccccgttaacggggttaaccctaaccccgg

SEQ ID NO: 384040 - DNA, 775 bp, Homo sapiens
  misc_feature: GZ8MTXP01DZ3E2.17.27.C05.1.454.CMB.2.raw
  modified_base (299)..(299): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggttttcttctgagctgactcaggatcctgctgtgtctgtggccttgggacagacagtcaggatcacatgccgaggagacagcctcagaaagctattatgacaagtgaccagcagaagccaggacaggcccctgtacttgtactatttanaggtaaagaactaaacccggccctagacgggactcccgaagaccccgtattctcgtggccctacccgaactccgaaagggaaaacgaccaacgtcccttaccccgtagaaacccctagttacccgaacggttcgggggaccttaccggaaggggaaccgggaaagaagttacgggaacgggaccttacggtaaacctttaacgtttaaaccggggttaacgggttaaaccccgttacccccgggggaaacgtaaccggtaccgtaacggttaccggtaccgttaaccgggtaacccgggttaaggggttacgggttaaccgggttaacccgggggaaccggggttaaacccggggtaacccccgttaaccggtaccgggttaaccccggttacggttaccgggttacccgtaacccggtaccccggtaacgggtccccgtaccccggttacccccgttccggttccccgtaacccg

SEQ ID NO: 384041 - DNA, 773 bp, Homo sapiens
  misc_feature: GZ8MTXP01ADS0S.17.27.C05.1.454.CMB.2.raw
  modified_base (227)..(227): a, c, t, g, unknown or other
  modified_base (235)..(235): a, c, t, g, unknown or other
  modified_base (299)..(299): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctggtggccttgggacagacagtcaggatcacatgccgagganacagcctnaagaagctatatgcaagtggaccagcagaagccaggacacggcccctgtacttgtctatttagnggtaagaactaacccggcctacgagggactcccgagaccccgtattctcgtcggcctacccgaacgtcgaaagggtaaacgaccaacggtcctttaccccgagaaacccctagtaccgtaacggttcgggggacctacggaacggggaccggggaaagtacgtagggaacggtccgttaaggtaacctttaaacgtttaaccggggttacgggttaaaaccccggtttacccccgggggaaactaaaccggccgtaagggttcggtaacccgttacgggaaacccggttaacgggggttggggttaaaccggtttcccgggggaaccgggggttaacccgggggaacccccgttaaacccggttacgggtaaccccgggtttccgtttaacggggttacccgaaccgggtacccccgaaacgggtccccggttacccgggttcccccccggtttcgggttccccttaaccccgg

SEQ ID NO: 384042 - DNA, 648 bp, Homo sapiens
  misc_feature: GZ8MTXP01A8EI8.17.27.C05.1.454.CMB.2.raw
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggttttcttctgagctgactcaggatcctgctgtgtctgtggccttgggacagacagtcaggatcacatgccgaggagacagcctcagaagctattatgactaagtggacagcagaacgcaggacacggcccctgtacttgtctatttagtaggtaaacgaacgtaacccggcctacgagggactacccgacgtaccccgtattctcgtcgccctacccgactaacgaagggaaacactacgtcccttacccgtagaaccctataccgaccgggttcgggggaccctacggaacgggggaacggaaaggtacgtagggaacgggtctacggtaactttaacgtttaccggtacggtaaacccggtcccgggaacaacgtccgaggtcgacgtacgaccggtagggttcggtacggtcgggcgggaccggaccccgacgtcggtaccgttcgttcggaccgaacgcccgtaacggcctccgccccgtcgttcctaacccg

SEQ ID NO: 384043 - DNA, 509 bp, Homo sapiens
  misc_feature: GZ8MTXP01EFSMR.17.27.C05.1.454.CMB.2.raw
  modified_base (315)..(315): a, c, t, g, unknown or other
  modified_base (414)..(417): a, c, t, g, unknown or other
  modified_base (420)..(420): a, c, t, g, unknown or other
  modified_base (424)..(424): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagtggtaccagcagaagccaggacaggcccctgtactgtcatttatggtaagataaccggccctanagggactacaccacgacccgtattccgcttcggaccttacccgaacgtacgaaaggaaacgacccgtacgtacctacccgtaccgaccgtaacgtacgnnnntgngcgnggcggcggacgacggacggacgtacgttacgttcgttacgtaacgtacgtaacgtaccgtaccgttaccgtaaccgaacgtaacg

SEQ ID NO: 384044 - DNA, 621 bp, Homo sapiens
  misc_feature: GZ8MTXP01BXXGY.17.27.C05.1.454.CMB.2.raw
  modified_base (234)..(234): a, c, t, g, unknown or other
  modified_base (247)..(247): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctnaagaagctattangcaagtggaccagcagagccaggacaggcccctgtacttgtctatttagtaggtaaagaacttaacccggcctagaacgggactccccgaagacccccgtattctacgtcggcctacccgactcgaaagggaaacgacacgtccttacccgagacccatcgacgtggggctacgagggacgaagatggaggtcctaggtacttaacgtttaccggtaacggttaacccggtaccccgggaactacggctaaggtcgtaccgtagacccggtagggttggtacgtcggggacgggacgggaccccacgtacggaccgttcgttacggccaacggaccccgaaggtccctaccggcccccgtggttccctaacccg

SEQ ID NO: 384045 - DNA, 616 bp, Homo sapiens
  misc_feature: GZ8MTXP01EFH2B.17.27.C05.1.454.CMB.2.raw
  modified_base (314)..(314): a, c, t, g, unknown or other
  modified_base (345)..(345): a, c, t, g, unknown or other
  modified_base (375)..(375): a, c, t, g, unknown or other
tcagcgtagactagcacgaccggtgctcgatttagacgcgatcgaagggtttggggagctgtgggctcagaagcagagttctgggggtgtctccaccatggcctggacccctctctggctcactctcctcactctttgcataggttctgtggttttcttctgagctgactcaggatcctgctgtgtctgtggccttgggacagacagtcaggatcacatcgaccgaggagacagcctacaagaagcttattatgactaaggtgaccagacaagaagccgaggacacggccctgtactgtctatttagaggtaanaactaccggcctagaaggcaccagacccctnttctctggcctaccgactcgaaaggaaacncacgtccttacccagacccactcgacggtcgggctacgagggtacggaagtagcggacggctacgtaacttaacgttacggtacgtaacccggtccggacacgcgtagtcgacgtacggtaccgtagggttacggtcggtcggggacgggaccggacccgttaccgtacgtacccgttacgttacggaccgtaaccggacccgtaacggcccgtcccgacccccgtcggttccctaacccg

SEQ ID NO: 384046 - DNA, 640 bp, Homo sapiens
  misc_feature: GZ8MTXP01CBGZO.17.27.C05.1.454.CMB.2.raw
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggttttcttctgagctgactcaggatcctgctgtgtctgtggccttgggacagacagtcaggatcacatgccgaggagacagcctcaagaagctattatgctaagtggacagcaagaagccaggacacggtcccctgtacttgtactatttagtagggtaaacgtaacgtaacccggccctacgagggaacctcccgagaccccgtattctcgtcggcctacccgaactcgaaagggaaacacctacgtcccttaccccagaccccatccgacggtggggctacgagggacggaaagagtgggacgtctaaggacttaacgttacgtacggtaaaccgtcccgggaatacgcgaacgttgaccgttaggaaccgtagggtcggtacggttaacggggccggaacggggtaccccacgtacggcccgttacgttacggttcgaaccgtcccgaacggtcccgtacccggttcccccttcgggccctaacccg

SEQ ID NO: 384047 - DNA, 643 bp, Homo sapiens
  misc_feature: GZ8MTXP01DSHYQ.17.27.C05.1.454.CMB.2.raw
  modified_base (227)..(227): a, c, t, g, unknown or other
  modified_base (235)..(235): a, c, t, g, unknown or other
  modified_base (248)..(248): a, c, t, g, unknown or other
  modified_base (300)..(300): a, c, t, g, unknown or other
  modified_base (308)..(308): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggttttcttctgagctgactcaggatcctgctgtgtctgtggccttgggacagacagtcaggatcacatgccgagganacagcctnagaaagctattangacaagtggaccagcaagaagccaggacaggcccctgtacttgtctatttanaggtaaanaactaaccggcctagacgggactcccgagaccccgtattctctcggcctaaccggactcgaaaggaaacgacacgtcccttacccgtagaccctatcgacgttcgggggactacgaagggacggaaagtatagggacgactaggtaaccttaacgtttaacggtaaccggttaaccggtccccgggaacaacggccgagttcgaccgtcggaccgtagggttggtacgtaacgggcgggaacggggaccccttacgtacggtacccgttacgttcggttaccgaaccgtacccggaacggtcctcccggttcccccgttcgggttaaccttcccg

SEQ ID NO: 384048 - DNA, 582 bp, Homo sapiens
  misc_feature: GZ8MTXP01E3BQ3.17.27.C05.1.454.CMB.2.raw
tcagcgtagactagcacgaccggtgctcgatttagacgcgatcgaagggtttgggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctatatgcagtgaccagcagaagccaggacaggcccctgttacttgtcatttataggtaaagaactaacccggcccctagacgggactcccagaccccgtattctctggcctacccgactcgaaggaaacacacgccttccctagaccctatcgacgtgggggacctacgagggacggaagagtgaggctagtactattacgtcgtaaccgtcccggacagcgagtcgactcgaccgtaggtcggtacgtccgggacggacggaccccaccgtacgtacccgttcgttacggccgaaccgaccccgaacggtcccgtacccgcccccgtccgttcctaaccccg

SEQ ID NO: 384049 - DNA, 721 bp, Homo sapiens
  misc_feature: GZ8MTXP01AH2UP.17.27.C05.1.454.CMB.2.raw
  modified_base (484)..(484): a, c, t, g, unknown or other
tcagcgtagactagcacgaccggtgctcgatttagacgcgatcgaagggtttggggacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgagggtctcctgcaaggcttctgcaggctacctttagctaactatgtcttcagcgtgggtgcgacgacggccccgtggacaagggcttggagtggagtgggaggatcgtacttcctagttcccgttagggggaactacggttaaaggtactaccgaaccgtaagtaaacgttacccgaacgggtaacaaacgttaccaacccgtacgttacccggacggaaaccgaactcccgaacgacgtaccaacgaccgtacccttaaanatttacggacgtttagaacggtccaaccggtcccttagaaagtcgtaccgtaacggacgggaacctccggggttacccgttagtttaaccgttaccgtggttccgggtaacgggaacgggttacggggggtaccccgaagggtaaaccccaacggttaacgggttcgggacgtaaggggttagggttaagggggtaaatttggggtttattttaagggttttttaaggtaaccccgg

SEQ ID NO: 384050 - DNA, 622 bp, Homo sapiens
  misc_feature: GZ8MTXP01C4CES.17.27.C05.1.454.CMB.2.raw
  modified_base (244)..(244): a, c, t, g, unknown or other
  modified_base (298)..(298): a, c, t, g, unknown or other
  modified_base (477)..(477): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttggacagacagtcaggatcacatgcgagagacagcctacagaagctattangacaagtgacagcaagagccaggacacggccctgtactgctatttagaggtaanaactaccggcctagaggactccgagaccccgtatctcgtcggcctaaccggaactcgaaaggaaacgacgacgtccttacccgagaccctatccgacggtcggggctacgaagggacggaaagagtaacgggcttagaacttaacgttaacgttacggggtaaacccgtcccggggaanacggacacggtcgacgtacggaccgtaggggtacggtacggttcggggaacgggacgggaccctaacggttcggtaacccgttcgttacggttccgacggaaccccgtagggcccttcccgccccgttcggtccttccggttccc

SEQ ID NO: 384051 - DNA, 549 bp, Homo sapiens
  misc_feature: GZ8MTXP01BHO8S.17.27.C05.1.454.CMB.2.raw
  modified_base (300)..(300): a, c, t, g, unknown or other
  modified_base (451)..(451): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagtggaccagcagaagccaggacaggcccctgtactgtcatttatggtaanaataacccggcctagagggactccccaggaccccattctcgtcggcctacccgactcgaaagggaaacacacgtccttcccagacccatcgacgtggggcctcgaggacggaagatggaggctgactattacgtacgtaacgtcccggganacgcagtgcgtgaccgtaggtgtagtcgggcggacgggacccacgtcgaccgttcgttacgcgaacgccgaacgctccgaccccgtggttcctaaccg

SEQ ID NO: 384052 - DNA, 664 bp, Homo sapiens
  misc_feature: GZ8MTXP01BXIZH.17.27.C05.1.454.CMB.2.raw
  modified_base (239)..(239): a, c, t, g, unknown or other
  modified_base (533)..(533): a, c, t, g, unknown or other
  modified_base (538)..(538): a, c, t, g, unknown or other
  modified_base (639)..(639): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggttttcttctgagctgactcaggatcctgctgtgtctggtggccttgggacagacagtcaggatcacatgaccggaggagacagcctanaagaagcttaattatcgactaaggttcggaaccagacaaggaacgccgaaggaccacggccccttgtaccttgtactagtttagtaggtaaacaacgtaacccggcctacgacgggtactaccccgagtacccccgtattcgtacgtccggccttaacccgactaaccggaaagggaaaccgcgtacgtccccttacccgagaaccctacgtacgcggtacggggcctacggacgggacggaagtacgtggaacgtcgtagaacttacgttacggtacgtaaccggtcccgganacgcngtgacgtaggtacgtaggttcgtcgtaaccgggcggaaccgggtccccttacggtaccggtaccgttcggttacgttccgaaccggacccgaacggtcccnccgttccccctggttaaccctcccg

SEQ ID NO: 384053 - DNA, 749 bp, Homo sapiens
  misc_feature: GZ8MTXP01DPDTX.17.27.C05.1.454.CMB.2.raw
  modified_base (251)..(251): a, c, t, g, unknown or other
  modified_base (402)..(402): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcagatcaacatgaccgaggagacacgcctacaagaagtctattangactaaggtcggaaccagacaagaacgccgaaggacacggcccctgtacttgtctaatttagaggtaaacgaacgtaacccggcctagacgggacctcccgaagtaccccgtattcgtcgtcggccctaacccgaactcggaaaggaaacncctacgtccttaccccgtgaaccctagtccgaacggtcgggggacctacggaaggggaaccggaaagacgttacgggaacgtccgtaacggttaaacttaacgtttaaccggtaacgggttaaaccccggtaccccggggaataacggcgtacggttcgtaccggtacggtaaacccggtaggggtttaccggttaggtcccgggggaacgggaacccgggtacccccttaaccggtaccggttaacccggttcggtttaaccgggacccgtaaccgggacccccggtaaagggtcccccgttaccccgggttacccccccgttcgggttaacccctttaacccccg

SEQ ID NO: 384054 - DNA, 632 bp, Homo sapiens
  misc_feature: GZ8MTXP01CBMD1.17.27.C05.1.454.CMB.2.raw
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctggtggccttgggacagacagtcaggatcacatgccgagagacagcctacagaagctattatgctaagtggtacagcaagaacgccaggacacggcccctagtacttgtctaatttagtaggtaagtaaacgtaacccggccctagaacgggactccccaggtaccccgtattcgtcgtcggcctaccggactcgaaggtaaacgacagtccttacccgtagacccatcgacgtggggctaccgagggacgaagagtcggacggtctacggaacttaacttaacggtacgtaaacccgtcccgggaactacgccgaaggtcgacgtacggaccgtaggttggtacgttcggggaccgggacgggacccgttacgtacggtcttaccgttaggttaccgaacggacccgaacggtccgtccgttcccccgtaacggttccctaacccg

SEQ ID NO: 384055 - DNA, 598 bp, Homo sapiens
  misc_feature: GZ8MTXP01DZ4CH.17.27.C05.1.454.CMB.2.raw
  modified_base (235)..(235): a, c, t, g, unknown or other
  modified_base (247)..(247): a, c, t, g, unknown or other
  modified_base (297)..(297): a, c, t, g, unknown or other
  modified_base (305)..(305): a, c, t, g, unknown or other
  modified_base (329)..(329): a, c, t, g, unknown or other
  modified_base (346)..(346): a, c, t, g, unknown or other
  modified_base (461)..(461): a, c, t, g, unknown or other
  modified_base (570)..(570): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttctctgagctgactcaggatcctgctgtgtctggtggccttgggacagacagtcaggatcaacatgccgaggagacagcctnaagaagctatangacaagtgacagcaagagcaggacacggcccctgtacttgtactatttanaggtaaanaactaacccggcctagacgggacncccgagacccgtattcncgtcggcctaccgactcgaaggaaagccagtcccttaccagacccatcacgtggggacctgagggtacgaagagtcgaggctagtaactagttacgtacgtaaccgtccgggaanagccagttcgacgtacgtaccgtagggttacggtcgttccgggacgggttaccggaccccgttaccgtcggtaacccgttcgttaggcccaacgacccgaacggtcccncccggttccccgtaacggttcctccccg

SEQ ID NO: 384056 - DNA, 717 bp, Homo sapiens
  misc_feature: GZ8MTXP01AFHM1.17.27.C05.1.454.CMB.2.raw
  modified_base (625)..(625): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgttggttttcttctgagctgactcaggatcctgctgtgtctgtggccttgggacagacagtcaggatcacatgccgaggagacgctcagaagactattatagcgaagttaggtaccgacgagaacgaaggaccgacggaacgacgtaccccgtcttacgttacgttcgtaacttttaagttaacggtaaaggtaaacgtaaaccccggtaccccgtaccgtagggaaccgtaccctaccgaccggtaaccttcttccgtggtaccgtcccgtaaacgtaccgaaggaaacggtaaccacgtcccgttccctacgactactacgtacgtagggtcggacaggggacggtaaagagtgacggtcgtactaacgtatttaaccgtcgggtaaacggtacccggacgaagtaccgaaggttcgacgtacggacgtaccgggtagggttaccgttaccggggccgggaaccggggttaacccncccgttaacgtcccggttaacgtttcggaaccgccgaacccgtaacggtcccgttacccgcccccgttaccgggtcttaaccccgttcccgg

SEQ ID NO: 384057 - DNA, 659 bp, Homo sapiens
  misc_feature: GZ8MTXP01DK9EE.17.27.C05.1.454.CMB.2.raw
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctacagagctattatgcaagtggaccagcagaagcaggacacggcccctgtacttgctaatttataggtaaagaactaaacccggccctacgaagggtactccccaagtaacccccgtatttcgtcgtacggccctaacccgaactccgaaagggaaaacgaccacgtccctttaccccgagaaacccctataccgacggtcgggggcctacgaacggggacggaaagagtacggaaggcttaggaacttaactttacgtacggttaaaccgtcccgggaacaacgccgaagttcgccgtaggacccgtagggttcggtaagttccggggcggaccggggtacccccacgtaccgtaccgttccgttacgggttaccgaacggccccgaaggtccctacccggccccccgttcgggttccctaacccg

SEQ ID NO: 384058 - DNA, 567 bp, Homo sapiens
  misc_feature: GZ8MTXP01BBTJR.17.27.C05.1.454.CMB.2.raw
  modified_base (420)..(420): a, c, t, g, unknown or other
  modified_base (509)..(509): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgacaagtggtaccagcaagaagcaggacacggcccctgtacttgtctatttagtaggtaaagaactaaccggcctacgagggactacccagaccccgtattctcgtggcctaccgactcgaaggaaacgacacgtccttcccagacccatcacgtggggctcgagggacggaanagtggacggctaggaacttattacggtacggtaaccgtccgggaacagcagtgactgaccgtagggtggtagtcgggcggacggacccncgtcgaccgttcgttcggcaacgcccgaacggccgtccgccccgtcggttcctaaccg

SEQ ID NO: 384059 - DNA, 638 bp, Homo sapiens
  misc_feature: GZ8MTXP01DEPSI.17.27.C05.1.454.CMB.2.raw
  modified_base (441)..(441): a, c, t, g, unknown or other
  modified_base (484)..(484): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggttttcttctgagctgactcaggatcctgctgtgtctggtggccttgggacagacagtcaggatcacatgccgaggagacagcctacagaagctattatgactaagtcgacagcaagaacgccgaaggacacggcccctgtactgtctatttagaggtaacaacgtaacccggcctagacggactcccgacgaccccgtattctcgtcggccctaacccgactcgaaaggaaacgaccacgtccttacccgagaaccctactcgacggtggggctacggaagggacgaagngtggagctagaacttattacggtacggtaaccgtacccggganacgcgacgtcgacgtacgtaccgtagggtcggtcgtaaccggggaccggttaccgggaccccttacggttaccgggtcccgttacgttcgggttacccgaaccggaaccccgtaacgggtcccgtacccggccccccgttcgggcccttccccg

SEQ ID NO: 384060 - DNA, 627 bp, Homo sapiens
  misc_feature: GZ8MTXP01CWC09.17.27.C05.1.454.CMB.2.raw
  modified_base (235)..(235): a, c, t, g, unknown or other
  modified_base (510)..(510): a, c, t, g, unknown or other
  modified_base (564)..(564): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctanagaagctattatgactaagtggtacagcaagaagccaaggacacggtcccctagttacttgtactatttagaggtaaagaactaacccggcctagacgggactcccgaagtaccccgtattcgcgtcggaccctacccggaactcgaaagggtaaacgacctacgtccttaccgagaccctatccgaacggtcggggactacggaacggggtacggaaggacgtggaacggtctaggtaaacttacgttacggtaacggtaaccgtcccgggaanacgcgtagtcgacgtacgtacgtagggtcgtacggtcgggacggaccggacccncgtacgtccgttacgttcgaccgaacgaccggtaacgtccgtccgttccccgtcgttccgtcg

SEQ ID NO: 384061 - DNA, 724 bp, Homo sapiens
  misc_feature: GZ8MTXP01CTT55.17.27.C05.1.454.CMB.2.raw
  modified_base (595)..(595): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgagggacacacgcctagaagacgtacttaattagtcgaactaaggttcgaaccgagacgaaagaaccgaccgaacggacgacccggtccccttagttacgtttcgtaactttaattttaaggtaagggtaaaacgtaaaaccggttaaacccccggcccttaacgggaacgggtacccttacccgaacggtaacccccgttattcctcggtacggtcccgtaacccgtaactaacggaaaaggggaaaacgactaacgtccccttacccgacgaaccctaattcccgaagggcggggttccacgggaaggggtaacggaaatgtggacgtctaagaactttaacgttacggtacgtaaccccggtcccgggaaancgtacgtaggtcgtacgtacggtacggtacggtacggttacggtaacgggacgggaccggacccgaccgtacgtacgttacgttcgttacgaaccgaccgaacgccgtcccgcccgtccgttccgtccg

SEQ ID NO: 384062 - DNA, 688 bp, Homo sapiens
  misc_feature: GZ8MTXP01CCEWJ.17.27.C05.1.454.CMB.2.raw
  modified_base (228)..(228): a, c, t, g, unknown or other
  modified_base (236)..(236): a, c, t, g, unknown or other
  modified_base (247)..(247): a, c, t, g, unknown or other
  modified_base (277)..(277): a, c, t, g, unknown or other
  modified_base (310)..(310): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggttttcttctgagctgactcaggatcctgctgtgtctggtggccttgggacagacagtcaggatcacatgccgagganacagcctnagaagctatangactaaggtcgacagcagacgccgaggacncggcccctgtacttgtactatttagtaggtaanaacgtaacccggcctagacgggactcccgaagacccctattctcgtcggcctaacccgaactcgaaaggtaaacgactacgtccttacccgtagaccctacgtacgacggtcggggacctacggaaggggacggaaagagtacggacgtactagtaacgtttaacgttaccggtaacggtaaacccggtacccgggaacacgtaccgcggtacgtacgtacggtaaccggtagggttacggtacgggtaaccggggaacggacccggggtaaccccttacggttaccggtacccggtttcggttaacgggacccgaaccgggtaccccgtaacggtccccgttccccggttacccccgttcggttcccgttaaccccg

SEQ ID NO: 384063 - DNA, 647 bp, Homo sapiens
  misc_feature: GZ8MTXP01EF3RW.17.27.C05.1.454.CMB.2.raw
  modified_base (224)..(224): a, c, t, g, unknown or other
  modified_base (232)..(232): a, c, t, g, unknown or other
  modified_base (237)..(237): a, c, t, g, unknown or other
  modified_base (241)..(241): a, c, t, g, unknown or other
  modified_base (264)..(264): a, c, t, g, unknown or other
  modified_base (271)..(271): a, c, t, g, unknown or other
  modified_base (361)..(361): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactatttgcataggttctgtggtttcttctgagctgactcaggatcctgctgtgtctgtggccttgggacagacagtcaggatcacatgcgaganacagcctnagaantatngacagtgacagcagaagcagacncgccctntactgctagttatgggtaaacaactaaccggcctagagggactacccgagacccctatcgtgtcggcctaccgaactcgaaagggaaacncgacgtccttacccgagaacccagtcgaccgtggggctacggaggacggaaagtagtggaggactagtaattacgttacgtaacggtaaccgttccgggaacacgcgaaggttcgacgttacggaacccgtaggggttacgttaacggttccggggacgggttaaaccggggaccccttaaccgggtacgttaaccccggttcgtttaacgggaccgtaaccggaccccggtaaacggggttcccccgtaccccggttaccccggttccggttaaccgttaacccg

SEQ ID NO: 384064 - DNA, 735 bp, Homo sapiens
  misc_feature: GZ8MTXP01EZEOM.17.27.C05.1.454.CMB.2.raw
  modified_base (394)..(394): a, c, t, g, unknown or other
  modified_base (425)..(425): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggttttcttctgagctgactcaggatcctgctgtgtctggtggccttgggacagacagtcaggatcacatgccgaggacgacacgcctacgaagaaacgtcttaattatgactaaggtcggtaccagacaagaacgccgaaggaccgacggtcccctgttaaccttgtactaagtttaagtaggtaaagtaaacctaacccgggtccctagaacgggtacctaccccgaaggaccccctatttcncgtcggccctaccgactaacgaaaggaaacnccacgtcccttacccgacgaacccactacgacgtcgggggactacggacgggacggaaagtagtacggacggaccgtacgtaactttaaccgttacggttaaccgggttaaacccggttaccccgggaacgtacgaccgtaaggttcgaccggttacggaaccggtagggttcgggttaacggtccgggggtaaccgggaccggggtaaaccccgttaccggtaccggtaacccggtttacggttaacggcccgaaccggtacccgaacgggtcccctcccggttaccccgtcggttaacccttaacccg

SEQ ID NO: 384065 - DNA, 675 bp, Homo sapiens
  misc_feature: GZ8MTXP01B8P3V.17.27.C05.1.454.CMB.2.raw
  modified_base (311)..(311): a, c, t, g, unknown or other
  modified_base (318)..(318): a, c, t, g, unknown or other
  modified_base (361)..(361): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctggtggccttgggacagacagtcaggatcacatggaccgaggagacagcctcgaagaaagctaattatgactaagtcggaccagacagaacgccaggacacggcccctgtacttgtactatttagnggtaaanaacgtaacccggcctagaggactcccgagtaccccgtatttcncgtacggcctaaccgactcgaaacgggtaaacacctacggtcccttaccctaggaaccctacgtaccgaacggttcgggggacctacggaaggggtacggaaagtagtacgggaacggtctacggtaacttaacgttaacggtacggttaaacccggtcccgggaacacgtccgaggtcgtacgtacggtaccgtagggttcgttacgggttccgggaacgggaccggtaccccttacggtacggtacccgttacggttacgaccgtaaccgacccgtaacggtccgtcccgttccccgtcggttcctaacccg

SEQ ID NO: 384066 - DNA, 705 bp, Homo sapiens
  misc_feature: GZ8MTXP01C5T2V.17.27.C05.1.454.CMB.2.raw
  modified_base (229)..(229): a, c, t, g, unknown or other
  modified_base (238)..(238): a, c, t, g, unknown or other
  modified_base (252)..(252): a, c, t, g, unknown or other
  modified_base (639)..(639): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgttggttttcttctgagctgactcaggatcctgctgtgtctggtggccttgggacagacagtcaggatcacatgccgagganacagcctanagaaagctaattangactaaggtcggtaaccagacgaaaggaacgccgaaggacacgggtaccccctagttacttgtactaattttagtaggtaaacgtaaacgtaacccggccctacgaacgggtacctacccgaacgtaacccccgtatttcgtcgtcggaccctaaccgactaacgaaaggaaacgaccgtacgtcccttaccctacgaccctattccgacggtcgggctacggaaggggacggaaagtcgtagggacgtacgtacgtaaacttaacgttacggtacccgggtaaacccggtaccccgggaagtaccggtactaacgggtccgacgttaccgtaacccgggtaagggttcgggttaaacggttccggggaacgggacccgggaccccncggtacggtccgttacgttacgacgccggaccctaacggcctccccggcccgttcggcttaacccg

SEQ ID NO: 384067 - DNA, 657 bp, Homo sapiens
  misc_feature: GZ8MTXP01A4F3H.17.27.C05.1.454.CMB.2.raw
  modified_base (290)..(290): a, c, t, g, unknown or other
  modified_base (518)..(518): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgttggttttcttctgagctgactcaggatcctgctgtgtctgtggccttgggacagacagtcaggatcacatgaccgaggacgacacgcctacgaagaagcttaattatgactaaggtcggaaccagcaagacgccgaggacncgccctgtactgtactatttagaggtaacaacgtacccggcctacgacggacctacccgagtaccccgtattcgtcgtcgccctaacccgactcgaaacgggaaacaccgacgtcccttacccgacgtaacccactccgacgggtcggggcctacggacgggaacggaagtacgtacggaacggtctacggtaacttacgttaccgtacggtaacccggtcccggganacgcgtagtcgtacgtcgtaaccggtagggttcggtacggtccggggacgggaccgggtaccccttacggtcggtaccgttcgttaacggcctaacggcccggtaagcccgtcccggttacccgtcggttcctaacccg

SEQ ID NO: 384068 - DNA, 640 bp, Homo sapiens
  misc_feature: GZ8MTXP01AV6T9.17.27.C05.1.454.CMB.2.raw
  modified_base (112)..(112): a, c, t, g, unknown or other
  modified_base (248)..(248): a, c, t, g, unknown or other
  modified_base (382)..(382): a, c, t, g, unknown or other
tcagcgtagactagcacgaccggtgctcgatttagacgcgatcgaagggtttggggagctgtgggctcagaagcagagttctggggtgtctccaccatggcctggacccctntctggctcactctcctcactctttgcataggttctgtggtttcttctgagctgactcaggatcctgctgtgtctgtggccttgggacagacagtcaggatcacatcgccgaggagacagcctcagaagctattagngactaagtggaccagcagaacgccaggacacggtcccctgtactgactatttagaggtaacaactaacccggcctagacggactcccgacgacccgtattctcgtacgccttaacccgactcgaaagggaaacnccgtaacgtccctttcccaggtaaccctaacgttcgaacccgggtacggggtcctccggaagggaccgggaaagtaacggtcggacggtactacggtaacttaacgttacgttacggtaaccggtccccgggaaacacgcgtacggtcgtacgacggtaccggtaggtacggtaccggtccgggacggccgtacccttcggtaccgacgttcgttcggaccaacggccgcggtccctccggttcccgtcgttcgtccg

SEQ ID NO: 384069 - DNA, 700 bp, Homo sapiens
  misc_feature: GZ8MTXP01BVO0U.17.27.C05.1.454.CMB.2.raw
  modified_base (227)..(227): a, c, t, g, unknown or other
  modified_base (235)..(235): a, c, t, g, unknown or other
  modified_base (246)..(246): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggttttcttctgagctgactcaggatcctgctgtgtctgtggccttgggacagacagtcaggatcacatgccgagganacagcctnagaagctatangactagtggaccagcagacgccgagacacggcccctgtacttgtactatttagaggtaagaacgtaacccggtcctagacgggactacccgacgaccccgtacttcgtacgtcggaccctacccgactaacgaaagggaaaccgaccgacgtcccttaccccgtagaaccctagtccgaaccggtggggcctacggaaggggtaccgggaaagtacgtacgggacggtactacggtaacctttaacgttacggttaccggttaacccggtacccgggaacgtcggaccgtaggttcgacgttacggtaaccggtagggttcggttaacggttccggggaccgggttacccgggtaaccccgttacggtcggtaccccggtttacggttcgggttaccgaacccggtaccccggaacggtcccgtacccggttcccccgttggccccttaacccg

SEQ ID NO: 384070 - DNA, 682 bp, Homo sapiens
  misc_feature: GZ8MTXP01CLINJ.17.27.C05.1.454.CMB.2.raw
  modified_base (243)..(243): a, c, t, g, unknown or other
  modified_base (470)..(470): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctggtggccttggacagacagtcaggatcaacatcggaccggaggacgaacagccctanaagaaacgtcttaatatgactaaggtcgaacagacaagaacgccgaggacacgccctagtactgtatattagaggtaacaacgtaccggcctagaacggactacccgagtaacccctattcgtcgtcggacctaacccgactaaccgaaagggaaacacctacgtccctttaccccgagaaccctacgtacgacggtacggggaccgtagacggggaaggtaaacgngtacggacgtactacgtaacttacgttaccggtaacggtaaacccggccgggaaatacggtacgtacggtcgtaccgtacgtaccgggtagggttaccgggtacggtaaccggggaccggaccggtacccgttccggtacggtaccgttagttaccggacctaacccggaccgtaaccggccgtccccggttacccgtcgttcccgtaaccg

SEQ ID NO: 384071 - DNA, 643 bp, Homo sapiens
  misc_feature: GZ8MTXP01BMUL3.17.27.C05.1.454.CMB.2.raw
  modified_base (88)..(88): a, c, t, g, unknown or other
  modified_base (227)..(227): a, c, t, g, unknown or other
  modified_base (235)..(235): a, c, t, g, unknown or other
  modified_base (249)..(249): a, c, t, g, unknown or other
  modified_base (270)..(270): a, c, t, g, unknown or other
  modified_base (295)..(295): a, c, t, g, unknown or other
  modified_base (388)..(388): a, c, t, g, unknown or other
tcagcgtagactagcacgaccggtgctcgatttagacgcgatcgaagggtttggggagctgtgggctcagaagcagagttctggggtntctccaccatggcctggacccctctctggctcactctcctcactctttgcataggttctgtggtttctctgagctgactcaggatcctgctgtgtctggtggccttgggacagacagtcaggatcacatgaccgagganacagcctnaagaagcttattangactaaggtgacagcaagacnccgaggacacggcccctagtacttnactatttagaggtaaacaactaacccggcctagaggacctacccgagtaccccgtattcctcgtcggtccctaaccgactcgaaaggtaaacncctacgtcccttaccgacgaactactcgacgtcgggctacgaggaacgaagtagtacgctatactaacttaccgtacgggtaacccgtcgggaactacggactagtcgacgtacggtaaccgtagggttacggtacggttccggggaaccgggtaaccggacccctacgttacggttaccggtacgtttacgggaccaccggttaacccgagggtccctccccggtacccgttcggtaaccttcccgtttcccgg

SEQ ID NO: 384072 - DNA, 641 bp, Homo sapiens
  misc_feature: GZ8MTXP01DG0LE.17.27.C05.1.454.CMB.2.raw
  modified_base (264)..(264): a, c, t, g, unknown or other
  modified_base (271)..(271): a, c, t, g, unknown or other
  modified_base (287)..(287): a, c, t, g, unknown or other
  modified_base (443)..(443): a, c, t, g, unknown or other
tcagcgtagactagcacgaccggtgctcgatttagacgcgatcgaagggtttggggacataacaaccacattcctcctctaaagaagcccctgggagcacagctcatcaccatggactggacctggaggttcctctttgtggtggcagcagctacaggtgtccagtcccaggtgcagctggtgcagtctggggctggaggtgaagagcctgggtcctcggtgagggtctccgtgcaaggcttctgcaggcctacttagcaactntgtcttnagcgtgggtcgcgacncggccccgtgaacgaggtctgagtggagtggggaggtatcacttcctagttccgtagggactaacggtaacggtactaccgtaacgaaggtaaaacgttccgaaggactaaacgtccaaccgtaacgttaccggacggtacgaactccgaacgganacctaacgacgtaccctagtagtttacggagttcgagactaccggctacgaagtacgtacgtaggaaccggacgtacggtaccgttgttacgttaccgtgggtcgaacggtaacgggttacgggtaccgaagtaaacgacgttaaggcggttagtaaggtaaggtgggtaacttgtttagtttgttttaaccgtaagg

SEQ ID NO: 384073 - DNA, 660 bp, Homo sapiens
  misc_feature: GZ8MTXP01CZTVI.17.27.C05.1.454.CMB.2.raw
  modified_base (235)..(235): a, c, t, g, unknown or other
  modified_base (244)..(244): a, c, t, g, unknown or other
  modified_base (283)..(283): a, c, t, g, unknown or other
  modified_base (326)..(326): a, c, t, g, unknown or other
  modified_base (481)..(481): a, c, t, g, unknown or other
  modified_base (528)..(528): a, c, t, g, unknown or other
  modified_base (534)..(534): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgttggttttcttctgagctgactcaggatcctgctgtgtctgtggccttggacagacagtcaggatcacatgcgaggagacagcctanaagaacgtntaattagacgactaaaggtcggaaccagacaaaggaacnccgaaggactacggccctagtactgtactatttagaggtaaanaaacgtaaccggccctagaacgggtactaccccgaaggtaacccctatttcgcgttacggccctaacccggaacaacgaaaggggaaaacgactacgtcccttaccccgagaaaccctacgtaccgaggtcggggacacgaagggacgtaaaganacgggaagtcgtactaacttacgtacggtaacggtaaccgccggaanacgtgngtacgacgtacgtaacgtagggtacggtaccggtcggaaccgggaccggacccttacgtacggtaccgttacgttacgaccgaaccgaccgtcggtcccgtccccgttacccgtcgttcctaaccg

SEQ ID NO: 384074 - DNA, 608 bp, Homo sapiens
  misc_feature: GZ8MTXP01BOQWZ.17.27.C05.1.454.CMB.2.raw
  modified_base (215)..(215): a, c, t, g, unknown or other
  modified_base (234)..(234): a, c, t, g, unknown or other
  modified_base (280)..(280): a, c, t, g, unknown or other
  modified_base (311)..(311): a, c, t, g, unknown or other
  modified_base (407)..(407): a, c, t, g, unknown or other
  modified_base (537)..(537): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcanatgccgagacacagcctanagaagtcttatagtgactaagtcggaacagcaagaacgccaggacncgccctgtacttgtctatttagacggtaaanaaccgtaaccggcctagacggtaccacccgaggacccctattcgtacgtcggccctaaccgactaacgaagtaaacgctacgaccttcgacgaccncgtacacggtgggactaggaggaacgagagtggacgtctagtactacgttacgttacggtaaccgtccggaagaccgagtcgtcggtactacgtcggtaaggtcggtaacggtcggacggacccggaccncggtacgtacgttacgttcccggactaaccggcccgtaacgtcccgtcccgcccgttcggttaaccctccg

SEQ ID NO: 384075 - DNA, 650 bp, Homo sapiens
  misc_feature: GZ8MTXP01AOS6R.17.27.C05.1.454.CMB.2.raw
  modified_base (249)..(249): a, c, t, g, unknown or other
  modified_base (373)..(373): a, c, t, g, unknown or other
  modified_base (453)..(453): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggttttcttctgagctgactcaggatcctgctgtgtctgtggccgttgggacagacagtcaggatcacagtcgccgaggacacacgcctacaagaacgtntaattactggtactaaggttcggaccagacaagaacgccaggtacacggcccctagtactgtactatttacgtagtaaagacgtacccggcctagacggactcccacggaaccctcttcgtcgnggtacctaccgaactcgaacggaaacgctacgtacgttcccagtacccagtcgtacgcgggtcaccggaggacggtaagngtcgagtctacgtactacgtacggtaacgtaaccggaccggacacgacgtacgttacgacgttacggtaccggtagggttcggtacgggtccgggaacgggacccggtacccgttaccggtaacggtaccggttacgttccggaccgtaaccggacccgtaaccggtccctcccggttacccgtcgttaaccgtccg

SEQ ID NO: 384076 - DNA, 601 bp, Homo sapiens
  misc_feature: GZ8MTXP01E07XC.17.27.C05.1.454.CMB.2.raw
  modified_base (183)..(183): a, c, t, g, unknown or other
  modified_base (234)..(234): a, c, t, g, unknown or other
  modified_base (298)..(298): a, c, t, g, unknown or other
  modified_base (305)..(305): a, c, t, g, unknown or other
  modified_base (320)..(320): a, c, t, g, unknown or other
  modified_base (560)..(560): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtntctgtggccttgggacagacagtcaggatcacatgccgaggagacagcctnagaagctattatgacagtcggtaccagacagaagccaaggacagcccctgtacttgtcatttanaggtaanaagtaacccggcctnagggactcccagacccccgtattcactggacctcccgactcgaaaggaaacgacacggctttcccgcacactacacgtagggcctacgagggaccggaagaataggaggacctgtaaactactttacggtacgtaaaccgtccccggggacaacgcctaagggtcgcctaggaaccctagggtacggtaagttcgggacggacggggaaccccttaccgcgaacccgttgttacgggccngacccgtaacggcctccggacccccgttggttcctaacccg

SEQ ID NO: 384077 - DNA, 669 bp, Homo sapiens
  misc_feature: GZ8MTXP01DJLDY.17.27.C05.1.454.CMB.2.raw
  modified_base (604)..(604): a, c, t, g, unknown or other
  modified_base (626)..(626): a, c, t, g, unknown or other
tcagcgtagactagcacgaccggtgctcgatttagacgcgatcgaagggtttggggacataacaaccacattcctcctctaaagaagcccctgggagcacagctcatcaccatggactggacctggaggttcctctttgtggtggcagcagctacaggtgtccagtcccaggtgcagctggtgcgagtcgtggggctggaggtagaagacgccgtgggtccgtggtgaggtctcctgacgaggtcttcgtgcgacggtccttaccgtttagactaacttagtcgtcttcgaggtcgtaggggtcgaccggtaccgacccggtaccccgtagggaaccggtaaggggtcgttagggagggttagggtaggtacgggggaggtacctttacgtaccgtttaccgtacgttcccggttaagggaaccgtaaaggtaacggtactacccgaacgtaacggtaaaccgttacggaacgggaacctaaacgtcccaccgtacgtaacccgggacgtaaaccgactacgacgtacgacacgacgtacctacgtagtgaacgtgaacgcacgcctagagtactgaggacgcgtacggtcttagtactcgtgnggaacgaggcgggacagaacgngttagcgagtaaggtagtaaggtattgttatttcgttgtaacg

SEQ ID NO: 384078 - DNA, 635 bp, Homo sapiens
  misc_feature: GZ8MTXP01ANCJ4.17.27.C05.1.454.CMB.2.raw
  modified_base (113)..(113): a, c, t, g, unknown or other
  modified_base (259)..(259): a, c, t, g, unknown or other
tcagcgtagactagcacgaccggtgctcgatttagacgcgatcgaagggtttggggagctgtgggctcagaagcagagttctgggggtgtctccaccatggcctggacccctntctggctcactctcctcactctttgcataggttctgtggtttctctgagctgactcaggatcctgctgtgtctgtggccttgggacagacagtcaggtatcaacagtggaccgaaggacgtacagccctagaagaacgctaattangactaaggtggtaccagcaagaacgccaaggaccacggtcccctagtacttgtactattttaagaggtaaagaacgtaacccggtccctagaacgggacctacccgagtaccccgtattctcgtcggtccgtaacccacgtcgaaaggaaacgaccacgttcctaccgtagaaccctacgttccgacggttacggggccttacggaacggggtacggaaagtgtcggacggtctacggtaacttacgttacggtacgttaaacccgcccggaacgagccgtagtccgactacgtaccgtaggtcggtacgtcggggcggttacgggacccagtcgacgttcgttcgcaacgccgtaagcctccggccctgctaacc

SEQ ID NO: 384079 - DNA, 786 bp, Homo sapiens
  misc_feature: GZ8MTXP01CIES1.17.27.C05.1.454.CMB.2.raw
  modified_base (226)..(226): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcagatcacatgaccgagganacagcctacagaagctaattatcgactaaggttcgtaaccaggacaaggtaacgccgaaggaacctacgggacccccttggttaacctttacgtacgtaaactttttaagtagggtaaaacaaacggttaaccccggtcccgtaacgaacgggtaacctaccccaacggtaaccccgtatttccgacggttcggaccttaacccgtaaccgttaacgaaaacggggtaaaactaccgtaacgtccctttacccccgaaggtaacccctaataccgtaccggttacgggggaccgttacgaaacgggggtaaccggtaaaggacgttacgggacggttacgacgttaaccgttaaacgttaaccggttaaccggtaaaccggttaccccggggaacgttaaccggcgttaaacggtcgtacccgttggaccccggtaaggttcgggtacggttaaccggaccgggggaacggaccccgttaaacggtccggaccgtttacgttaaccgggccaaccggtacccgaacggtccccgtaccgccccgttaacgcccgtaaccc

SEQ ID NO: 384080 - DNA, 548 bp, Homo sapiens
  misc_feature: GZ8MTXP02H8EXY.17.27.C05.1.454.CMB.2.raw
  modified_base (355)..(355): a, c, t, g, unknown or other
  modified_base (366)..(366): a, c, t, g, unknown or other
tcagcgtagactagcacgaccggtgctcgatttagacgcgatcgaagggtttgggagctgtgggctcagaagcagagttctgggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctatatgcaagttggaccagcagagccaggacaggcccctgtactgtcatttatggtaagataaccggcctagagggactcccagaccccgattctctggctccgactcaaggaaacncagccttcccngacccatcacgtggggctcgaggcggaagagtgaggctagactattacgtgtaactccgggacagcgagtgcgtgaccgaggtcgtacgttcgggacgggtacggacccctaccgtacggacccgttcgttacggtccgaacgacccgaacgggtcctaccggccccctcggttaccacccg

SEQ ID NO: 384081 - DNA, 571 bp, Homo sapiens
  misc_feature: GZ8MTXP02JA5UC.17.27.C05.1.454.CMB.2.raw
  modified_base (233)..(233): a, c, t, g, unknown or other
  modified_base (305)..(305): a, c, t, g, unknown or other
  modified_base (388)..(388): a, c, t, g, unknown or other
  modified_base (417)..(417): a, c, t, g, unknown or other
  modified_base (548)..(548): a, c, t, g, unknown or other
tcagcgtagactagcacgaccggtgctcgatttagacgcgatcgaagggtttgggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctnagaagctattatgcaagttgtaccagcagaagccaggacaggcccctgtacttgtacattttataggtaaanaactaaacccggccctacgagggtactccccgagaccccgtattcctctggctcccgactcgaagaaacgacacgtcttcccngaccatcacgtgggctcgaggacggaagngtagacggctagactattactagtaaccgcccgggtacagcagtgcgtagaccgagggtgtagttccgggacggtacgggacccaccgtacggacccgttacgttacggtacgaacgacccgaacggtccnccgtcccccgtcggtacctcccg

SEQ ID NO: 384082 - DNA, 514 bp, Homo sapiens
  misc_feature: GZ8MTXP02I4RKN.17.27.C05.1.454.CMB.2.raw
  modified_base (371)..(371): a, c, t, g, unknown or other
  modified_base (428)..(428): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcaggggactcccagaccccgattctctcggctccgactcagaaagacagcttccngaccatcactggggctcgagcgaagatgaggctgactattactgtaactcccggganagcagtgctgaccaggtgtatcgggcggacgggacccacgtcgaccgtctaggcaacgcccaaggcctcgcccctcggtcctaccg

SEQ ID NO: 384083 - DNA, 542 bp, Homo sapiens
  misc_feature: GZ8MTXP02F9FVV.17.27.C05.1.454.CMB.2.raw
  modified_base (303)..(303): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaanaataacccggcctcgagggactccccagaccccgattctctggctccgactcgaaggaaacacagccttcctgaccatcacgtggggctcgaggacggaagagtggagctagacttattacgtgtaaccgtccgggacagcagtgctagaccgaggtcggtagttcggacggtacgggacccacgtcgtaccgtacgtacggtcaacgcccgaacggctcgcccccgtcggtcctaccg

SEQ ID NO: 384084 - DNA, 526 bp, Homo sapiens
  misc_feature: GZ8MTXP02HMLCG.17.27.C05.1.454.CMB.2.raw
  modified_base (455)..(455): a, c, t, g, unknown or other
  modified_base (483)..(483): a, c, t, g, unknown or other
  modified_base (510)..(510): a, c, t, g, unknown or other
tcagcgtagactagcacgaccggtgctcgatttagacgcgatcgaagggtttggggacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgagggtctcctgcaaggcttctgcaggcacctttagcaactatgctttcagctgggtgcgacaggcccctggacagggcttgagtggatggggaggatcattcctatccttggggactaggtaaggtactccaacagaacgttcccaggggccaaaaggtccaaccgattacccggcggaaccgaaactcccgaacgagacacagcctacattgagttgagcagcctcagatcngagacacggccgtgtatactgtgcgagngggtccgagacacgaagtgcaagtagnggatgtatgttttgag

SEQ ID NO: 384085 - DNA, 539 bp, Homo sapiens
  misc_feature: GZ8MTXP02IS76S.17.27.C05.1.454.CMB.2.raw
  modified_base (294)..(294): a, c, t, g, unknown or other
  modified_base (300)..(300): a, c, t, g, unknown or other
  modified_base (335)..(335): a, c, t, g, unknown or other
  modified_base (415)..(415): a, c, t, g, unknown or other
tcagcgtagactagcacgaccggtgctcgatttagacgcgatcgaagggtttgggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtactgcatttanggtaanaataaccggcctcagggactcccagaccccgatcnctggctccgactcagaaagacagccttccagacccatcacgtggggactcgaggcggaagatgaaggctgaactattacngttaacctcccgggaacagacgagtcgctacgacgtaggtacgtacgtcgggacggacggaccctacgtacgaccgtacgtacgacgaacgaccgaacggtccgtccgccccgtcgtacctacg

SEQ ID NO: 384086 - DNA, 501 bp, Homo sapiens
  misc_feature: GZ8MTXP02JG6X1.17.27.C05.1.454.CMB.2.raw
  modified_base (298)..(298): a, c, t, g, unknown or other
  modified_base (311)..(311): a, c, t, g, unknown or other
  modified_base (355)..(355): a, c, t, g, unknown or other
  modified_base (364)..(364): a, c, t, g, unknown or other
  modified_base (397)..(397): a, c, t, g, unknown or other
tcagcgtagactagcacgaccggtgctcgatttagacgcgatcgaagggtttgggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggaccagcagaagccaggacaggcccctgtactgcattatggtaanaataaccggcctnagggatcccagaccccgattctctggctccgactcgaaggaaancagcttccngaccatcactggggctcgagcgaagatgaggcngactatactgtaactccggacagcagtcgctgacctagggtgtagttcgggcggagggacccacgtcgaccgtctaggcaagccaagctcgcccctcggactac

SEQ ID NO: 384087 - DNA, 591 bp, Homo sapiens
  misc_feature: GZ8MTXP02IIX58.17.27.C05.1.454.CMB.2.raw
  modified_base (303)..(303): a, c, t, g, unknown or other
  modified_base (372)..(372): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctacagaagctattatgcaagttggaccagcagaagccaggacaggcccctgtactgtcatttatggtaaanaaacgtaacccggcctacgagggactccccgagaccccgattcctcgtggcctccgactcgaaggaaancagccttccagaccatcacgtcggggctacgagggacggaagagtagaagggctaggaacttaattactacggttaaaccgtcccgggaacacgacgaacgtcgacgtaggaaccgagggtagtacgttcgggacgggtacgggaccctaccgtcgtacccgtcgttaacggccgaacggacccgaacggtcccgtccgcccccgtcggtacctacccg

SEQ ID NO: 384088 - DNA, 612 bp, Homo sapiens
  misc_feature: GZ8MTXP02IWGRR.17.27.C05.1.454.CMB.2.raw
  modified_base (473)..(473): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctatatgacaagttggtaccagcaagaagccaaggacacggcccctgtacttgtactatttataggtaaagaactaacccggcctacgaagggactccgaagaccccgtattctcgtcggcctaccgactcgaaggaaacgacacgccttacccagacccatccgacgtcggggctacgagggacgaagagtggaggctagactagttaccgtacgtaaccgtaccccgggaanacgacgagtcgacgtacggaccgtagggtacggtacggtcggggacggaaccggaccctacggtacggtaccgttacgttacggaccgaaccggaccccgtaacggtcccgtcccggtcccccgtacggtaccctaccg

SEQ ID NO: 384089 - DNA, 560 bp, Homo sapiens
  misc_feature: GZ8MTXP02GRB1N.17.27.C05.1.454.CMB.2.raw
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtctatttataggtaagaactaacccggccctacgagggactccccagaccccgattctctggcctccgactcgaagaaagacagccttcctgacccatcacgtgggctcgaggacggaagatggagctagaacttattacgtacgtaaccgtcccgggacagcagtgcacgaccgaggtacgtacgtcgggacggtacgggacccacgtcgacccgtcgttacggtcaacggtacccgaacggtccgtccgcccccgtcggtacctacccg

SEQ ID NO: 384090 - DNA, 595 bp, Homo sapiens
  misc_feature: GZ8MTXP02H8652.17.27.C05.1.454.CMB.2.raw
  modified_base (289)..(289): a, c, t, g, unknown or other
  modified_base (297)..(297): a, c, t, g, unknown or other
  modified_base (440)..(440): a, c, t, g, unknown or other
tcagcgtagactagcacgaccggtgctcgatttagacgcgatcgaagggtttggggagctgtgggctcagaagcagagttctggggtgtctccaccatggcctggacccctctctgactcactctcctcactctttgcataggttctgtggtttcttctgagctgactcaggatcctgctgtgtctgtggccttgggacagacagtcaggatcacatgccgaggagacagcctcagaagctatatgcaagttgaccagcagagccagacaggcccctgtctgtcattanaggtaaanaactaaaccggcctagagggactcccgagaccccgattctctggctccgactcgaagaaagcagccttcccagaccatcacgtcgggctacgaggacggaagagtagagctagacttagttactagtaaaccgtcccgggaanacgacgagtcgacgtacgaacggtagggtacggtacggttcggggacgggaaccgggaacccgtaccggtacggtaacccgtttacggttaacggtaccgaaccggaacccgaacggtcccgtacccggtacccccgttacggttaccctacccg

SEQ ID NO: 384091 - DNA, 569 bp, Homo sapiens
  misc_feature: GZ8MTXP02HJW6O.17.27.C05.1.454.CMB.2.raw
  modified_base (470)..(470): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctatatgcagttgaccagcagaagccaggacaggcccctgtactgtctatttagtaggtaaagaactaacccggccctacgaggggactccccgaagaccccgtacttccgtcgtcggcctcccggactcgaagggaaacgaccacgtcccttcccagacccatccgacgtcggggctcgagggacgaagagtggacggctagacttattacgtacgtaaccgcccggganagcgagtgctgaccgtaggtgtacgtcgggacggacgggacccacgtacgaccgtcgttacgcaacgacccgacggcctccgcccccgtcggtcctccg

SEQ ID NO: 384092 - DNA, 659 bp, Homo sapiens
  misc_feature: GZ8MTXP02JBQK0.17.27.C05.1.454.CMB.2.raw
  modified_base (234)..(234): a, c, t, g, unknown or other
  modified_base (294)..(294): a, c, t, g, unknown or other
  modified_base (301)..(301): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctnagagctattatgcaagttggaccagcagaagccaggacaggcccctgtactgtcatttanaggtaanaataccggcctgagggactaccagaccccgtattctcgtacggcctaccggactcgaagggaaaacaccgaacggtccttaccccgtagaaacccctaacgtcccgaacggttcgggggccttaccggaacgggggacggaaacggagtacgggaacggggactagggtaacctttaagtttaccgtacggttaaacccgtaccccgggggaactaacggaccgtaggtcgaccgtacggaacccgtagggtacggtacgttacgggacgggtaccgggaccccgtacgtacggtacccgtacgttacggtaccaacggtcccgaaacggtccgtccgacccccgtcggacctacccg

SEQ ID NO: 384093 - DNA, 611 bp, Homo sapiens
  misc_feature: GZ8MTXP02HR7R7.17.27.C05.1.454.CMB.2.raw
  modified_base (226)..(226): a, c, t, g, unknown or other
  modified_base (234)..(234): a, c, t, g, unknown or other
  modified_base (373)..(373): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgagganacagcctnagaagctattatgcaagttggaccagcagaagccaggacaggcccctgtactgtactatttagaggtaaagaacgtaaccggcctagaggtacctccgacgaccccgtattcgtcgtcgctaccgatcgaagggaaacncacgtccttccagacctatcgacggtcgggcctacggaggacggaagtacgtacggaggtacctaggtaaacctttagttaccgtaggtttaaacccgccggaacgacggtcgaacgttcgacgttacgaaccgtggggttacgtaacggttcgggacgggtaccggacccacggttcgtaaccgttcgttacggcgaaccgccgaacgtcccgtaccgtccccgtcggtacctaccg

SEQ ID NO: 384094 - DNA, 567 bp, Homo sapiens
  misc_feature: GZ8MTXP02HG4YR.17.27.C05.1.454.CMB.2.raw
  modified_base (384)..(384): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttgtaccagcagaagccaggacaggcccctgtacttgtctatttatggtaaagaactaacccggccctacgaagggactcccgagaccccgtattcctctggcctccgactcgaaggaaagacagccttcccngaccactcacgtggggctacgaggacggaagagtggaggctagtacttatttacgtaggttaaccgtcccgggacacgcgagtcgcgtcgaccgtagggtgtacgtcgggcggacgggacccacgtcgaccgtcgttacggtcaacgtcccgaacggtcctccgcccccgtcggtacctaccg

SEQ ID NO: 384095 - DNA, 559 bp, Homo sapiens
  misc_feature: GZ8MTXP02IZDGZ.17.27.C05.1.454.CMB.2.raw
  modified_base (294)..(294): a, c, t, g, unknown or other
  modified_base (445)..(445): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttgaccagcagaagccaggacaggcccctgtactgtcatttanggtaagaataaccggcctcgagggactcccagaccccgattctctaggctccgactcaggaaacacagccttccctgaccctatccacgtcggggactcgaaggcggaagatgaggctagacgtattacgacgttaaccgtacccgggaanacgcgtagtcgacgtacgacgtaggtgtacggtcgggacggaccggacccgtacgtacgtaccgtacgtacgacgaaccgaccgaacggccctaccggccccgtcggtacctcg

SEQ ID NO: 384096 - DNA, 500 bp, Homo sapiens
  misc_feature: GZ8MTXP02HABVL.17.27.C05.1.454.CMB.2.raw
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtactgtcatttatggtaagaataaaccggcctcagggatccagaccccgattctctggctccgactcagaaagcagctcctgaccatcactggggctcagcggaagatgaggctgactatactgtaactccgggacagcagtgctgaccagtgtattcggcggaggcccaaccgtggaccgtcgtaggtcaagcccaaggctcgcccctcggtcacc

SEQ ID NO: 384097 - DNA, 631 bp, Homo sapiens
  misc_feature: GZ8MTXP02H7INO.17.27.C05.1.454.CMB.2.raw
  modified_base (109)..(109): a, c, t, g, unknown or other
  modified_base (207)..(207): a, c, t, g, unknown or other
  modified_base (223)..(223): a, c, t, g, unknown or other
  modified_base (231)..(231): a, c, t, g, unknown or other
tcagcgtagactagcacgaccggtgctcgatttagacgcgatcgaagggtttgggagctgtggctcagaagcagagttctgggtgtctccaccatggcctggacccctntctggctcactctcctcactctttgcataggttctgtggtttctctgagctgactcaggatcctgctgtgtctgtggccttgggacagacagtcaggntccacatgccgagganacagcctnagaagctattatgcagttgaccagcaagaagccaggacacggcccctgtacttgtactatttataggtaagaacgtaacccggcctacgaaggggtactaccccgagaccccgtattcctcgtcggctcccgactcgaaggaaacgaccagtcccttaccagaccctaatcaccgtggggactacgaggacggtaagagtggaacgcctaggaacttaacgttaaccgtacgttaaaccgtccccggggaacaacgccgtaaggttcgacgtacggtacccgtagggtacggttaacgttccggggaccgggacgggaccccctacgtacggtaccgttacgttacggtaccgaaccggtacccgaacggtccctaccggcccccgtcgggtacctaccg

SEQ ID NO: 384098 - DNA, 584 bp, Homo sapiens
  misc_feature: GZ8MTXP02HZQ33.17.27.C05.1.454.CMB.2.raw
  modified_base (235)..(235): a, c, t, g, unknown or other
  modified_base (304)..(304): a, c, t, g, unknown or other
  modified_base (451)..(451): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggttttcttctgagctgactcaggatcctgctgtgtctgtggccttgggacagacagtcaggatcacatgccgaggagacagcctnagaagctattatgcaagttggaccagcagagccaggacacggcccctgtactgtacatttataggtaanaactaaccggcctagagggactcccagaccccgattcctctggctccgactcgaaggaaacgacacgtcctttcccagacccatccacgtcggggctacgaggacggaagatgaggctagacttattactacgtaaccgtcccgganacgcagtgcgtacgaccgtagggtcgttacgttcgggacgggtaaccgggacccctaacggtacgtacccgttacgttaacggacgaaccggacccgaaacggtcctaccgcccccgttacggtacctacccg

SEQ ID NO: 384099 - DNA, 519 bp, Homo sapiens
  misc_feature: GZ8MTXP02GLP8O.17.27.C05.1.454.CMB.2.raw
  modified_base (357)..(357): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggacagcagagcagacaggcccctgtactgtcatttatggtaagaataaccggcctacagggactcccagaccccgattctctggctccgactcgaaggaaacncagaccttcccagacccatcacgtggggctcgaggcggaagatgacggctagactacttactagtaacctccgggacagcagtgctgaccaggtgtagtcggcggaggacccacgtacgaccgtcgttaggccaagcccaaggcctcgccccgtcgtctccg

SEQ ID NO: 384100 - DNA, 681 bp, Homo sapiens
  misc_feature: GZ8MTXP02F5VU1.17.27.C05.1.454.CMB.2.raw
  modified_base (260)..(260): a, c, t, g, unknown or other
  modified_base (551)..(551): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctggtggccttgggacagacagtcgaggatcacagtcgaccggaggagacacgcctacgaagaagtcttaattagngactaaggttcggaaccagacaagaacgccgaaggacacggtcccctgttactgtactagtttagaggtaaacaacgtaacccggcctaggacggtacctacccgagtaccccgtactttccgcgtacgacctaccggtaactaccggaaaggaaaccgtaccaccgttacccctttaccgacgaaccctaacgtccgtaaccggtcgggggtacctacggaaggggacgaaagagtacggacgggtactacgtaaacttacgttaaccgtacgtaacccgacccgggaanacgacgagtcgtacgtacggtacggtagggtacgtacggtaccgggaccggaccggtacccgtacgtcggttaccgtacgtacgaccgaaccgacccgacggtcccgcccgtacccgtacgtaccctccg

SEQ ID NO: 384101 - DNA, 658 bp, Homo sapiens
  misc_feature: GZ8MTXP02FP6J2.17.27.C05.1.454.CMB.2.raw
  modified_base (226)..(226): a, c, t, g, unknown or other
  modified_base (234)..(234): a, c, t, g, unknown or other
  modified_base (304)..(304): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgagganacagcctnagaagctattatgcaagttggaccagcagaagccaggacaggcccctgtacttgtctatttagaggtaanaacgtaacccggcctacgagggactcccgagaccccgtattcctcgtacggccttacccgactacgaaagggaaacgacgacgtccctttacccgagaaccctagtaccgaaccggtcgggggcctacggaacgggacgggaagagtacgggacggtacgtacggtaacttaacttacgtacggttaaacccggtccccgggaaacgtacgaccgagttacggactacggaccgtagggtcgttaacggtcggggacgggacgggacccctacggtacggtacccgtttacgtacggtacccgaacggaccccgaaaggtcccgtacccggcccccgttacggtcccttacccg

SEQ ID NO: 384102 - DNA, 580 bp, Homo sapiens
  misc_feature: GZ8MTXP02J42KZ.17.27.C05.1.454.CMB.2.raw
  modified_base (224)..(224): a, c, t, g, unknown or other
  modified_base (232)..(232): a, c, t, g, unknown or other
  modified_base (290)..(290): a, c, t, g, unknown or other
  modified_base (328)..(328): a, c, t, g, unknown or other
  modified_base (345)..(345): a, c, t, g, unknown or other
  modified_base (360)..(360): a, c, t, g, unknown or other
tcagcgtagactagcacgaccggtgctcgatttagacgcgatcgaagggtttgggagctgtgggctcagaagcagagttctgggtgtctccaccatggcctggacccctctctggctcactctcctcactctttgcataggttctgtggtttcttctgagctgactcaggatcctgctgtgtctgtggccttgggacagacagtcaggatcacatgccgagganacagcctnagaagctattatgcaagttgaccagcagacgcagcaggcccctgtacttgtcatttanaggtacaactaccggccctacgaggtactccagacccnttctctaggctaccgancgaaggaaactaccnctcctcctcacacacgacggtcggcgacgaggaggaagagtagacgtacgtacgtacttaacttacgttacgtaccgtacccggacgacgacgacgtacgcgtacggtacgtacggtacggtacggtaccggtacggaccggacccgtaccgtaccgtaccgttaccgttacgtaccgaaccgaccgaccgtccgtcccgtccccgtcccgtaccgtccg

SEQ ID NO: 384103 - DNA, 526 bp, Homo sapiens
  misc_feature: GZ8MTXP02JCX3W.17.27.C05.1.454.CMB.2.raw
  modified_base (295)..(295): a, c, t, g, unknown or other
  modified_base (301)..(301): a, c, t, g, unknown or other
tcagcgtagactagcacgaccggtgctcgatttagacgcgatcgaagggtttgggagctgtgggctcagaagcagagttctggggtgtctccaccatggcctgaacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcattanggtaanaataaccggcctcagggatcccagaccccgattctctggctccgactcaggaaacgacagcttacctgaccatcactggggctcgaggcgaagatgaggctgactattactacgtaacgtcccgggacacgcgagtgctgaccaggtgtagttcgggacggacgggacccaccgtcgaccgtcgttaggcaacgcccgaacggcctcgccccctcggtcctaccg

SEQ ID NO: 384104 - DNA, 625 bp, Homo sapiens
  misc_feature: GZ8MTXP02FR7UJ.17.27.C05.1.454.CMB.2.raw
  modified_base (111)..(111): a, c, t, g, unknown or other
  modified_base (233)..(233): a, c, t, g, unknown or other
  modified_base (237)..(237): a, c, t, g, unknown or other
  modified_base (242)..(242): a, c, t, g, unknown or other
  modified_base (251)..(251): a, c, t, g, unknown or other
  modified_base (257)..(257): a, c, t, g, unknown or other
  modified_base (263)..(263): a, c, t, g, unknown or other
  modified_base (293)..(293): a, c, t, g, unknown or other
  modified_base (333)..(333): a, c, t, g, unknown or other
tcagcgtagactagcacgaccggtgctcgatttagacgcgatcgaagggtttgggagctgtgggctcagaagcagagttctggggtgtctccaccatggcctggacccctntctggctcactctcctcactctttgcataggttctgtggtttctctgagctgactcaggatcctgctgtgtctgtggccttgggacagacagtcaggatcacatcgccgaggacacagcctnaganctatngcagtgacngcagancagacncggtccctgtactgctagtttagaggtaanacgtaaccggccttagaggtactccgagtacccgtattcncgtcgctccgactcgaacggaacacacgtccttaccgagtaccctagtccgtaacggtcggggacttacggacggtacggaacgtacgtaggacggtactacgtaacttacgttacgtacggtaaccgtacccgggtacacggtaccgtaggtacgtaccgtaacggaacccggttaggttacgggttacgttaccggggacggtaaaccggtacccgtacggttcggtaaccgttcgtacggtaccgaacgtacccgtaacgtccgtaccgtacccgtcggtactacccgg

SEQ ID NO: 384105 - DNA, 535 bp, Homo sapiens
  misc_feature: GZ8MTXP02I40OD.17.27.C05.1.454.CMB.2.raw
  modified_base (435)..(435): a, c, t, g, unknown or other
tcagcgtagactagcacgaccggtgctcgatttagacgcgatcgaagggtttggggacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgagggtctcctgcaaggcttctgcaggcacctttagcaactatgctttcagctgggtgcgacaggcccctggacaagggcttgagtggagtgggagggatcattcctatccttgggacagtacggtatccacagaacgttccaggggacaaagtcaccagttaccgacgacgaactccacgagcacagcctacacttgagttgagcgagccctnagatcgtagacggacacgggccgtagtacgttactgtgacggaggacgggtcgagacgacaagtggactaagtaggtaggattgttattggttttgtaag

SEQ ID NO: 384106 - DNA, 614 bp, Homo sapiens
  misc_feature: GZ8MTXP02I8ZXT.17.27.C05.1.454.CMB.2.raw
  modified_base (234)..(234): a, c, t, g, unknown or other
  modified_base (245)..(245): a, c, t, g, unknown or other
  modified_base (295)..(295): a, c, t, g, unknown or other
  modified_base (303)..(303): a, c, t, g, unknown or other
  modified_base (349)..(349): a, c, t, g, unknown or other
  modified_base (482)..(482): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctnagaagctatangacagttggacagcagaagccaggacaggcccctgtacttgtctatttangggtaaanaactaacccggccctagacgggactcccgaacgaccccgatttccncgtcggacctaccgactacgaaacggaaacgacacgtccttacccgacgaacctactccgacggtcggggactacggagggacggaagacgtggacgtctagtacttagttacgtacgtaaccgacccggganacgcgagtcgtacgacgacgtagggtcggtacgtacggggacgggaccggacccgtacgtacggtaccggttcgttaacggaccgaaccggacccgaacggtcccgtcccgtcccccgtacggtacctaccg

SEQ ID NO: 384107 - DNA, 533 bp, Homo sapiens
  misc_feature: GZ8MTXP02JE5VB.17.27.C05.1.454.CMB.2.raw
  modified_base (226)..(226): a, c, t, g, unknown or other
  modified_base (234)..(234): a, c, t, g, unknown or other
  modified_base (293)..(293): a, c, t, g, unknown or other
  modified_base (300)..(300): a, c, t, g, unknown or other
  modified_base (332)..(332): a, c, t, g, unknown or other
  modified_base (428)..(428): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgagganacagcctnagaagctattatgacagttggaccagcagaagccagacaggcccctgtactgctattanaggtaanaataccggcctgaggactccagacccgattcnctcgcctcgactcaaggaacacagccttccagaccatcacgtgggctacgaggcgaagagtaggagctagacttatacgtacgaccgtaccggganacgcagtcgctacgacgaggtacgtagtcgggcggtacggacccacgtcggtaccgtcgtaacgtcgaacgaccgaacggtccgccgcccccgtacggcctaccg

SEQ ID NO: 384108 - DNA, 687 bp, Homo sapiens
  misc_feature: GZ8MTXP02IL1HA.17.27.C05.1.454.CMB.2.raw
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcaagaagctattatgacaagttggtaccagcaagaagccaggacacggcccctgtacttgtctatttataggtaataacgtaacccggccctacgacggggacctacccgaggtaaccccgtattcctcgtcggcctacccgactccgaaagggaaacgaccacgtcccttacccgacgaaccctataccgaacgtcgggggacctcggaaggggtacgggaaagtagtcggacgggtactaggtaaacctttaagtttaccgtaacggttaaacccggtaccccggggaactacggaccgaggttacgacgtacgaaccggtaggggtacgtaacggttccggggacgggtaaccgggacccctaacggtaccggtaccggttaccgtttaacggacccgaacggtacccccgaaacgggtccctcccggtacccccgttcggtacctccccg

SEQ ID NO: 384109 - DNA, 626 bp, Homo sapiens
  misc_feature: GZ8MTXP02GD9GN.17.27.C05.1.454.CMB.2.raw
  modified_base (234)..(234): a, c, t, g, unknown or other
  modified_base (246)..(246): a, c, t, g, unknown or other
  modified_base (356)..(356): a, c, t, g, unknown or other
  modified_base (476)..(476): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctnagaagctattangactaagttggaccagcagagccaggacacggcccctgtacttgtactatttagtaggtaaagaactaacccggccctacgaagggactacccgagtaccccgtattccncgtcggcctccgactcgaagggaaacgccagtcccttcctacgacccatcgacgtcggggctacgagggacggaagagtggagctagaaacttattacgtacggtaaccgtcccgggaanacgacgaggtcgacgtacggaaccgtaggggtacggttacggttaccggggaccgggaaccggggtacccctaccggtacggtacccgttcgttaacggtaccgaacggtacccgacggtccctcccggcccccgttacggtcctacccg

SEQ ID NO: 384110 - DNA, 626 bp, Homo sapiens
  misc_feature: GZ8MTXP02IF739.17.27.C05.1.454.CMB.2.raw
tcagcgtagactagcacgaccggtgctcgatttagacgcgatcgaagggtttgggacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgagggtctcctgcaaggcttctgcaggctacctttagcaactatgctttcagtctgggtgcgacgacggccccgtaggacgaagggtcttagaggtggagtggggaggtatctattcctagtccgttgggactaggtaagtactaccgacgtaaggtaacgttaccgaggggaactaaaacggtccaacccgtaacgttacccggacggtaacgaaactaccgaacgacgacacacgactacattagacgttgagcacgcctacgagatcgtagacggaccgtacggtccgtagttaacgttaccgtggtacggtcggtaacggggtacggggtaccggaagaaccgaacgtaacgtacggacgtaaggtaggtaggtaagtagtttacgtttagttttagtaacg

SEQ ID NO: 384111 - DNA, 582 bp, Homo sapiens
  misc_feature: GZ8MTXP02I5E6Y.17.27.C05.1.454.CMB.2.raw
  modified_base (249)..(249): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcacttctttgcataggttctgtggtttcttctgagctgactcaggatcctgctgtgtctgtggccttgggacagacagtcaggatcaacatgccgaggagacagcctacagaagctattangacaagttggaccagcagaagccaggacaggcccctgtacttgtctatttagaggtaaagaactaaccggcctagaacgggactaccccgaagaccccgtattccgtactcggcctaccgactcgaaggaaacgacagtccttccagaccactcgacgtcgggctacgaggacgagagtagacgctagactattacgtacgtaacgtaccgggacagacgagtcgctcgaccgtaggtagtacgtcgggacggacggacccacgtcggacccgttacgtacggtccgaacggtcccgaaacggtccgtaccgtccccgtacggtacctacccg

SEQ ID NO: 384112 - DNA, 651 bp, Homo sapiens
  misc_feature: GZ8MTXP02GNXFV.17.27.C05.1.454.CMB.2.raw
  modified_base (246)..(246): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattangcaagttgaccagcagagccaggacacggcccctgtacttgtactatttagtaggtaaacaacgtaaccccggcctacggaagggacctaccccgagtaccccccgtatttccgtcgtacggcccttacccgactccgaaaggaaacgacacgtccttacccagacccataccgacggtcggggactacgacgggacggaagagtggaaggactacgtaacttactaacgtacgttaacccgacccgggaacacgtactaggtcgcgttacgaaccgtagggtacggttacgtaccggggaccgggaaaccgggtaccctaacggttcggtaacccgttcgttaaccggccgaaccggtacccgaaacgggtccctcccggtacccccgttaccggtcctacccg

SEQ ID NO: 384113 - DNA, 581 bp, Homo sapiens
  misc_feature: GZ8MTXP02IOY5G.17.27.C05.1.454.CMB.2.raw
  modified_base (394)..(394): a, c, t, g, unknown or other
  modified_base (461)..(461): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacacggcccctgtacttgtctatttagtaggtaaagaaactaacccggccctacgagggactaccccgagaccccgattcctcgtcggcctcccgactcgaagggaaacacacgtccttccngaccatcacgtggggctcgagggacgaagatgagctagacttattacgtacgtaaccgtcccggganacgcaggtcgcgtagaccgtaggtcggtagttcggggacggacggacccaccgtacggaccgttacgttacggtaccaacggccccgaacggtcctccgtcccccgtacggtcctacccg

SEQ ID NO: 384114 - DNA, 546 bp, Homo sapiens
  misc_feature: GZ8MTXP02FOIIS.17.27.C05.1.454.CMB.2.raw
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctatatgcaagttgtaccagcagaagccaggacaggcccctgtacttgtcatttatggtaagaactaacccggcctcgagggactccccgagaccccgattctctggctccgactcgaaggaaacgacacgccttccctgacccatcacgtggggactcgagacgagatgagctgactatactacgtacgtccggacagcgagtgcgtgaccgaggtgtacgttcggcgggtacggacccaccgtacggacccgttcgttacggtcaacgacccgaacggtcctccgcccccgtccggtcctacccg

SEQ ID NO: 384115 - DNA, 633 bp, Homo sapiens
  misc_feature: GZ8MTXP02GTWEM.17.27.C05.1.454.CMB.2.raw
tcagcgtagactagcacgaccggtgctcgatttagacgcgatcgaagggtttggggacataacaaccacattcctcctctaaagaagcccctgggagcacagctcatcaccatggactggacctggaggttcctctttgtggtggcagcagctacaggtgtccagtcccaggtgcagctggtgcagtctgggctgaggtgaagaagcctgggtcctcggtgagggtctcctgcaaggcttctgcaggcacctttagcaactatgctttcagtcgtgggtgcgacgacggccccctggacgaagggtcttggaggtggagtggggaggatctattcctagtccgtaggacaggtaagtactaccacgagtaacgttccgagggacaaacggtccaacctacgttaaccggacgggtaaccgaaactcccgaacggaacgaccaaccgaacgtccctaactagtttacgaaggttagacggacacgtaccgttacgaagtactacgtacggaacgggaccgtaaccggggtccgtagttacgttaccgtggtacggaccggaagggtaccgggtaccggaagaacgacgaacgtggacgtaaggtaggtaggtattgtatttacggttttagaag

SEQ ID NO: 384116 - DNA, 570 bp, Homo sapiens
  misc_feature: GZ8MTXP02I2822.17.27.C05.1.454.CMB.2.raw
  modified_base (379)..(379): a, c, t, g, unknown or other
  modified_base (464)..(464): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtctatttatggtaagaactaaccggccctacgaagggactcccgagaccccgtattctcgtggctccgactcgagaaagacagtcctccngaccatcacgtgggctacgaggacgaagacgtggaggctagtacttattaacgtacgttaaccgtcccgggacacgccgaggtcncgtacgaccgtagggtgtacgtcgggacggaccggacccaacgtcgaccgttacgttacggtacaacgacccgaaggtcccgtccgcccccgtacggtcctacccg

SEQ ID NO: 384117 - DNA, 618 bp, Homo sapiens
  misc_feature: GZ8MTXP02H4ZFK.17.27.C05.1.454.CMB.2.raw
  modified_base (226)..(226): a, c, t, g, unknown or other
  modified_base (245)..(245): a, c, t, g, unknown or other
  modified_base (369)..(369): a, c, t, g, unknown or other
  modified_base (382)..(382): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgagganacagcctcagaagctatangcaagttgaccagcagagcagacagcccctgtactgctatttagtaggtaaagaactaacccggcctagaacggggactaccccgagacccccgattcctctggctccgactcaaagggaaacncagtccttcccgnacccatacacgtcggggctacgaggacggaagagtggaacgggtctagaaacttagttaacgtacgttaaaccgcccgggaacacggaccgaagttcgacgtcggaaccgtagggtacgggttaacgttccggggaccgggtacggggaacccctaccggtacggtacccgttacgtttaacggaccgaaccggacccgaacgggcctcccgccccccgttcggtaccctaccccg

SEQ ID NO: 384118 - DNA, 571 bp, Homo sapiens
  misc_feature: GZ8MTXP02FQ5Y9.17.27.C05.1.454.CMB.2.raw
  modified_base (306)..(306): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggttttcttctgagctgactcaggatcctgctgtgtctgtggccttgggacagacagtcaggatcacatgccgaggagacagcctcagaagctattatgcaagtggtaccagcagaagccaggacacggcccctgtacttgtctatttatggtaaanaactaacccggcctacgagggactcccagaccccgtattctcgtcggctccgactcgaaggaaacacacgtccttccctagacccactcacgtgggctcgaggacgaagagtggagcgtagactattaccgtacgtaaccgtcccgggaacacgaccgagtcgactcgaaccgtagggtggtacgttcgggacgggacggaccctacgtacggaccgttcgtacggtcaacgtcccgaacggcctcgccccgtcggtacctaccg

SEQ ID NO: 384119 - DNA, 617 bp, Homo sapiens
  misc_feature: GZ8MTXP02HOAAY.17.27.C05.1.454.CMB.2.raw
  modified_base (247)..(247): a, c, t, g, unknown or other
  modified_base (303)..(303): a, c, t, g, unknown or other
  modified_base (310)..(310): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgttggtttcttctgagctgactcaggatcctgctgtgtctgtggccttgggacagacagtcaggatcacatgccgaggagacagcctcagaagctattangacaaggttggaccagcaagaagccgaaggacacggcccctgtacttgctatttanaggtaanaacgtaaccggcctagacgggtactcccgagaccccgtattcctcgtcggcctaccggactcgaaagggaaagaccacgtccttcccgagacccatacgacgtcgggctcgagggacggtaagagtaggaggtcgtagtacgttattacgtacgtaaccgtaccggacgacgcgagtgcgtacggaccgtagggttacggtacgttccggggacgggtaccgggacccgtaccggtacggtacccgttacgttaaccggaccgaaccgaccgaacggtcccgtccgtcccccgttcggtacctcccg

SEQ ID NO: 384120 - DNA, 646 bp, Homo sapiens
  misc_feature: GZ8MTXP02II096.17.27.C05.1.454.CMB.2.raw
  modified_base (393)..(393): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgttggtttcttctgagctgactcaggatcctgctgtgtctgtggccgttgggacagacagtcaggatcacatgaccgaggagacagcctcaagaagctatatgacaaggttcgaccagcaagaagccaggacacggcccctatactgtactaatttagtaggaaacaaacgtaacccggtcctacgaagggactaccccgagaccccgtattccgcgtggcctaccgaactccgaaagggtaaacncacgtcccttcccgagtacccatcacggtcgggctacggacgggacggaaagagtacggaacggtctacggtaactttaacgtttaacggtacgtttaaaccgaccccgggaacgaacgtccgaaggtcgacgtcgaaccggtagggttacgtaaggttccggggacgggtacgggacccctacggtacgtaccggttacgttacggacgaaccgaccgaacggtcctaccggtccccctacggtcctacccg

SEQ ID NO: 384121 - DNA, 642 bp, Homo sapiens
  misc_feature: GZ8MTXP02GBSFR.17.27.C05.1.454.CMB.2.raw
  modified_base (234)..(234): a, c, t, g, unknown or other
  modified_base (246)..(246): a, c, t, g, unknown or other
  modified_base (309)..(309): a, c, t, g, unknown or other
  modified_base (487)..(487): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctnagaagctattangctaagttggaccagcagaacgccaggacacggcccctgtacttgtctatttagtaggtaaanaacgtaacccggcctacgaagggtactaccccgagaccccgtattcctcgtcggcctccgatccgaaggaaacgacacgtccttacccgagaccctactaccgacgtcggggcctacgacgggacggaagtagtggacgctagtaacttaacgttacgtacgtaaccgtcccgggaanacgaccgtagtcgacgtacgaccgtaggggtacggtacggttaccggggacgggaaccgggtaccccgtacgtccggtaacccggttaccgttaacgggtacccgaaccggacccgaacgggtccctacccggtcccccgtacggtacctacccg

SEQ ID NO: 384122 - DNA, 537 bp, Homo sapiens
  misc_feature: GZ8MTXP02H8HE3.17.27.C05.1.454.CMB.2.raw
  modified_base (293)..(293): a, c, t, g, unknown or other
  modified_base (299)..(299): a, c, t, g, unknown or other
  modified_base (337)..(337): a, c, t, g, unknown or other
  modified_base (367)..(367): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacagccctgtactgtcattanggtaanaataaccggcctacagggactcccgagaccccgattcnctggctccgactcgaagaagacagcttccngaccatcacgtggggctcgaggcgaagatgaggctgactatactcgtaacgtcccgggacagctagtcgcgtgaccgtagtggtacttcgggcggacggacccctacgtcggtaccgtcttacgggtacaacggtcccgaaaggtccgtcgcccccgtacggtcctaccg

SEQ ID NO: 384123 - DNA, 666 bp, Homo sapiens
  misc_feature: GZ8MTXP02FYAM8.17.27.C05.1.454.CMB.2.raw
  modified_base (246)..(246): a, c, t, g, unknown or other
  modified_base (307)..(307): a, c, t, g, unknown or other
  modified_base (388)..(388): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattangactaagtgaccagcagaacgccaggacacggcccctgtactgtctatttagtaggtaaanaacgtaacccggccctacgaagggactaccccgagtacccccgtattcctcgtcggcctacccgactccgaagggaaaacncacgtcctttacccgagaccctagtccgacggtcggggactcgaaggggacggaaagtagtcggaggtctaggtaacttaacgtttacgtacggtaaacccgtccccgggaaacacgtacctaggtcgtaccgttacggaccgtaggggttggttaacggttccgggggaccgggaaccgggtacccccgtaaccggtacggtacccggttacgtttacgggaccgaaccggacccgtaacggtcccgttcccgccccccggttcggtacccttcccg

SEQ ID NO: 384124 - DNA, 632 bp, Homo sapiens
  misc_feature: GZ8MTXP02FKWVK.17.27.C05.1.454.CMB.2.raw
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaaggacaggcccctgtacttgtcatttatggtaaagaataaaccggcctcagggactcccagaccccgtattctctggctccgactcgaaggaaacgacagccttccctagacccatccaacgtgggggacctcgaacgggacggaaacgagtggaggactaggaacttaattaacgtcgtaaaccgtccccggggaactaacgccgaagttcgaccgtcggaacccgaagggttcggggtaagttccgggggaccgggaacggggaaccccctaccggtacggtaaccccgttcgttaacggttacgaaccgaaccccgtaaacggggcctacccggccccccgtccggggtcccttaaccg

SEQ ID NO: 384125 - DNA, 690 bp, Homo sapiens
  misc_feature: GZ8MTXP02ITXYP.17.27.C05.1.454.CMB.2.raw
  modified_base (241)..(241): a, c, t, g, unknown or other
  modified_base (258)..(258): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcaacagtgccgaggagacagcctgagaanctatatgacagttgacngacaagaacgcgaggacgacggccctgtactgtactatttagtaggtaaactaaacgttacccggcctacgaagggtacctaccgaagtaccccgtacttccgtcgtacgtccgtcccgaactcggaaaggaaacgccctaacgtcccttcccgaaacgaccctatccgtaacggtcggggactacggagggtaaaccggaagtaggtacgaggtactaacggtaacctttaacgttaaaccgtaccggttaaccgtacccgggaagacgaaccgtggtaccgttcggaacggtaccgtaaggggttcgtaaaccggttcggggaacccgggtaaccgggaccctaaacgggtccgtaccgggttacttacgggacctaaccggtaaccggaaccggtccctccccggtaccccgtttcgggtaacctcccg

SEQ ID NO: 384126 - DNA, 586 bp, Homo sapiens
  misc_feature: GZ8MTXP02IN13S.17.27.C05.1.454.CMB.2.raw
  modified_base (246)..(246): a, c, t, g, unknown or other
  modified_base (450)..(450): a, c, t, g, unknown or other
  modified_base (461)..(461): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattangacaagttggtaccagcagagcaggacacggcccctgtacttgtctatttataggtaagaataaccggcctcagggactccagacccgatctctggctccgatcgaaggaaacgacagtccttcccagaccatcaccgtggggctacgacggcggaagagtggaaggctagtaacttaatttactacgttaaccgtcccggganaacgctaggtncgtagtaccgaggttggtacgttcggggacgggacggggacccctaacggtcggaacccgttacgttacgtccgaacggcccgtaaacgggtccgtcccggtacccccgtcgggttacctacccg

SEQ ID NO: 384127 - DNA, 791 bp, Homo sapiens
  misc_feature: GZ8MTXP02JNUXX.17.27.C05.1.454.CMB.2.raw
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagagctatatgcagtgacagcagagcagacaggcccctgtacttgtctatttagtaggtaaagaacgtaacccggccctacgacggttactaccccgaagaaccccgtacttcctcgtacggtcctaccgacctcgaaacggtaaacgaaccgacgtacccttacccgtacgaaccctactccgtaaccggtcgggggaccttacggaacggggtacgggaaaacgtaggttacgggaacggggtaccgttaacggttaaaccgtttaacgttttaaccggtaaccggttaaaacccgggttacccccgggggaaacgtaacgggtacccgtagggttaccggtaccggtacgggtaaccccggtagggggtttacgggttaaccgggtttacccgggggaacgggggaaccccgggggtaaacccccgtacccgggttaccgggtaacccccgggtttacggtttaccggggtaacccgtaaccgggaacccccggtaaacgggtcccccggttacccggtcccccccggttaccgggtacccctttaacccccgg

SEQ ID NO: 384128 - DNA, 782 bp, Homo sapiens
  misc_feature: GZ8MTXP02FR6J0.17.27.C05.1.454.CMB.2.raw
  modified_base (316)..(316): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcaagaagctattatgacaagttggtaaccaggcagaaacgccaaggacagggcccctgtaccttgtctatttagtaggtaaanaaactaacccggcccttacgaaggggactaccccgaagaccccccgtatttcctctcggccttacccggacttccgaaagggaaaacgaccgaacgtccctttaccccgtaggaaccctaagtccgtaaaccgttcgggggccttaccggaaaggggaccggaaaaggtacgttagggaacgggtaccctagggtaaaacctttaaacgtttaacccggttaacgggttaaaaccccgttaccccccgggggtaaaacgtaaccggtaaccgtacgggttacggtaccgttaacgggtaacccggtaagggggttacgggttaaccgggttacccgggggaccgggtaaacccggggtaaccccgtaaccggttaccggtaaccccggtttacggttaaccggtaccgaacccggtaccccggaacggtcccgtaccccggtacccccgttacggttaccctaccg

SEQ ID NO: 384129 - DNA, 642 bp, Homo sapiens
  misc_feature: GZ8MTXP02GE16M.17.27.C05.1.454.CMB.2.raw
  modified_base (304)..(304): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatcgccgaggagacagcctacaagaagctattatgcaagttgaccagcaagagcaggacacggccctgtactgtctattagtaggtaanaacgtacccggcctacgacgggtacctcccgagaccccgtacttctctcggcctacccgactacgaaaggaaacgacctacgtcccttacccgtacgaccctaacgtccgaacggtcgggggacctacggaacggggacggaagagtaggaggtactagtaaacttaacgttacgtacggtaaccggtcccgggaactacggccgaagttcgaccgtacggaccgtagggtacggttacgtacggggacgggtaacggacccctacggtacggtaccgttacgtacgggtccaacggtacccgaacggtcccctccggtcccccgtcggtaccctccg

SEQ ID NO: 384130 - DNA, 614 bp, Homo sapiens
  misc_feature: GZ8MTXP02I0YNU.17.27.C05.1.454.CMB.2.raw
  modified_base (418)..(418): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctggtggccttgggacagacagtcaggatcacatgccgaggagacagcctacaagaagtctaattagtgactaaggttcggaaccaggaccaaggaacgccgaaggaccacgggcccctggttacttggtctaattttagtaggtaaaacgtaaacgtaaccccggccctacgaacgggactaccccgaagtaccccgtattcctcgtcggtcctccgactcgaagggaaaacncctagccctttacccgagaccctatccgacgtcgggctacggaggacggaagagtaacgctagactacttacgtacgtaccgtccgggactacgacagtacgcgtacgacgtaggtgtacgtcgggacgtacggaccacgtcgaccgttacgtacgtacgaccgtaacgacgccgtaccgcccgtcgactctcccg

SEQ ID NO: 384131 - DNA, 693 bp, Homo sapiens
  misc_feature: GZ8MTXP02HI29F.17.27.C05.1.454.CMB.2.raw
  modified_base (226)..(226): a, c, t, g, unknown or other
  modified_base (235)..(235): a, c, t, g, unknown or other
  modified_base (250)..(250): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgagganacagcctanaagaacgtctattangacgtaagttggaccagacaggaacgccgaaggacacggtcccctgtacttgtactaagtttagtaggtaaacgaacctaacccggcctacggaaacggtactacccgaagaccccgtattccgtcgtacggctacccgactaccggaaagggaaaacaccgtacgtaccccttacccgtacggaaccctacgtccgaaaccggtcggggtacctacggaacgggacggaaacgtaacggtaaacggtctacgtaaactttaaccgttaaccgttacgtaacccggttacccgggacaacgggtcgtacggtcgtacgtacggaacggtaggttacggtaacggtccgggaaccgggaccggacccgtacgtacggtaccgtaccgttacgggaccctacggaaccgaacgtccgtcccgtacccgtcgtaccgtcttcccgg

SEQ ID NO: 384132 - DNA, 672 bp, Homo sapiens
  misc_feature: GZ8MTXP02JV814.17.27.C05.1.454.CMB.2.raw
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaacgcaggacaggcccctgtacttgtcatttatggtaaaagaacgtaaaccggcctacgagggactcccagacccgtattctacgtggcctccgactcgaacggaaaacgacgagccttacccgtacgaacccattaccgaaacggtgggggacctacggaacggggtaccggaaacggacgtaagggagtaccgttagaaaccttaagtttaaaccctacgggttaaaaccgttcccccggggaagaacgaccgtaaggtcgtaccgtacggacccgtaaggggttacggttacgttacggggacgggaaaccgggacccccaaacgttccggtaccccgtacgtttaacggccgaacggacccgtaacgggccctaccggtaccccccgttcggtaccttaccccg

SEQ ID NO: 384133 - DNA, 550 bp, Homo sapiens
  misc_feature: GZ8MTXP02JVCXR.17.27.C05.1.454.CMB.2.raw
  modified_base (245)..(245): a, c, t, g, unknown or other
  modified_base (353)..(353): a, c, t, g, unknown or other
  modified_base (368)..(368): a, c, t, g, unknown or other
  modified_base (402)..(402): a, c, t, g, unknown or other
  modified_base (412)..(412): a, c, t, g, unknown or other
  modified_base (532)..(532): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctatangacagtggaccagcagaagcaggacaggcccctgtactgtcatttatggtaagaataccggcctgacgggatcccagaccccgatctctggctccgactcaaggaaanacacgcttcccgtanacccatccgacgtcggggctcgaagggcgaaagngtagacggtntagtaactacttaaccgtacgtaaccggacgacagactagactcgacgaacggtggtagtacggtacgggacgggacccgtacgacgtacgtacgtacgtcgaccgaacgaccgacgtcncccgtccgtcgtctcccg

SEQ ID NO: 384134 - DNA, 605 bp, Homo sapiens
  misc_feature: GZ8MTXP02I80SK.17.27.C05.1.454.CMB.2.raw
  modified_base (237)..(237): a, c, t, g, unknown or other
  modified_base (250)..(250): a, c, t, g, unknown or other
  modified_base (415)..(415): a, c, t, g, unknown or other
  modified_base (446)..(446): a, c, t, g, unknown or other
tcagcgtagactagcacgaccggtgctcgatttagacgcgatcgaagggtttggggagctgtgggctcagaagcagagttctgggggtgtctccaccatggcctggacccctctctggctcactctcctcactctttgcataggttctgtggttttcttctgagctgactcaggatcctgctgtgtctgtggccttgggacagacagtcaggatcacatgccgaggagacagccctnaagaagctattangacaaggttcgaccagcaagaacgccgaggaccacggcccctgtaccttgactaatttagaggtaaaacgaacgtaacccggccctacgagggacctacccgagaccccgtattcctcgtacggtcctaccgatccgaaaggaaacgcacgccttcccagaccancgtacggtgggactcgaagggacgaagtagngacgactagtaacttacttaacgtacgtaaccgacccggactacgacgtacgtcgacgtacgacgtaggtagtacggtcgggaccggaccggacccgtacggtacgtacgtacgtacgacgaaccgaccgacgtccgtcccgtcccgtcggtacctccg

SEQ ID NO: 384135 - DNA, 596 bp, Homo sapiens
  misc_feature: GZ8MTXP02FOX60.17.27.C05.1.454.CMB.2.raw
  modified_base (297)..(297): a, c, t, g, unknown or other
  modified_base (303)..(303): a, c, t, g, unknown or other
  modified_base (344)..(344): a, c, t, g, unknown or other
tcagcgtagactagcacgaccggtgctcgatttagacgcgatcgaagggtttggggagctgtgggctcagaagcagagttctgggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtactgtcatttanggtaanaataacccggcctagagggactcccgagaccccgtattccncgtcggcttccgactcgaggaaacacgagtccttaccctgacccatccacgtcggggctacgaggacggaagatacggagctgactattacgtcgtaacgtcccgggacagcgaagtcgcgtacggaccgtaggggtacggtaacgttcgggacggggtaaccggtaccccgaaccggtcggtacccggttacgttaacggtccgaacggcccgaaacggtccgtaccggtacccccgtcggtactaccccg

SEQ ID NO: 384136 - DNA, 692 bp, Homo sapiens
  misc_feature: GZ8MTXP02JO0QA.17.27.C05.1.454.CMB.2.raw
  modified_base (371)..(371): a, c, t, g, unknown or other
tcagcgtagactagcacgaccggtgctcgatttagacgcgatcgaagggtttggggagctgtgggctcagaagcagagttctgggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctacaagaagtctaattagtgactaaggtttcgaaccaggacaaggaacgccgaggacacggtcccctagtacttgactattagtaggtaaagaacgtaacccggcctacgagggacctaccgaagaccccgtacttcncgtcggcctccgactacgaaaggtaaacgacctacgtcccttacccgcgaacccacgtccgaccggttcgggggacctacgggacggggacggtaacgagtacgggaacggtactacggtaaacttacgtttaaaccgtacggtaaacccggtacccgggagtaacgtccgaacggtcgtacgcggtaaccggtaggggtttacgtaccggttcgggggaacccggtacggggacccctaaacggttccggaccggttacgttaccgggaccgaacggacccgtacgggtccctcccggtcccccgtacggtacctccccg

SEQ ID NO: 384137 - DNA, 716 bp, Homo sapiens
  misc_feature: GZ8MTXP02FICNR.17.27.C05.1.454.CMB.2.raw
  modified_base (236)..(236): a, c, t, g, unknown or other
  modified_base (247)..(247): a, c, t, g, unknown or other
  modified_base (273)..(273): a, c, t, g, unknown or other
  modified_base (305)..(305): a, c, t, g, unknown or other
tcagcgtagactagcacgaccggtgctcgatttagacgcgatcgaagggtttggggagctgtgggctcagaagcagagttctggggtgtctccaccatggcctggaccccctctctggctcactctcctcactctttgcataggttctgtggttttcttctgagctgactcaggatcctgctgtgtctggtgccttgggacagacagtcaggatcacatgccgaggagacagcctnagaagctatangctaagtgaccagcagaagcaggacncggcccctgtacttgtctagttagtaggtaanaaacgtaacccggcctagacggactccccgaagtacccccgtattccgtacgtcggcctcccgaacgtacgaaacggaaaacgactaaccgtcctttaccccgagtaccctaacgtcgtaacccggttcggggaccgttacggaagggggtaaccggaaaggtaacgttagggacgggtactacggtaaacctttaacgttaccgttaacgtaaacccggtcccgggaaacacgaccgtaagtcggtaccgtacgggaccgtagggttcgggtaaccggttccgggggaacggggtaaccggggtaaccccctaccgtaccgggttaacccgttacggttaacgggtaccgaaccgggtaacccaaacggggttccccacccgggttccccccgtcgggtccctaaccccg

SEQ ID NO: 384138 - DNA, 702 bp, Homo sapiens
  misc_feature: GZ8MTXP02JKV2B.17.27.C05.1.454.CMB.2.raw
  modified_base (256)..(256): a, c, t, g, unknown or other
  modified_base (372)..(372): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttctctgagctgactcaggatcctgctgtgtctggtggccttggggacagacagtcaggatcacagtgccgaaggagacagcctagaagaacgtcttaattagngacgtaaaggttcggaaccagaccaaggaaccgccgaaggaccacggtcccctagtacttgtactatttagaggtaacaaccgtaccgcctagaacggtcctaccgagaccccgtnttccgtcgtcggcctaccggactacggaaacggaaacgaccgtacgttcccgtttacccgagaaccctacgtaccgtaccgggtcggggacctacggaacggggaacggtaaggagtacgggaagtaccgtagtaaaccttacgttaacgtaccgttaacccgggacccggtaagacgacggtacgacgtacggtagaccggtaggggttcgtaacgggttaccggggaaccgggtaccggtaccctacggtaccgggtaaccgttaccgtacggtaccgaaccggtacccgaacggtcccctaccggtcccccgtacgtaccctacccg

SEQ ID NO: 384139 - DNA, 668 bp, Homo sapiens
  misc_feature: GZ8MTXP02FZ76J.17.27.C05.1.454.CMB.2.raw
  modified_base (89)..(89): a, c, t, g, unknown or other
  modified_base (113)..(113): a, c, t, g, unknown or other
  modified_base (236)..(236): a, c, t, g, unknown or other
tcagcgtagactagcacgaccggtgctcgatttagacgcgatcgaagggtttggggagctgtgggctcagaagcagagttctgggggtntctccaccatggcctggacccctntctggctcactctcctcactctttgcataggttctgtggtttcttctgagctgactcaggatcctgctgtgtctgtggccttgggacagacagtcaggatcacatgccgaggagacagcctanagaagctattatgacagttgaccagacagaagcagacacgcccctgtactgtcatttataggtaacaacgtacccggcctgaacggactacccgagacccccgtatccgtacgtggcctccgactccgaaaggaaacgacgacgtccttaccgtagacctatccgacgtcggggctacgacgggaacggaagagtacggaacgggtctacgtaaactttaacgtttaaccgtaacggttaaaccccgtaccccggggtaaacgacgtaccgtacggttcgaccggtaacggaccggtaggggttacggttaacgggtaccggggaaccggggtaaacccggtaaccccgtaccgtacggtaacccgttacgtaaccggtaccgaaccggtacccgaacggtcccctacccggtccccgtacgtaccgtaccg

SEQ ID NO: 384140 - DNA, 638 bp, Homo sapiens
  misc_feature: GZ8MTXP02HY3EA.17.27.C05.1.454.CMB.2.raw
tcagcgtagactagcacgaccggtgctcgatttagacgcgatcgaagggtttggggagctgtgggctcagaagcagagttctggggtgtctccaccatggcctggacccctctctggctcactctcctcactctttgcataggtttctgtggtttcttctgagctgactcgaggatcctgctgtgtctgtggccttgggacagacagtcaggatcaacatcggccgagggacgacaggcctacagaagtctattatgactaaggttcggaaccagacaagaacgccaggaccacggcccctagttcttgactatttagaggtaacaacgtaaccggcctagaacggtaccaccgaggacccctattcctcgtcgcctaccgactcgaaagaaacgaccgactcccttcccagaccctactaccgacgtcgggcacggacggacggaagagtaggacgtcgtagtactaacgttacgtacggttaaccgaccgggacacgacgtagtcgacgtacggtacgtacgggtagttacggtaccgggaccgggaccggacccctaccgtcggtacccggtacgttaccggccgaaccggtcccgaacggtccccgtcccgcccccgttacgtaccgttccccg

SEQ ID NO: 384141 - DNA, 613 bp, Homo sapiens
  misc_feature: GZ8MTXP02G7COJ.17.27.C05.1.454.CMB.2.raw
  modified_base (235)..(235): a, c, t, g, unknown or other
  modified_base (249)..(249): a, c, t, g, unknown or other
  modified_base (313)..(313): a, c, t, g, unknown or other
  modified_base (387)..(387): a, c, t, g, unknown or other
  modified_base (491)..(491): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctanaagaagctaattangactaaggttggaccagacaagaagccgaggacacggcccctgtactgactattagaggtaaanaactacccggcctagaaggactacccgagaccccgtattcctcgtcggctaccgaactaccgaaagggaaaacnccgacgtcccttcccagaaccctacgtaccgacggtcggggacctacggaagggacgaaagagtacggagctagaacttagtacgtacgtaaccgtacccgganacgactagtcgactacggaaccgtagggtagtacggtcgggacggaaccggacccaccgtacggaccgttacgtacggacaaccgacccgaacgtcctcccgtccccgtcggtacctacccg

SEQ ID NO: 384142 - DNA, 722 bp, Homo sapiens
  misc_feature: GZ8MTXP02G634B.17.27.C05.1.454.CMB.2.raw
  modified_base (204)..(204): a, c, t, g, unknown or other
  modified_base (257)..(257): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacngtcaggatcacagtcgccggaaggagacacgccctagaagaagtcttaattangacgtaaggttcggaaccagccaaggaacgccgaaggaccacggtcccctaggttacttagtactaagtttagtaaggtaaacgtaaacgttacccggcccttagaacggtacctaccgtacgtaccccgtattccgtacgtcgtcctaccggtactacggaaacggaaacgtaccgtccgttaccccttacgacggtaaaccctacgtaccgtacggtacggggtcgacggacgggaacggacgtaggtacggacggtacgtacgtaaacttacgtttaaccgtacggttaaccggtcccggaacgtacgaccgtaggtcgtacgtacgaacccggtagggtacggtacggttaccggggacgggtacccggtaccgtaccggtacggttacccgttaccgttacggaccgaaccggacccgtaaacggtcccgtcccggtacccccgtcggtacccttacccg

SEQ ID NO: 384143 - DNA, 712 bp, Homo sapiens
  misc_feature: GZ8MTXP02JTV0R.17.27.C05.1.454.CMB.2.raw
  modified_base (247)..(247): a, c, t, g, unknown or other
  modified_base (275)..(275): a, c, t, g, unknown or other
  modified_base (386)..(386): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatcgccgaggagacagcctgagaagctattangactaagtcgaccagcagacgcaggacncggcccctgtactgtctatttagtaggtaaactaacgtaacccggcctacgacgggtacctcccgagaccccgtattcgtcgtcggcctacccgactacgaacgggaaacncgacgtccttcccacgaaccctactccgtacggtcggggcctacggacggggacgaagtacggtacgggacgtcgttaggtaaacctttaacgttaaacgtaccggttaaacccgccccgggtaaacgacgtaccggtaaggtccgtaaccggtcgtaaccgggtagggttacgggtacggtttacccgggggaaaccggggtacccgggaaaccccgtaccggttccgggtaacccgtttcggttaaccggacccggaaccggaaccccggtaacggtccccgttaccccgggtccccccgtttacgggtaccctttacccccgg

SEQ ID NO: 384144 - DNA, 630 bp, Homo sapiens
  misc_feature: GZ8MTXP02I775C.17.27.C05.1.454.CMB.2.raw
  modified_base (215)..(215): a, c, t, g, unknown or other
  modified_base (226)..(226): a, c, t, g, unknown or other
  modified_base (234)..(234): a, c, t, g, unknown or other
  modified_base (246)..(246): a, c, t, g, unknown or other
  modified_base (266)..(266): a, c, t, g, unknown or other
  modified_base (281)..(281): a, c, t, g, unknown or other
  modified_base (524)..(524): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcanatgccgagganacagccanagagtctatagngatagtcgacagacaagacncgagacacgcccctntactgtactaattagtaaggtaaataacgtaacccggcctacgaacgggtacctacccgacgtaccccgtacttaccttcgtacggtcctaccggtaactacggaaacggaaaacgtaccgtaccgtacccgtttacccgacgaaccctagtcccgtaacggtcggggacctacggaacggggaacggaaggagtacggacggtctaacggtaacttacgtttacgaacgtaccgacccgganacgcgagtcgcgtagacgtgggtacgtacggtcggacgggtaccgaccgtacgcgttaccgtcgtacgacgaaccgaccggcgtccgcccgacccgtcgactaccc

SEQ ID NO: 384145 - DNA, 651 bp, Homo sapiens
  misc_feature: GZ8MTXP02GF229.17.27.C05.1.454.CMB.2.raw
  modified_base (226)..(226): a, c, t, g, unknown or other
  modified_base (229)..(229): a, c, t, g, unknown or other
  modified_base (303)..(303): a, c, t, g, unknown or other
  modified_base (348)..(348): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgagganacngcctcagaagctatatgcaagtgtaccagcagagccaggacacggcccctgtactgtctatttacgtaggtaanaacgtacccggcctacgaggactaccaacgaccccgtattactcncggacctccgactccgaagggaaacacgacgtccttcccagacccatcacgtcggggctacgagggacgaaacggagtcggaggtacctgtaaaccgttaattacgtaccgtttaaaccggcccgggtaacacggacacggtcgacgtacggaccgtaggggtacggttacgggttccgggacgggtaaccggggtacccccgaaacgttccggtaaaacccggttccgtttacgggacccgccggttaacccccgaacgggtccctccccggtaacccccgttccgggttaaccctaccccg

SEQ ID NO: 384146 - DNA, 639 bp, Homo sapiens
  misc_feature: GZ8MTXP02GWBAE.17.27.C05.1.454.CMB.2.raw
  modified_base (236)..(236): a, c, t, g, unknown or other
  modified_base (247)..(247): a, c, t, g, unknown or other
  modified_base (303)..(303): a, c, t, g, unknown or other
  modified_base (501)..(501): a, c, t, g, unknown or other
tcagcgtagactagcacgaccggtgctcgatttagacgcgatcgaagggtttggggagctgtgggctcagaagcagagttctgggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctanagaagctatangactagttgacagcagagcaggacacggcccctgtactgtactattagaggtaaanaacgtaacccggcctacgagggactaccgagaccccgtattcctcgtcggcctaccgactcggaaaggtaaacgaccgacgtccctttacccgacaaccctactaccgaaccggttcgggacctacggaacggggacggaaagagtacgggacgtactacgtaaacttacgttaaccgtacggttaccggacccgganagccgagtacgctacggacgagggttacgacgttcgggaacgggtacgacccgtacgtacggtacccgttacgttaaccggacgaaccggacccgaacggtcccgtacccggcccccgttacgggtaacccttcccgg

SEQ ID NO: 384147 - DNA, 604 bp, Homo sapiens
  misc_feature: GZ8MTXP02HWSVW.17.27.C05.1.454.CMB.2.raw
  modified_base (246)..(246): a, c, t, g, unknown or other
  modified_base (370)..(370): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattangcaagttggaccagcagagccagacaggcccctgtactgtctatttagtaggtaaagaactaaccggccctagagggaactcccgaagaccccgtattctcgtggctccgactcgaaaggaaanacagtccttcccagacccatcacgtggggctcgaggacgaagagtgacggactagacttattacgtagtaaccgtcccgggacagacgtagtcgacgtgaaccgtaggtacggttaacggttccggggaccggggaccgggtaacccctaccggtaccggtacccgttacgttacggtaccgaaccggacccgaaacgggtccctacccggtcccccgtacggtaccctacccg

SEQ ID NO: 384148 - DNA, 876 bp, Homo sapiens
  misc_feature: GZ8MTXP02HGQVC.17.27.C05.1.454.CMB.2.raw
  modified_base (236)..(236): a, c, t, g, unknown or other
  modified_base (341)..(341): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgttggtttcttctgagctgactcaggatcctgctgtgtctgtggccttggacagacagtcaggatcacatggccgaggagacagccctnaagaagctaattatgactaaaggtttggaacccaagacgaagaacgacccgaaggaaccgtacggccccttaggttaccttgtactaagtttaagtaggtaaaanaaacgtaacccggccctacgaacgggtactacccccgaaggacccccgtatttccgtcgtacgggtaccttacccggaacgttaccgaaaaggggaaaaacgaccctaaccgttcccctttacccccggtaaacgaaaccccgtaacgttaccgtaaccgggttacggggacccgtaaccgggaaacggggtaacgggaaaaggtaacggtaacgggaaacgggtacgttaaacggttaaaccgtttaaacgtttaaacccggttaaccgggttaaaaccccggtaccccggggtaaccgtaaacggtaccggttaacgggttacccggtaacgttaacgggtaacccggtaaagggggtttaccggggttaacccgggttacccgggggaacccgggggtaaacccgggtaaccccccgttaaaccggttaccgggtaaccccgtttacggttaaccgggacccgtaacccggaccccgtaaaccggggtccccgttacccccggtccccccggtttaccggtacccctacccg

SEQ ID NO: 384149 - DNA, 561 bp, Homo sapiens
  misc_feature: GZ8MTXP02GRU2F.17.27.C05.1.454.CMB.2.raw
  modified_base (226)..(226): a, c, t, g, unknown or other
  modified_base (234)..(234): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgagganacagcctnagaagctatatgcagttgaccagcagaagccagacaggcccctgtactgctattataggtaaagaataacccggcctacgagggactcccaagacccgtatctactggctccgactcgaaggaaacgacacgaccttccctagacccatccaacgtggggctacgaggacgaagatagagctagacctagttacgtagtaaccgtcccgggacgagacagtcgactacgacgtaggtcggtagtacgggacgggacggaccccgtacgacgacccgtacgttaggtccaacgacccgaaaggccgtcgaccccctacggtctacccg

SEQ ID NO: 384150 - DNA, 641 bp, Homo sapiens
  misc_feature: GZ8MTXP02I66KJ.17.27.C05.1.454.CMB.2.raw
  modified_base (228)..(228): a, c, t, g, unknown or other
  modified_base (237)..(237): a, c, t, g, unknown or other
  modified_base (305)..(305): a, c, t, g, unknown or other
  modified_base (311)..(311): a, c, t, g, unknown or other
  modified_base (395)..(395): a, c, t, g, unknown or other
  modified_base (498)..(498): a, c, t, g, unknown or other
tcagcgtagactagcacgaccggtgctcgatttagacgcgatcgaagggtttggggagctgtgggctcagaagcagagttctgggggtgtctccaccatggcctggacccctctctggctcactctcctcactctttgcataggttctgtggtttcttctgagctgactcaggatcctgctgtgtctggtggccttgggacagacagtcaggatcacatgccgagganacagcctanagaagctattatgactaaggttcgaccagcagaagccaggacacggcccctgtactgtctaatttagnggtaanaactacccggcctagaggactacccgagacccccgtattcctcgtcggctaccgactcgaaggaaacacgtacgccttacccgngaaccctatccgtacggttcgggggcctacggaacgggacggaaagtagtggaaacggccgtagaacgtttacttacgttaacggttaccgaccccggggaanacgtacgacgtacgtacgtacggacggtaggtacggtcggtaccggggccgggaacccggtacccgtacggttaccggtaccgttacgtacggaccgaaccggtacccgacggtcccgtcccgtccccgttccgtaccctccg

SEQ ID NO: 384151 - DNA, 588 bp, Homo sapiens
  misc_feature: GZ8MTXP02IOHZT.17.27.C05.1.454.CMB.2.raw
  modified_base (305)..(305): a, c, t, g, unknown or other
  modified_base (311)..(311): a, c, t, g, unknown or other
  modified_base (344)..(344): a, c, t, g, unknown or other
  modified_base (387)..(387): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagcttattatgactaaggttcggaccagacagaacgccaggacacggcccctgtacttgctatttagnggtaanaactaccggcctcgaggactccgagaccccgtnttctctaggctaccgactcgaagaaacgcacgtcccttaccgngacccatcgacgtcggggctcgacggacgagagtgaggactagtaacttagtttacgtacgttaaccgtacccggacgacgcgtagtacgacgtacgaccgtaggtggtacgttccgggacgggtaccggaccctaaccgtcgtaccgtcgttaacgtcgaaccgacccgaacggtccgtccgtccccgtcggtactcccg

SEQ ID NO: 384152 - DNA, 660 bp, Homo sapiens
  misc_feature: GZ8MTXP02G5AW4.17.27.C05.1.454.CMB.2.raw
  modified_base (228)..(228): a, c, t, g, unknown or other
  modified_base (271)..(271): a, c, t, g, unknown or other
  modified_base (373)..(373): a, c, t, g, unknown or other
  modified_base (408)..(408): a, c, t, g, unknown or other
  modified_base (423)..(423): a, c, t, g, unknown or other
tcagcgtagactagcacgaccggtgctcgatttagacgcgatcgaagggtttggggagctgtgggctcagaagcagagttctgggggtgtctccaccatggcctggacccctctctggctcactctcctcactctttgcataggttctgtggtttcttctgagctgactcaggatcctgctgtgtctgtggccttgggacagacagtcaggatcacatcgccgagganacagcctagaagaagtcttaattatgactaaggttcggaaccngacaaggaacgccgaggaccaccgggccccttagtaccttgtactatttaagaggtaaacgtaaccctaccggcctacgaaggcctacccgagtaccccgtntccgtactcggcctacgactcggaaagggaacacnccgtaccttacccgnacccagtacgacggtcgggacagaacgggagaagcgtaggagtactacgttaaacttacgttaccgtacggtaaccgacggacagtacgagcgacgtacgacggtagggtacgtacggtaccggggaccggtaaccggacccgttacggtacggttaccgttacggttaccggaaccggaacccgtaacccggtacggtcccgtacccccgggtacccgtttacggtccgtttcccg

SEQ ID NO: 384153 - DNA, 667 bp, Homo sapiens
  misc_feature: GZ8MTXP02JQWMV.17.27.C05.1.454.CMB.2.raw
  modified_base (229)..(229): a, c, t, g, unknown or other
  modified_base (237)..(237): a, c, t, g, unknown or other
  modified_base (242)..(242): a, c, t, g, unknown or other
  modified_base (261)..(261): a, c, t, g, unknown or other
tcagcgtagactagcacgaccggtgctcgatttagacgcgatcgaagggtttggggagctgtgggctcagaagcagagttctggggtgtctccaccatggcctggacccctctctggctcactcctcctcactctttgcataggttctgtggtttcttctgagctgactcaggatcctgctgtgtctgtggccttgggacagacagtcaggatcacagtcgccgagganacagcctnagaanctatatgcaagttggaccngcagagccgagacgacgcccctgtactgtactatttagtaggtaacgaacgtacccggccttacgaggggtacctaccccgaaggtacccccgtattcgtacgtcggaccttacccgaacgtccaaagggaaaactaccgtacgtaccctttccccaacggtaacccaaacgttaccggaaaccggttcgggggaaccctacgggaaacggggaaccggtaaaggaacggttaaaacggggcttaacggttaactaacttaaacccggttaggtaaacccccgtccgggaactacgggactacggtcgacgtacgacgtaggtcgtaaggtcgggacggtaccgaccacgacggtaccgtcgacgtcgacgccgtaacggcctccgaccctcggtactccgttccg

SEQ ID NO: 384154 - DNA, 685 bp, Homo sapiens
  misc_feature: GZ8MTXP02G7NEC.17.27.C05.1.454.CMB.2.raw
  modified_base (229)..(229): a, c, t, g, unknown or other
  modified_base (250)..(250): a, c, t, g, unknown or other
  modified_base (279)..(279): a, c, t, g, unknown or other
  modified_base (306)..(306): a, c, t, g, unknown or other
  modified_base (321)..(321): a, c, t, g, unknown or other
tcagcgtagactagcacgaccggtgctcgatttagacgcgatcgaagggtttggggagctgtgggctcagaagcagagttctgggggtgtctccaccatggcctggacccctctctggctcactctcctcactctttgcataggttctgtggtttcttctgagctgactcaggatcctgctgtgtctggtggccttgggacagacagtcaggatcacatgaccgagganacagcctacagaagtctaatntgactaagttcgacagcagacgcgagacncgccctgtactgtctattagaggtaanaacgtacccggtacncgaagggtactacccgaggtacccctatccgtcgtaccggctacccgaactcggaaagggaaacactacgtcccttaccctaggacccctataccgtacggtcggggaccgacggaacgggacggtaaacgagtacggtagtaccgtagtaaacgttaactttaacccgtaacggttaaacccggtccccgggaaagtacgtaaccgtagtccggtacgtacgtaaccggttaggggtacggttaggtacccggggacggaaccggggacccctaaccggtacggtacccggtacggttaacggacctaaccggtacccgtaacggtcccgttaccgacccccggtttcggaccgtttaccccg

SEQ ID NO: 384155 - DNA, 738 bp, Homo sapiens
  misc_feature: GZ8MTXP02FPHYV.17.27.C05.1.454.CMB.2.raw
tcagcgtagactagcacgaccggtgctcgatttagacgcgatcgaagggtttggggagctgtgggctcagaagcagagttctggggtgtctccaccatggcctggacccctctctggctcactctcctcacttctttgcataggttctgttggtttcttctgagctgactcaggatcctgctgtgtcgtggtcggccgttgggacagacagtcaggactcacatcgaccggaggacgaccagcctacgaagaacgtacttattaatgactaaggttcggaccagacaacggaacgccgaaggacgtaccggcccttagttacttcgtactaagttttagtaacggtaaacgtaaacgtaaccccggcctacggacggtactaccgacgtaccccgtactttccgtcgtacgcctacccgtacgtacgaaacggaaacgtactaccgtcccttcccacgtacccatttacccgaccggggtcgggaacttcgggaaacgggggacgtaaagtcgtacggggtacgggtacttacggttaaaccggtttaacttaccggttaaccggtaaacccgggtccccgggaaatagtacccggtagccgggtactacgggaacgggtagggttacgggttacgaccgggggtacgggacccgttaacccgtacgtacggttaccgtttacgacgaccggtaaacgccccgtaaggcccccgtcccgtacccgcggttcctacccg

SEQ ID NO: 384156 - DNA, 765 bp, Homo sapiens
  misc_feature: GZ8MTXP02FR006.17.27.C05.1.454.CMB.2.raw
tcagcgtagactagcacgaccggtgctcgatttagacgcgatcgaagggtttggggacataacaaccacattcctcctctaaagaagcccctgggagcacagctcatcaccatggactggacctggaggttcctctttgtggtggcagcagctacaggtgtccagtcccaggtgcagctggtgcagtcgtgggctgaggtgaagagccgtggtcctcggtgagggtctctgcgaaggtctctgcaggcctacctttagactaactatgtctttcagcgtgggtcgcgacgacggccccgtaggacgaagggtctggaggtggaggtaggggagggtatcgtacgtttacctacgtccggttagggactaaggttaaacgtactaccgaacgtaaggtaacgttaccggagggtaacctaaacgtccgtaaaccccgtaacgtttaacccgggaaccgggtaaaccgtaaactacccgaaaccggacgaccaaacctacggtacccctaagtaggtttacgaagggtttacgaacgacccgtaaccggacccttaacgaaggtacttacgggtaacgggaaccgacccggtacccgggttaccggtttaagttaacgttaaccgtggggtacgtaaccggggaacggggtaaccggggacccggtaaacggaacgaaaacgtaaaccggtcggaacggttaaaggggtaacggggttaacggttaaaacgtttggttttaaacgttttaggtttacggtaaaccgg

SEQ ID NO: 384157 - DNA, 628 bp, Homo sapiens
  misc_feature: GZ8MTXP02F3O22.17.27.C05.1.454.CMB.2.raw
  modified_base (205)..(205): a, c, t, g, unknown or other
  modified_base (227)..(227): a, c, t, g, unknown or other
  modified_base (235)..(235): a, c, t, g, unknown or other
  modified_base (239)..(239): a, c, t, g, unknown or other
  modified_base (244)..(244): a, c, t, g, unknown or other
  modified_base (262)..(262): a, c, t, g, unknown or other
  modified_base (268)..(268): a, c, t, g, unknown or other
  modified_base (281)..(281): a, c, t, g, unknown or other
tcagcgtagactagcacgaccggtgctcgatttagacgcgatcgaagggtttggggagctgtgggctcagaagcagagttctgggggtgtctccaccatggcctggacccctctctggctcactctcctcactctttgcataggttctgtggtttcttctgagctgactcaggatcctgctgtgtctgtggccttgggacagacngtcaggatcacatgccgagganacagcctnaganctatngactagtgacagcagacncagacncgccctgtactgntattagtaggtaaacacgtaccgcctagacggactacccgagaccccgtattccgtcgtcggccctaccgaactacggaaaggaaaaccgaccgtaccgtccccttacccgtagaaccctagtaccgaacggtcgggggactacgggagggacggaagagtacggacgctagtaacttacgttacgtacggttaacccgccgggtaacacgacgtagcgtacgtacggaccgtagggtacgtacgtacgggaccgggaccggtaccctacggtacgtacccgttacgtacggtaccaaccggtacccgtaacggtcccgtcccgtaccccgtcggtaccttaccccg

SEQ ID NO: 384158 - DNA, 635 bp, Homo sapiens
  misc_feature: GZ8MTXP02GKA8A.17.27.C05.1.454.CMB.2.raw
  modified_base (224)..(224): a, c, t, g, unknown or other
  modified_base (280)..(280): a, c, t, g, unknown or other
tcagcgtagactagcacgaccggtgctcgatttagacgcgatcgaagggtttgggagctgtgggctcagaagcagagttctggggtgtctccaccatggcctggacccctctctggctcactctcctcactctttgcataggttctgtgtttcttctgagctgactcaggatcctgctgtgtctgtggccttgggacagacagtcaggatcacatgccgagganacagcctacagaagctaattatgcgtaagttggtaaccagcagaagccgaggaccncggcccctagttaccttgtacttaatttagtaggtaaaagtaacgtaacccgggcccttacgagggactacccgagacccgtacttcgtctacggctccgacgtcgagaaacgcgactaccttccgacgaccacgtcgtacgtcggacgtacggacggaggacgtagtggaacgtctaggtaacttagtacgtcgttaacgacccgggagtaacgcgtaggtacgcggttacgaccgggtagttagggtaaccgttcgggggaaaccggtacgggtacccctaccgttacggccgttaccggtaacgtacgaacccgccgaacggttccctccgccccgttacggccttacccgg

SEQ ID NO: 384159 - DNA, 644 bp, Homo sapiens
  misc_feature: GZ8MTXP02F4SC0.17.27.C05.1.454.CMB.2.raw
tcagcgtagactagcacgaccggtgctcgatttagacgcgatcgaagggtttggggacataacaaccacattcctcctctaaagaagcccctgggagcacagctcatcaccatggactggacctggaggttcctctttgtggtggcagcagctacaggtgtccagtcccaggtgcagctggtgcagtcgtggggctgaggtgaagaagccgtgggtcctcggtgaggtctcctgcaaggcttctgcaggcctactttagctaactatgcttcgagcgtggtgcgacacggccccgtggacaagggtcttaggaggtggaggtgggagggtactcgtactttcctagttccgttaggacgtaacgtaacgtacgtaccgaactaggtaaccgttaccgaggggtaaccaaacggtactaaccctacgttaacccggacgggaaaccgtaacgtacccgaaacgacgacaccacgacctacagtttcgtaggtagacgaccgacgtcctacgtagtacgttcgacggaacgacggacggtacccgttagttacttacgtggtaggtacgaggggtcggaaccggagaaaccgactaacggtggagtaaggtaggtacggtaaggtttgtttagtttaggtttacag

SEQ ID NO: 384160 - DNA, 724 bp, Homo sapiens
  misc_feature: GZ8MTXP02FHHQ6.17.27.C05.1.454.CMB.2.raw
tcagcgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccggaggagacagccctacaagaacgctaattatgactaaaggttcggaccaggcaagaaagccaggaccacggtcccctagtactttgtctatttagtaggtaagaaacgtaaccggccctacgacggactaccccagaccccgtattcctacgtcggtcctacccgacgtcgaaacgggaaaagaccacgtccttcccgtacggtaacccactacccgtaaaccggtcgggggaccttacggaacggggtcccgggaaaagtacgtacggaagggtccttacggtaaacctttacgtttaaacgttaccggtaaccggttaccccggggtaaacgacggaccgaaggttcgtacgttacggaaccgtaggggttacgggttaacggttccgggggtaccggggaaacggggtaccccgtaacccggttacggtaacccgtttacgtaaccggtcgaaaccggtcccgaaacggtccgtccggacccccgttccgggtctacccg

SEQ ID NO: 384161 - DNA, 524 bp, Homo sapiens
  misc_feature: GZ8MTXP01B09VI.21.9.A09.1.454.CMB.2.raw
  modified_base (249)..(249): a, c, t, g, unknown or other
  modified_base (268)..(268): a, c, t, g, unknown or other
  modified_base (358)..(358): a, c, t, g, unknown or other
  modified_base (519)..(519): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatcgtggtgggggcagagtctccatcacttgccggcagtcagtaatattatagctggtgctggtancagcagaaacagggaaacncccctaactctagatatagtcgggacttactaaagtttaggaaaggtcggggtccagtcggaggttcagccggcaggtgctgtagggacngaattcactctacaccatcagcgcctgcagctagattgtatttgactaacttatactgacctaaatattaacgaatgacttacgtcgtcgttacgtcgaccgaagggaacagggttacgaaattacgaaacgtacttgcggctgcaactatcttgtccttntaacc

SEQ ID NO: 384162 - DNA, 557 bp, Homo sapiens
  misc_feature: GZ8MTXP01A10BU.21.9.A09.1.454.CMB.2.raw
  modified_base (234)..(234): a, c, t, g, unknown or other
  modified_base (250)..(250): a, c, t, g, unknown or other
  modified_base (271)..(271): a, c, t, g, unknown or other
  modified_base (334)..(334): a, c, t, g, unknown or other
tcagtcgtcgctcgcacgaccggtgctcgatttagcgagacgcgcaggggggcaggagtcagacccagtcaggacacagcatggacatgagggtccccgctcagctcctggggctcctgctgctctggctcccaggtgccaaatgtgacatccagatgacccagtctccttccaccctgtctgcatcgtggtgggggcagagtctccatcacttgccggcagtcagaatattanagctggttgctggtancagcaagaaaccagggaaacncccctaactctgatatatcgggctataatttaggaagtcgggtccagtcgaggttcaggccgnagtggctcgtagggacaagtattcactctacacatcacgcgcctgcagcctagatgtatttagactaaacttattacacgactaaactattaactaatcgtattaccgtcgtcggttaccggttacggaccgaaaggggaacccgtaaggggttacggtaaaacacggtaaaacgtacgttaggttcgaccgtgaccaacctatcgttacttccttctaaccg

SEQ ID NO: 384163 - DNA, 549 bp, Homo sapiens
  misc_feature: GZ8MTXP01CFCKZ.21.9.A09.1.454.CMB.2.raw
  modified_base (229)..(229): a, c, t, g, unknown or other
  modified_base (245)..(245): a, c, t, g, unknown or other
  modified_base (265)..(265): a, c, t, g, unknown or other
  modified_base (341)..(341): a, c, t, g, unknown or other
  modified_base (350)..(350): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccacctgtctgcatctggtgggggcagagtctcatcacttgccggcagtcagatattanagctggttgctggtancagcagaaaccagggaaacncccctaactctgatatagtcggctactaatttagaaagtgggtccagtcgagttcagccgcagtgctcgtgggacngatcactcncacatcagcggctgcagctagatgtatttgactaacttattactggacctaaactattaaccaattgtaactttactacggaccgttaccggttcgggaccaaacgggggaaccctaagggggttacgggaaaacttacgaaaaaccggtacttaggttcggacgtgaccaaccgtatccgttagttccttcgtaaccg

SEQ ID NO: 384164 - DNA, 552 bp, Homo sapiens
  misc_feature: GZ8MTXP01DF0FH.21.9.A09.1.454.CMB.2.raw
  modified_base (254)..(254): a, c, t, g, unknown or other
  modified_base (276)..(276): a, c, t, g, unknown or other
  modified_base (521)..(521): a, c, t, g, unknown or other
  modified_base (535)..(535): a, c, t, g, unknown or other
tcagtcgtcgctcgcacgaccggtgctcgatttagcgagacgcgcaggggggcaggagtcagacccagtcaggacacagcatggacatgagggtccccgctcagctcctggggctcctgctgctctggctcccaggtgccaaatgtgacatccagatgacccagtcctccttccaccctgtctgcatcgtggtggggggcagagtctcatcacttgccgggcagtcagtaatattatagctggtcggctggtancagacaagaaaccagggaaacnccccctaactcctagatatagtcggggattactaaagtttaggaaaggtcgggggtacccagtcggaggttcaggcccggcaggtggctcgtaagggacaagaacttcactctcacatcagcgctgcagctagattgtatttgactaacttattactgacctaaactattaacaatcgtattacgtacgtcgttacgtcggaccgaaggggaaccaagggttacgaaattacgaaaacgcttggnggcctgaccaactntcttcgttcttctaacc

SEQ ID NO: 384165 - DNA, 555 bp, Homo sapiens
  misc_feature: GZ8MTXP01AQZDY.21.9.A09.1.454.CMB.2.raw
  modified_base (255)..(255): a, c, t, g, unknown or other
  modified_base (275)..(275): a, c, t, g, unknown or other
  modified_base (337)..(337): a, c, t, g, unknown or other
tcagtcgtcgctcgcacgaccggtgctcgatttagcgagacgcgcaggggggcaggagtcagacccagtcaggacacagcatggacatgagggtccccgctcagctcctggggctcctgctgctctggctcccaggtgccaaatgtgacatccagatgacccagtcctccttccaccctgtctgcatcgtggtgggggcagagtctccatcacttgccgggccagtcagtaattattatagctggttgctggtancagcaagaaccgaggaaacncccctaactctagatatagtcggctataagtttagaagtcgggtaccagtcgaggtcagcgnagtgctgagggacaagtactcactcctacacatcagccggctgacagcgtagattgtattttacgacttaacttattaccgtagaccctaaataacttaactaattgtacttacgtcgtaccgttaacgttcggaaccgtaaggggaacctaggggttagaaacttacgaaagtacgttggttcgctaagctaacgtattcttacgttcttcgtaacc

SEQ ID NO: 384166 - DNA, 541 bp, Homo sapiens
  misc_feature: GZ8MTXP01AMQFG.21.9.A09.1.454.CMB.2.raw
  modified_base (255)..(255): a, c, t, g, unknown or other
  modified_base (276)..(276): a, c, t, g, unknown or other
  modified_base (351)..(351): a, c, t, g, unknown or other
  modified_base (410)..(410): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatcgtggtgggggcagagtctccatcacttcgccgggccagtcagtaattattatagctggttgcctggtancagcagaaaccgagggaaacncccctaacctctgatatagtcggatactaatttagaagtcgggtaccagtcgagtcagcgcagtgctgagggacngatcactctcacatcacgcgcctgcacgcctagtatgtaatttgactaacttattaccnggaccaaatattacgaattcgattacgtcgtcgttacggtccgacgtaaacgggaaccgaggggttaggaaacttcgaaaacggtacgttggttacggctgccaacctattcttcgttaaccttcgtaacc

SEQ ID NO: 384167 - DNA, 550 bp, Homo sapiens
  misc_feature: GZ8MTXP01EUXR1.21.9.A09.1.454.CMB.2.raw
  modified_base (258)..(258): a, c, t, g, unknown or other
  modified_base (278)..(278): a, c, t, g, unknown or other
  modified_base (370)..(370): a, c, t, g, unknown or other
  modified_base (428)..(428): a, c, t, g, unknown or other
  modified_base (515)..(515): a, c, t, g, unknown or other
  modified_base (527)..(527): a, c, t, g, unknown or other
tcagtcgtcgctcgcacgaccggtgctcgatttagcgagacgcgcaggggggcaggagtcagacccagtcaggacacagcatggacatgagggtccccgctcagctcctggggctcctgctgctctggctcccaggtgccaaatgtgacatccagatgacccagtcctccttccaccctgtctgcatcgtggtggggggcagagtctccatcacttggccgggccagtcagaattattatagctggttggcctggtancagcagaaaccagggaaacncccctaactcctgatatagtcgggctacttaagtttaggaaaggttgggggtacccagtcgaggttcaggccggcagtggctcgtagggacngtaattcactctacacatcagcgcctgcagcccgtatgtatttgactaacttattacncgtaccaaatattacaatgtaacttacgtcgtacggtacgttcgggaccgaaaggggacaaggggtaagaaatacgaaacgtagtgnggcttagcaccngttctagttcttcgaacttcccg

SEQ ID NO: 384168 - DNA, 591 bp, Homo sapiens
  misc_feature: GZ8MTXP01B0KJO.21.9.A09.1.454.CMB.2.raw
  modified_base (257)..(257): a, c, t, g, unknown or other
  modified_base (278)..(278): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtcctccttccaccctgtctgcatcgtggtgggggcagagtctccatcacttgccggccagtcagtaattatttatagcttggttggcctggtancagcaagaaaccagggaaacnccccctaactcctagatatagtcggggacttacttaaagtttaggaaaggttcggggtacccagtcggaggttcacggccggcgtagtggctcgtaagggacaagtattcactctcacatcacgcgcctgcagcccgatgtatttcgactaacttattactcgaccaaactattaacaattgacttaccgtccggtacgttacggttaccggaccgtaaaggggccgaaggggtacgaaagtaccgttaaacggtaacgtggttacggcttacggaaccaccgtaattctacgttcctttcgaactttccccg

SEQ ID NO: 384169 - DNA, 585 bp, Homo sapiens
  misc_feature: GZ8MTXP01EXEP8.21.9.A09.1.454.CMB.2.raw
  modified_base (261)..(261): a, c, t, g, unknown or other
  modified_base (357)..(357): a, c, t, g, unknown or other
  modified_base (376)..(376): a, c, t, g, unknown or other
  modified_base (493)..(493): a, c, t, g, unknown or other
tcagtcgtcgctcgcacgaccggtgctcgatttagcgagacgcgcaggggggcaggagtcagacccagtcaggacacagcatggacatgagggtccccgctcagctcctggggctcctgctgctctggctcccaggtgccaaatgtgacatccagatgacccagtcctccttccaccctgtctgcatcgtggtgggggcaggacgtctccatccacttgccgggccagtcagtaattatttatagtcgtggtgcctggtancagcaagaaaccgagggaaacgccccctaactcctagatatagtcgggcttataagtttaggaaaggttcgggtaccagtcgtaggttcagccggnaggtggctcgtaagggacngtaaacttcgaactctacaccgtatccgagccggtcctaggacacgcccttaggattggtacttttggaccttaacttattacctaggacctaaatattacaaattcgaactttacncggtacgtaccggttcgaccgtaaagggctaaggggttagaaacttacgaaacgtattggttagctgcaacctattcttagtcttcgtaacc

SEQ ID NO: 384170 - DNA, 606 bp, Homo sapiens
  misc_feature: GZ8MTXP01DDN1T.21.9.A09.1.454.CMB.2.raw
  modified_base (233)..(233): a, c, t, g, unknown or other
  modified_base (248)..(248): a, c, t, g, unknown or other
  modified_base (269)..(269): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtcctccttccaccctgtctgcatcgtggtgggggcagagtctcatcacttgccggcagtcagaatattanagctggtgctggtancagcaagaaaccagggaaacncccctaactctagatatagtcggtcttactaaagtttagaaaggttcggggtaccctagtccggtaaggttcaacggtccggctaggtggctcgtaaggggactaaggtaattccaactctacactatacgacgcgcctgcacgcccaatcgtatttcgacttaaacttatactacaacctaactaagttaaccaatgtaacttacgtcggtaccgtacgttaccggaccgtaaacggggacctaaggggtacgaaacgtacgaaaacgttaccgtggttacgggccttacgaacctaaacccttgttcctacgttaccttccgttaaccgttcccg

SEQ ID NO: 384171 - DNA, 620 bp, Homo sapiens
  misc_feature: GZ8MTXP01B9YEH.21.9.A09.1.454.CMB.2.raw
  modified_base (235)..(235): a, c, t, g, unknown or other
  modified_base (251)..(251): a, c, t, g, unknown or other
  modified_base (272)..(272): a, c, t, g, unknown or other
  modified_base (357)..(357): a, c, t, g, unknown or other
tcagtcgtcgctcgcacgaccggtgctcgatttagcgagacgcgcaggggggcaggagtcagacccagtcaggacacagcatggacatgagggtccccgctcagctcctggggctcctgctgctctggctcccaggtgccaaatgtgacatccagatgacccagtctccttccaccctgtctgcatcgtggtgggggcagagtctcatcacttgccggcagtcaagtaatattanagcgtggtgctggtancagcaagaaaccagggaaacncccctaactcagtatatagtcgggtacgtacttaaagtttagaaagggttcggggtacccagttcggtaaggttcaggtcccggntaggtggcctaggtaacgggaacaaggtaaacttccactctacaccgatccagcgactgcacgctagagtgtatttagacttaaacttagtaacctggaacctaaacttacttaacaattcgtaattacgtcggtcgttaccggttacggaccgtaaagggcccgtaaggggttaaacgaaaccgttacgtaaaaacggtccgttaggcgggttacctaaggaccctaacgttaatccgttacgtcccgttttaactaacccg

SEQ ID NO: 384172 - DNA, 594 bp, Homo sapiens
  misc_feature: GZ8MTXP01BGJAZ.21.9.A09.1.454.CMB.2.raw
  modified_base (252)..(252): a, c, t, g, unknown or other
  modified_base (273)..(273): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtcctccttccaccctgtctgcatcgtggtgggggcagagtctcatcacttcgccggccagtcagtaatattatagctggtgcctggtancagcaagaaacgagggaaacncccctaactctagatatagtcggtcttactaaagttaggaaacggtcgggtaccagtcgtagttcaggccgacgagtgctgagggacaagatcactctacacatcagcgctgacacgtcctaggattagtactttgaaccttaaatttacttaccgtacggaaccctaaattaacttaactaagttcgtaacctttacgaccggtcggtttaaccggtccgggaaaccgtaaaggggaacccgtaagggggttactaaaacttccggaaaacgtcgttaggttcgacgtgacctaactagtccttcgttccttcgtaaccg

SEQ ID NO: 384173 - DNA, 529 bp, Homo sapiens
  misc_feature: GZ8MTXP02IWZGF.21.9.A09.1.454.CMB.2.raw
  modified_base (269)..(269): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggggcagagtctccatcacttgccggccagtcagaatattatagctggttgcctggtatcagcagaaaccagggaaacncccctaactcctgatatagtcgggctactaaatttagaaaaggtgggtacccagtcgaggttcagccggcagtggactcgtaggggacagaattcactctcacatcagcgctgcagcctgatgtatttgactaatttatactgacctaaatattaacaatgtacttactcggtacgttacgttcggaccgaaagggtaccaggggtagaaaactacgaaaacgtacgtgtagcctaagacaccgatctacgtcttactac

SEQ ID NO: 384174 - DNA, 577 bp, Homo sapiens
  misc_feature: GZ8MTXP02HNLSA.21.9.A09.1.454.CMB.2.raw
  modified_base (232)..(232): a, c, t, g, unknown or other
  modified_base (264)..(264): a, c, t, g, unknown or other
  modified_base (275)..(275): a, c, t, g, unknown or other
  modified_base (280)..(280): a, c, t, g, unknown or other
  modified_base (287)..(287): a, c, t, g, unknown or other
  modified_base (399)..(399): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatctggtgggggcagagtctccatcacttgccggcagtcagaatattanagctggtgctggatcagcagaaacaggaaacncccctaactcngatanatcgggntactaagttagaaaggtcgggtccagtcgaggttcagccggcagtcggctgtggacagtaattcactctcacatcagcgctgcagctgatgtatttgactaacttattacgnacctaaatattaacaaatgtaactttaccgtacgtaccggttaccgtttaccgggaccgtaaaacgggggtaccctaaaagggggttacggaaaaacttaccggaaaaaacgtacgttacgggtacggccttaacggcccaaaacccgttacttaccgttacgttacctttactaccg

SEQ ID NO: 384175 - DNA, 584 bp, Homo sapiens
  misc_feature: GZ8MTXP02JKFVW.21.9.A09.1.454.CMB.2.raw
  modified_base (232)..(232): a, c, t, g, unknown or other
  modified_base (268)..(268): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatcgtggtgggggcagagtctccatcacttgccggcagtcagatattanagctggtggctggtatcagcagaaaccagggaaacncccctaacctctagatatagtcgggactactaatttaggaaagggttcggggtaccctagtcgaggttcaggcccggcaggtcggctcgtagggacaggtaacttcgactcctacaaccgatcgagccggctgcagccctgactgtatttgactaaacttatactcgacctaactattaacaattgaactttacgtcgtacgttaccggttacggaaccgaaacgggtaccgtaagggggtacgaaaacgtaccgaaaacggtaccgtagggtcggacctcggacctaacctagttccttacgttacctttctacc

SEQ ID NO: 384176 - DNA, 501 bp, Homo sapiens
  misc_feature: GZ8MTXP02H1E0M.21.9.A09.1.454.CMB.2.raw
  modified_base (233)..(233): a, c, t, g, unknown or other
  modified_base (271)..(271): a, c, t, g, unknown or other
  modified_base (342)..(342): a, c, t, g, unknown or other
  modified_base (347)..(347): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtcctccttccaccctgtctgcatctggtgggggcagagtctcatcacttgccggcagtcagaatatttanagctggttggcctggtatcagcagaaaccagggaaacncccctaactcctgatatatcgggctctaaatttagaaagtcggggtccatcgaggtcagccgcagtgctgnggacngaattcactctcacatcagcgctgcagctgatgatttgactaactttattactgaccaatattacaaattgattactcgacgttacgtcggacgaaagggaccgagggtagaaatacaaaacgtactgtggactgcacatctcgttcttactac

SEQ ID NO: 384177 - DNA, 613 bp, Homo sapiens
  misc_feature: GZ8MTXP02H28O6.21.9.A09.1.454.CMB.2.raw
  modified_base (275)..(275): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatctggtgggggcagagtctccatcacttgccgggccagtcagtaatattatagtctggtggcctggtatcagcaagaaaccgagggaaacncccctaacctctagatatagtcgggactactaaagtttaggaaggtcggggtacccagtcgaggttcaggccggcaggtgctgtggggacagaacttcactctacaccatcacgcgctgcacgctgatgtatttgactaacttattactacgacctaaactaattaacaattagtaactttaccgttaccggtaccggttaaccggttaccgggacccgtaaaacgggggtacccgtaaagggggttacggaaaaacttaccgaaaaaccggtaacgtacggttacgggacttaacggacctaaccgtacgttccgtttacggtacctttaccgaccg

SEQ ID NO: 384178 - DNA, 547 bp, Homo sapiens
  misc_feature: GZ8MTXP02JDOUN.21.9.A09.1.454.CMB.2.raw
  modified_base (233)..(233): a, c, t, g, unknown or other
  modified_base (272)..(272): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatctggtgggggcagagtctccatcacttgccggccagtcagaatattanagctggttggcctggtatcagcaagaaaccagggaaacncccctaacctcctagatatagtcgggctactaagtttaggaaagtcggggtacccagtcgaggttcaggccggcagtgctcgtgggacagattcactctcacatcagcgcctgcagcctgatgtatttgactaacttattactcgacctaacactttaacaattgaactttactcggtacgttacggttacggaccgaaacggggtaccagggggtagaaaacgtacgaaaaccggtacgtacggtacgactgactaccatcctacgtcttctac

SEQ ID NO: 384179 - DNA, 557 bp, Homo sapiens
  misc_feature: GZ8MTXP02GGC9K.21.9.A09.1.454.CMB.2.raw
  modified_base (266)..(266): a, c, t, g, unknown or other
  modified_base (344)..(344): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggggcagagtctccatcacttgccgggcagtcagaatattatagctggtgctggtatcagcagaaccagggaaacncccctaactcctgatatagtcggctactaatttagaagtggggtccatcgaggttcagccggcagtgctcgtgggacngtaacttcactcctcaccatcagcgcctgcacgcccgatcgtattttcgactaaactttattactgacctaaactattaacaatgtaatttactcgtcgtaacgttcggaccgtaacgggacctaggggtacgaaacgtacgtaaaacggaacgttggtacggtactacggaacctaaccgaacttcgtacgtttacgttcctactttccccg

SEQ ID NO: 384180 - DNA, 597 bp, Homo sapiens
  misc_feature: GZ8MTXP02I3KVZ.21.9.A09.1.454.CMB.2.raw
  modified_base (273)..(273): a, c, t, g, unknown or other
  modified_base (364)..(364): a, c, t, g, unknown or other
  modified_base (375)..(375): a, c, t, g, unknown or other
  modified_base (379)..(379): a, c, t, g, unknown or other
  modified_base (421)..(421): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatctggtgggggcagagtctccatcacttgccgggccagtcagaatattatagctggttggcctggtatcagcaagaaaccagggaaacncccctaacctcctagatatagtcgggactactaatttagaaaggttcggggtaccagtcgaggttcaggccggcagtggctcgtagggacngaattcactcncacntcagcgctgcacgcccgatcgtatttcgactaacttattacncgtaacctaaactattaaacaattagtaactttaccgtacgtacggttaacgttccggaaccgtaaaggggacccgtaagggggttaacggaaaattaccggaaaaacgtacgttcggtacggtactacggaaccgtaacctacttcgtacgttacctttacgtaactttcccccg

SEQ ID NO: 384181 - DNA, 527 bp, Homo sapiens
  misc_feature: GZ8MTXP02FX0ZS.21.9.A09.1.454.CMB.2.raw
  modified_base (233)..(233): a, c, t, g, unknown or other
  modified_base (270)..(270): a, c, t, g, unknown or other
  modified_base (333)..(333): a, c, t, g, unknown or other
  modified_base (337)..(337): a, c, t, g, unknown or other
  modified_base (343)..(343): a, c, t, g, unknown or other
  modified_base (395)..(395): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggggcagagtctccatcacttgccgggccagtcagaatattanagctggttggcctggtatcagcagaaccagggaaacncccctaactcctgatatatcgggctctaattagaaagtgggtcccatcgaggttcagcgcagngctntggacngaattcactctcacatcagcggcctgcagcccgatcgtatttgctaaacttnttactgaccaacattacaatgaacttactcgtacgtaccgttcggaccgtaaaggggacctaggggtacggaaactacgaaaacgtactggtacggactagctaacccattcgtgtccttacactttccccg

SEQ ID NO: 384182 - DNA, 538 bp, Homo sapiens
  misc_feature: GZ8MTXP02JLUY1.21.9.A09.1.454.CMB.2.raw
  modified_base (231)..(231): a, c, t, g, unknown or other
  modified_base (267)..(267): a, c, t, g, unknown or other
  modified_base (354)..(354): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatctggtgggggcagagtctccatcacttgccggcagtcagatattanagctggtgcctggtatcagcagaaaccagggaaacncccctaactcctagatatagtcgggactacttaaagtttaggaaaggtggggtacccagtcggaggttcaggccggcaggtgctcgngggacagtattcactctcacatcagcgctgcagcctgactgtatttgactaacttatactcgacctaatattaacaatgtacttactcggtacgtacggttccggaccgaagggtaccgaggggtagaaacgtacgaaacgtacgtcggtacggactcgacactactctacgtacttactaccg

SEQ ID NO: 384183 - DNA, 577 bp, Homo sapiens
  misc_feature: GZ8MTXP02ILE5K.21.9.A09.1.454.CMB.2.raw
  modified_base (233)..(233): a, c, t, g, unknown or other
  modified_base (275)..(275): a, c, t, g, unknown or other
  modified_base (301)..(301): a, c, t, g, unknown or other
  modified_base (347)..(347): a, c, t, g, unknown or other
  modified_base (362)..(362): a, c, t, g, unknown or other
  modified_base (414)..(414): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtcctccttccaccctgtctgcatcgtggtgggggcagagtctcatcacttgccggcagtcagtatattanagctggtcggcctggtatcagacaaggaaaccagggaaaccncccctaactcctagatatacgtcggntacttaagttaagaaggtcgggtaccagtcgaggttcaggtccggnaggtgctgtaggacngtatcactcacacatcagcgctgcagcccgatgtatttgactattatactanacctaaactattactaatatattaccgtcgtacggttaccgttaccggacgtaaacggggaaccgtaggggtaaacgtaaaacgttaaccgaaaacggtaccgttaggttacggactacggaacctaacgtacgttccgttagttcctttactactttccccg

SEQ ID NO: 384184 - DNA, 552 bp, Homo sapiens
  misc_feature: GZ8MTXP02JXV81.21.9.A09.1.454.CMB.2.raw
  modified_base (236)..(236): a, c, t, g, unknown or other
  modified_base (258)..(258): a, c, t, g, unknown or other
  modified_base (507)..(507): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtcctccttccaccctgtctgcatcgtggtgggggcagagtctccatcacgttgccggcagtcagtaatattanagtctggttcggctggtatcancgaagaaaccgaggaaaccgcccctaacctctagatatagtcggactactaagttaggaaaggtcgggtacccagtcggtagtcgaggcccggcaggtcgctcggagggacagtactcactctcacctatcgacgccgcctgcacgcccgtatgtatttcgactattactactcgactaactatacatgtatacgtcgtacgtacgtacggacgaacggacgtaaggtacgaaactacgaaacgtacgngtacggactacgaacgtacctacgttctcgttacttcacttcccg

SEQ ID NO: 384185 - DNA, 555 bp, Homo sapiens
  misc_feature: GZ8MTXP02JDM6L.21.9.A09.1.454.CMB.2.raw
  modified_base (233)..(233): a, c, t, g, unknown or other
  modified_base (271)..(271): a, c, t, g, unknown or other
  modified_base (348)..(348): a, c, t, g, unknown or other
  modified_base (362)..(362): a, c, t, g, unknown or other
  modified_base (376)..(376): a, c, t, g, unknown or other
  modified_base (385)..(385): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatctggtgggggcagagtctccatcacttgccgggcagtcagaatattanagctggttgcctggtatcagcaagaaaccagggaaacnccccctaaactcctagatatagtcgggcgtactaaagtttaggaaaaggtggggtacccagtcgaggttcagccggnagtggctgtgggangaattcatctcacntcagcgccngcagctgatgtatttgactaactttatacgtcgacctaaatatttaacaaattcgtaactttacgtccggtacgttacggttccggacgtaaacggggacctaggggtagaaactacgaaaacggtacgtaggtcgactgaccgaacctattcctaggttccttactacc

SEQ ID NO: 384186 - DNA, 510 bp, Homo sapiens
  misc_feature: GZ8MTXP02H0ODB.21.9.A09.1.454.CMB.2.raw
  modified_base (232)..(232): a, c, t, g, unknown or other
  modified_base (335)..(335): a, c, t, g, unknown or other
  modified_base (340)..(340): a, c, t, g, unknown or other
  modified_base (349)..(349): a, c, t, g, unknown or other
  modified_base (359)..(359): a, c, t, g, unknown or other
  modified_base (476)..(476): a, c, t, g, unknown or other
tcagtcgtcgctcgcacgaccggtgctcgatttagcgagacgcgcagggggcaggagtcagacccagtcaggacacagcatggacatgagggtcccccgctcagctcctggggctcctgctgctctggctcccaggtgccaaatgtgacatccagatgacccagtctccttccaccctgtctgcatctgtgggggcagagtctccatcacttgccggcagtcagaatattanagtctggttggcctggtatcagcaagaaacagggaaacgcccctaaacctctagatatatcgggactactaaattagaaagtgggtaccatcgagtcagccgnagtgntctaggacngaattcactncacatcagcgctgcagcctgatgtatttgactaacttatactgaccaatattacaatgaatactcgcgtacgttcgacgaacggacaagggtagaaaactcgaaaacgaacttcggngactaacgacctaacgtactacgtcttctactcg

SEQ ID NO: 384187 - DNA, 551 bp, Homo sapiens
  misc_feature: GZ8MTXP02IRFUS.21.9.A09.1.454.CMB.2.raw
  modified_base (233)..(233): a, c, t, g, unknown or other
  modified_base (267)..(267): a, c, t, g, unknown or other
  modified_base (427)..(427): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtcctccttccacctgtctgcatcgtggtgggggcagagtctcatcacttgccggcagtcagtaatattanagctggtgctggtatcagcagaaacagggaaacncccctaactctagattatacgtcgggtacttacttaaagtttaggaaaaggttcggggtacccagtcgtaggttcaggccggtcagtcggctcgtagggacagtacttcactctaccacatcagccgtctgacacgcccgtatgtatttcgactaacttntactcactaatatacatagtacttcgtcgcgttacgtcggacgaagggaccgtaagggtacgaaactacgaaaaccgtagtcggtacggctagaacctactattcctgtacctcactttccccg

SEQ ID NO: 384188 - DNA, 591 bp, Homo sapiens
  misc_feature: GZ8MTXP02H0CE2.21.9.A09.1.454.CMB.2.raw
  modified_base (278)..(278): a, c, t, g, unknown or other
  modified_base (290)..(290): a, c, t, g, unknown or other
  modified_base (302)..(302): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtcctccttccaccctgtctgcatcgtggtgggggcagagtctccatcacttgccgggcagtcagtaattattatagtctggttggcctggtatcgagcaagaaacgagggaaacncccctaactctnatatagtcgggntacttaagttaggaaaggtcggggtacccagtacgtaggtcgaggccggacaggtggctcgtagggacagaattcactcgtccacatcgagccgctgcagccgtagatgtatttgacttaaacttacttactacgaccctaaatacttaacaattgtaacttacttacggtcgttaaccggttcggaaccgtaaggggtaccgtaaggggttacggaaaacttacgaaaacggtaacgtcgtacggtctaacggacctaactacgttcgttacgtacctttacgtaccg

SEQ ID NO: 384189 - DNA, 604 bp, Homo sapiens
  misc_feature: GZ8MTXP02H3XIZ.21.9.A09.1.454.CMB.2.raw
  modified_base (239)..(239): a, c, t, g, unknown or other
  modified_base (281)..(281): a, c, t, g, unknown or other
  modified_base (359)..(359): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtcctccttccaccctgtctgcatcgtggtgggggcagagtctcatcacttggccgggccagtcaagtaattattanagtctggtcggcctggtatcagcaagaaaccgaggggaaacncccctaacctctagaatagtagtcgggtactactaaagttaggaaaggtcggggtaccagtcgtaggttcaggtccgnagtgctgtagggacagtaattcactctacaccatcagcgctcgacacgcccgtattgtatttacgacttacttatactactacctaactaattaacaatagtaattaaccgcggttacgtacggttaccggacgtaaacgggggacccgtaagggggtaacgtaaaactaaccgaaaacggtacgtacggtacggtacgacgaaccgtaacccgtattcgtacgttccttactaacctttccccg

SEQ ID NO: 384190 - DNA, 636 bp, Homo sapiens
  misc_feature: GZ8MTXP02JR6IR.21.9.A09.1.454.CMB.2.raw
  modified_base (236)..(236): a, c, t, g, unknown or other
  modified_base (280)..(280): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatcgacccagtcctccttccaccctgtctgcatcgtggtgggggcagagtctcatcacttgccggcagtcagtaattattanagtctggttcgcctggtatcgagacaagaaaccgagggaaaccncccctaacctctagatagtcgtcgggtactacgtaaagtttaggaaacggttcggggtacccaagtccggtaaggttccaggcccggacgtaggtggtcctacggtacggggactacgtaacttcaccgttccacctaccatccgacgccgtcctgaccaccggtcccgtagttcggtaacgttttcgaaccttaactttaactaccgtagtaccctaaattaacttaactaagttacgtaacgttaccgtcggtacgttaccggttcgggaaccgtaagggtaaccgtagggtacaaactacggaaacgtagtcgcgtacacgaactacacgttcgtcgtacctacgacttcccg

SEQ ID NO: 384191 - DNA, 571 bp, Homo sapiens
  misc_feature: GZ8MTXP02INPW8.21.9.A09.1.454.CMB.2.raw
  modified_base (235)..(235): a, c, t, g, unknown or other
  modified_base (273)..(273): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtcctccttccaccctgtctgcatcgtggtgggggcagagtctccatcacttgccggcagtcagtaatattanagctggtggctggtatcagcaagaaaccgagggaaacncccctaactcctagatatagtcgggacttactaaagtttaggaaaggttcggggtacccagtcggtaggttacacggccggtacaggtcggacttcgtacggggaactaggtaacttcgaaccttcctaccactatcgacgccggcctgcagtcctagattgtatttgactaactttacttactgacctaatattacaatgtacttactcgtacgttacggtacgacgaaacgggtacgagggtaagaaactaacgaaacgtacgtcggtacgctgacactatctcgttctactaccg

SEQ ID NO: 384192 - DNA, 567 bp, Homo sapiens
  misc_feature: GZ8MTXP02IUEX4.21.9.A09.1.454.CMB.2.raw
  modified_base (358)..(358): a, c, t, g, unknown or other
  modified_base (390)..(390): a, c, t, g, unknown or other
  modified_base (393)..(393): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtcctccttccaccctgtctgcatcgtgggtgggggcagagtcctccatcacttcggcccgggccagtcaagtaatatttatagcttggttggcctggtatcagcaagaaaccagggaaacgccccctaacctcctagatatgtcgggcttactaaatttaggaaaggttggggtccagtcgaggttcaggccggnaggtcgctcgtgggacagtattcactctcacntcngcgctgcagcccgtatgtattttgactaacttattactcgaacctaactattacaatcgtaacttacgtcgtacgttaaccgttcggaccgtaaaggggaccgtaagggggtagaaaactacgaaaacgtacgtagacgtctacgccacgtactctacgtcttacactttcccg

SEQ ID NO: 384193 - DNA, 574 bp, Homo sapiens
  misc_feature: GZ8MTXP02IKRH6.21.9.A09.1.454.CMB.2.raw
  modified_base (527)..(527): a, c, t, g, unknown or other
  modified_base (570)..(570): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtcctccttccaccctgtctgccatcgtgggtgggggcagtagtcctccatccacgttcgccgggcagtcagtaattattatagtctggtgtctaggtatcagacaagaaaccgaggaaacgtcccctaacctctagattatagtcgggtacttctaaaagtttaggaaaaggtcggggtacccagtacgtaggttacaggcgctagtcggctacgtgggaactaggtaacttccgaacttcctaccacagttccgagccgcctgcacgcccgtatcgtatttgactaaactgtactacgtacaactattaacattgacttacacgtgtacgtcggaaccgtaagggaccctaagggaagtaaanacgaaaacgagttcgaggtcctagccaactactctctactacnctcc

SEQ ID NO: 384194 - DNA, 619 bp, Homo sapiens
  misc_feature: GZ8MTXP02F1PGF.21.9.A09.1.454.CMB.2.raw
  modified_base (235)..(235): a, c, t, g, unknown or other
  modified_base (273)..(273): a, c, t, g, unknown or other
  modified_base (362)..(362): a, c, t, g, unknown or other
  modified_base (374)..(374): a, c, t, g, unknown or other
  modified_base (379)..(379): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatctggtgggggcagagtctccatcacttgccgggccagtcagaatatttanagctggttggcctggtatcagcaagaaaccaggaaacncccctaactcctagatatagtcggacttactaatttaggaaagtcggggtccctagtcgaggttcagcccggctaggtgctgtgggacngaattcactctnacatnacgcgcctgcacgcccgatgtatttcgactaacttagttacctacggaacctaactaatttaaccaaagtttacgaaacgtttccgtaccggttaccggttaaccggttaccggacccggtaaagggggtaacccgtaagggggttaaccgaaaagtaccgtaaaaaccggtacgtacggtaacggggcttacgaaccgtaaccagttcccgttaggttcccttaacgtacctttccccg

SEQ ID NO: 384195 - DNA, 507 bp, Homo sapiens
  misc_feature: GZ8MTXP02IH6NT.21.9.A09.1.454.CMB.2.raw
  modified_base (250)..(250): a, c, t, g, unknown or other
  modified_base (265)..(265): a, c, t, g, unknown or other
  modified_base (277)..(277): a, c, t, g, unknown or other
  modified_base (283)..(283): a, c, t, g, unknown or other
  modified_base (287)..(287): a, c, t, g, unknown or other
  modified_base (315)..(315): a, c, t, g, unknown or other
  modified_base (320)..(320): a, c, t, g, unknown or other
  modified_base (323)..(323): a, c, t, g, unknown or other
  modified_base (327)..(327): a, c, t, g, unknown or other
  modified_base (329)..(329): a, c, t, g, unknown or other
  modified_base (387)..(387): a, c, t, g, unknown or other
  modified_base (401)..(401): a, c, t, g, unknown or other
tcagtcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccacctgtctgcatctggtgggggcagagtctccatcacttgccgggcagtcagatattatagctggttgctggatcagnaagaaacaggaaacncccctaactctnatatancggntactaattagaaagtggtccatcgagtnagcgnagngacngnggacagattcactctacacatcagcgcctgcagctgatgatttgactaacttattacnaaccaatattaaanaatgtattacgtcgtacgtacgtacgacgaaacggtacgagggtaaagaaactaacgaaaacgtacgtacggtcgtacgtcgactactactactcttactactacg

SEQ ID NO: 384196 - DNA, 539 bp, Homo sapiens
  misc_feature: GZ8MTXP01B2AGX.15.76.G10.1.454.CMB.2.raw
  modified_base (378)..(378): a, c, t, g, unknown or other
  modified_base (480)..(480): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcattatagtaacaaaacaacaaacactacctacggacccctcgacccgattcctcaaggcctccctccgttcgggggcaaagctcgccctagaccnctcgtctgggtgtcgcagcctgacgacgaggctgactattactcgcctactctactttggtgtggcttgtgctagtcggcggaggaccagcctgtaccggtntaacgtcacgccgaaggctcgccccgttcgcaactctcgtcccacccttctcgctaacg

SEQ ID NO: 384197 - DNA, 515 bp, Homo sapiens
  misc_feature: GZ8MTXP01B58YQ.15.76.G10.1.454.CMB.2.raw
  modified_base (434)..(434): a, c, t, g, unknown or other
  modified_base (475)..(475): a, c, t, g, unknown or other
  modified_base (487)..(487): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtaacaaacaacaaacactacctacggacccctgcccgaattctcaggctccctccgttcgggggcaaagctcgccctgaccaactgtctggtgtgcagcctgagacgagctgactattactgcctatctacttgtgtgctgtnctatcggcgaggacagctgacgtctaagtcagcccaaggcncgccccgttgcnctctcgttccccgccttcctcgctaacg

SEQ ID NO: 384198 - DNA, 520 bp, Homo sapiens
  misc_feature: GZ8MTXP01DYY8Y.15.76.G10.1.454.CMB.2.raw
  modified_base (368)..(368): a, c, t, g, unknown or other
  modified_base (432)..(432): a, c, t, g, unknown or other
  modified_base (493)..(493): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcattatagtaacaaacaaacaaacactcctcggacccctgcccgattctcagctccctccttcgggggcaaagctcgccctgacncgtgtctggtgtgcagcctgagacgaggctgactattactgcctactctacttggtgtgctgtncgtatcggcggaggaccaagtctgaccgtctaagtcagcccaaggcctcgccccgttggcnctctcgttcccaccttcctcgctaacg

SEQ ID NO: 384199 - DNA, 524 bp, Homo sapiens
  misc_feature: GZ8MTXP01B0ZVR.15.76.G10.1.454.CMB.2.raw
  modified_base (362)..(362): a, c, t, g, unknown or other
  modified_base (372)..(372): a, c, t, g, unknown or other
  modified_base (455)..(455): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgatctcagctcctccttcggggcaaagctgccctgacnctgtctggtntgcagcctgagacgaggctgactattactgcctactctacttgtggtgctgtgctattcggcggaggaccaagtctgaccgtnttaaagtcagcccaaaggcctgcccccgttggttcctaactctcgttcccgcccttcctccgctaaccg

SEQ ID NO: 384200 - DNA, 531 bp, Homo sapiens
  misc_feature: GZ8MTXP01BYZLR.15.76.G10.1.454.CMB.2.raw
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctaggacccctgcccgattctcaggctcctccttcgggggcaaagctgccctcgacaactgtctggtgtgcagcctgaggacgaggctgactatactgcctactctactttggtcgtggctgtgctagttcggcggaggtaccaagctgacctcgttaatcagcccaaggcctcgcccccgttcggttccaactctcgttcccaccgttcctcgcgtaacg

SEQ ID NO: 384201 - DNA, 715 bp, Homo sapiens
  misc_feature: GZ8MTXP01CP1DL.15.76.G10.1.454.CMB.2.raw
tcagtctacgtagccacgaccggtgctcgatttagtcactcatacaggggggcgccaggggtcccttccaatatcagcaccatggcctggactcctctctttctgttcctcctcacttgctgcccaggactccaattctcagactggtggtgactcgaggacgccctcactgactgtcgtccccgagggagggacagtcactctccacctgtcgccttaccaaacacgtggacgcagtaccaaccagtcgtacttaactactaccaaaacgttcggttaccagcaacgaaacctggaacaagccacccgagggacactactaattataagtaacaaaacaaacaaacacctcctaccggacccctcgacccgtacttcctaccgacggtcccttccccgttccccggttacggggggaacaaacggtccgtaccgaccccttaggaaccacgttcgtccgtgggtgtcgcgacgccgtggagggacgaggctaggtaacttactactcgtacctactcttacgttgggtggggtcgtcgttgtcgtacgttacggttcgggacgggaacgggaccgtaaggtccgtacggtaccggttaacgtttaaacggccgaaccggacccggtaaacggtccgttaccccggttccccgttccggtaaccctaccgttcccgttcccgtcccccttaccccttcccgttccggttaacccg

SEQ ID NO: 384202 - DNA, 552 bp, Homo sapiens
  misc_feature: GZ8MTXP01APEFQ.15.76.G10.1.454.CMB.2.raw
  modified_base (327)..(327): a, c, t, g, unknown or other
  modified_base (362)..(362): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactgtccagcagaaacctggacaagcacccagggcactcatttatagtacaaacaacaaacactcctgacccctgcccgattcncaggctccctccttcggggcaaagctgccctgacnctgtctggtgtgcagccctgaggacggaggctgacgttattactgtccgtacttctactttggtggtggctgtgtcgtagttcggcggagggaccaagtccgtagaccgtcttaagtcacggcccgaaggcctcgcccccgttcggttcctaactcctcgttccccaccccttcctccgcgttaacccgg

SEQ ID NO: 384203 - DNA, 554 bp, Homo sapiens
  misc_feature: GZ8MTXP01BIKES.15.76.G10.1.454.CMB.2.raw
  modified_base (379)..(379): a, c, t, g, unknown or other
  modified_base (524)..(524): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtaacaaacaaacaaacactcctaggacccctgccccgattctcacggctccctccgttcgggggaccaaagcctgcccctagaccnctgtctgggtgtcgcagcctgaggacgaggctgactattactgcctactcttacttggtggtggtctgtgtctagttcggcggtacggaccaagtctcgaccgtcgttaagtcgagcccgaaggcctcgcccccgttcggttccnctctcgtccccacccttcctcgcgtaaccg

SEQ ID NO: 384204 - DNA, 573 bp, Homo sapiens
  misc_feature: GZ8MTXP01B2DK4.15.76.G10.1.454.CMB.2.raw
  modified_base (284)..(284): a, c, t, g, unknown or other
  modified_base (385)..(385): a, c, t, g, unknown or other
  modified_base (416)..(416): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtcagcagaaactgacaagcaccaggcactcatttanagtaacaaacaaacaaacactcctacgaccccctgcccgattcctcacggcctcccgtcgttccgggggacaaagcctacgccctagactctgtctgggtntcgcagcctgacgacgagcgtgactattacngcctactcttacgttgtcggtggctgtgctagttcggcggacggtaccaagtcgtacgaccgtcgttaacgtcacggacccgaaggccgtccgttcccccgttcggttcctaaccctccttccgtcccccgtcccttcccgtcgttccgttaaccgg

SEQ ID NO: 384205 - DNA, 522 bp, Homo sapiens
  misc_feature: GZ8MTXP01DAR2C.15.76.G10.1.454.CMB.2.raw
  modified_base (290)..(290): a, c, t, g, unknown or other
  modified_base (361)..(361): a, c, t, g, unknown or other
  modified_base (457)..(457): a, c, t, g, unknown or other
  modified_base (494)..(494): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttanagtacaaacaacaaacactcctggacccctgcccgatctcagctcctcctcggggcaaagctgccctgacnctgtctgggtgtgcagcctgaggacgaggctgactattactgcctactctacttggtggtgctgtgctattcggcggagggaccaagctgaccgtnttaaagtcacgcccaaggcctgcccccgttggttccnctctcgttcccgccttcctcgcgtaacg

SEQ ID NO: 384206 - DNA, 522 bp, Homo sapiens
  misc_feature: GZ8MTXP01BM2M2.15.76.G10.1.454.CMB.2.raw
  modified_base (364)..(364): a, c, t, g, unknown or other
tcagtctacgtagccacgaccggtgctcgatttagtcactcatacaggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttcggggcaaagctgccctgacnctgtctggtgtgcagccctgagacgaggctgactattactgcctactctactttggtcgtggtctgtgctattcggcggtaggactagctgaccgtcttaaagtcagcccaaggctcgccccttggttcaactctcgtcccaccttcctcgctaaccg

SEQ ID NO: 384207 - DNA, 557 bp, Homo sapiens
  misc_feature: GZ8MTXP01CEFOE.15.76.G10.1.454.CMB.2.raw
  modified_base (376)..(376): a, c, t, g, unknown or other
  modified_base (476)..(476): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtaacaaacaacaaacactacctcggaccccctgaccccgattctcacggctcccctccgttcgggggcaaagctgccctagacnctgtctggtgtgcagccctgaggacgaggctagactagttactgcctactctacttggtgtggctgtgctagttcggcggaggaccaagtcgtgaccgtnttaacgtcacgacccaaggcctcgcccccgttcggttccaaccttcctccgttccccacccttcctccgttcgttaaccgg

SEQ ID NO: 384208 - DNA, 543 bp, Homo sapiens
  misc_feature: GZ8MTXP01DPISA.15.76.G10.1.454.CMB.2.raw
tcagtctacgtagccacgaccggtgctcgatttagtcactcatacagggggcgccaggggtcccttccaatatcagcaccatggcctggactcctctctttctgttcctcctcacttgctgccccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcattatagtaacaaacaacaaacactcctggacccctgccccgatctcacggctccctccgttcgggggcaaagctcgccctgacaactgtctggtgtgcagcctgaggacgaggctgactattactgcctactctactttggtggtgcttgtgtctagttcggcggtagggaccaagtctggaccgtcttaagtcagcccgaaaggtcctcgccccgttcggttctcgtctcgttcccacccttcctcgcgttaaccg

SEQ ID NO: 384209 - DNA, 557 bp, Homo sapiens
  misc_feature: GZ8MTXP01DV5S4.15.76.G10.1.454.CMB.2.raw
  modified_base (291)..(291): a, c, t, g, unknown or other
  modified_base (379)..(379): a, c, t, g, unknown or other
  modified_base (390)..(390): a, c, t, g, unknown or other
  modified_base (482)..(482): a, c, t, g, unknown or other
  modified_base (539)..(539): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttanagtaacaaacaaacaaacactacctcggacccctgaccccgattctcacggctcccctccgttcgggggccaaaagctcgccctgacnctgtctgggtntgcagactgaggacgagctgactattactgtcctactctacgtttggtggtgcttgtgcgtattcgggcggagggaccaagtctagaccgtnttaagtcacgcccgaaaggctccgcccccgttggttccaaccgttctcgttaccccnccttcctcgccttaaccg

SEQ ID NO: 384210 - DNA, 542 bp, Homo sapiens
  misc_feature: GZ8MTXP01A46PM.15.76.G10.1.454.CMB.2.raw
  modified_base (163)..(163): a, c, t, g, unknown or other
  modified_base (290)..(290): a, c, t, g, unknown or other
  modified_base (332)..(332): a, c, t, g, unknown or other
  modified_base (373)..(373): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctnactgactgtgtccccaggagggacagtcactctcacctgtgcttccaacactggagcagtcaccagtgcttactatccaaactggttccagcagaaacctggacaagcacccagggcactcatttanagtacaaacaacaaacactcctggacccctgccccgattccncacggcctccctccgttcgggggcaaagctgcccctagacnctgtctggtgtgcagccctgaggcgagggctgactatactgcctactctacgtttggtggtggctgtgcgtattcggcggaggacccaagtctgaccgtcttaagcagcccaaggcctcgcccccgttggttccaacttctcgttccccaccttccctcgcgttaaccg

SEQ ID NO: 384211 - DNA, 546 bp, Homo sapiens
  misc_feature: GZ8MTXP01BFCVE.15.76.G10.1.454.CMB.2.raw
  modified_base (376)..(376): a, c, t, g, unknown or other
  modified_base (482)..(482): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtaacaaacaacaaacactcctacggacccctgccccgattctcacgcctccctccgttcgggggcaaaggctcgcccctagaccnctgtcgtgggtgtgcacgcctgaggacgagggctgactagttactcgcctactcttactttgggtggtgtcgtgtgctagttcggcggaggaccagtctgaccgtnttaagcacgccgagcctcgccccgttcggttccaacgtctcgtccccacccttctcgcgtaacg

SEQ ID NO: 384212 - DNA, 816 bp, Homo sapiens
  misc_feature: GZ8MTXP01D9F5W.15.76.G10.1.454.CMB.2.raw
tcagtctacgtagccacgaccggtgctcgatttagtcactcatacaggggggcgccaggggtcccttccaatatcagcaccatggcctggactcctctctttctgttcctcctcacttgctgccccagggtccaattctcagactgtggtgactcaggagccctcactgactgtgtccccaggagggacagtcactctcacctgtgcttccaacactggagcagtcaaccagtgcttactatccaaactggttaccagcagaaacctggacaagcacccaggcactcatttatagtaacaaacaacaaacactacctacggacccctgaccccgtattctcgaacggcctccccgttccgtttaccggggggacctaaaacggccttacggcccccttacggaaccctaacgttcggttcccgttggggttcgttcggccgaaggtccccgttacgggaaggggtaccggtaagggccgttaagggtaaccgtttaaacgttttaaaccttcggtaccccgtttaaccgttaccctttaaccgtttttacgggggttacggggtttggggtcccgtttggggtttaccggttccgtttaaacggtttcccgggggtaccgggggtaacgggggtaaaccccgaaagggtccgttaacgggtaccccgggttaacttttaaaacggtcccggttaacggtaccccgaaacggggtcccttccgggacccccccgtttcgggttaccccgtaacccgttcccttcccggtttcccccctacccccttacccgtttccccgttccgtttaaaccccggg

SEQ ID NO: 384213 - DNA, 530 bp, Homo sapiens
  misc_feature: GZ8MTXP01B274L.15.76.G10.1.454.CMB.2.raw
  modified_base (291)..(291): a, c, t, g, unknown or other
  modified_base (370)..(370): a, c, t, g, unknown or other
  modified_base (448)..(448): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttanagtacaaacaacaaacactacctgacccctgccccgattctcacggctccctccgttgggggccaaagctgccctgacnctgtcctgggtgtgcagccctgaggacgaggctagactattactgcctactctacttggtcgtgctgtgctattcggnggagggacagctgccgtctaagtcagcccaaggctcgccccgttcggctaactctcgttcccgccttccctcgccgttaacg

SEQ ID NO: 384214 - DNA, 590 bp, Homo sapiens
  misc_feature: GZ8MTXP01C1WHJ.15.76.G10.1.454.CMB.2.raw
  modified_base (383)..(383): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttaccagcagaaacctggacaagcacccaggcactcatttatagtaacaaacaacaaacactcctacggaccccctgcccgattcctacacggtcctcccgtccgttcgggggacaaacgctcgccctacgacnctgtcgtgggtgtgctagccgtgaggacggagctgactattactgcctctcttacgtttggtgtggtcgtgtgtcgtagttcggcggagggaccaagtctcggaccgtcttaaacggtcacgccgaacgggtccgtcgttacccccgttcggttaccaacccgttccgttccggttccccgccccttccgtccgttcgttaacccgg

SEQ ID NO: 384215 - DNA, 608 bp, Homo sapiens
  misc_feature: GZ8MTXP01B9HMD.15.76.G10.1.454.CMB.2.raw
  modified_base (270)..(270): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggacgccctcactgactgtcgtccccaggagggacagtcactctcacctgtgccttaccaacactggagcagtcaccagtgacttactactccaaactggtaccagcaagaaacnggacaagcaccgaggcactctattataataaacaaacaaacaaacactcctacggacccctgcccgtactctcacggcctccgtcgtcggggacaagctacgccctaagacctcgtcgtcgtggtgtcgacacgccctaggacggacgacggtctagtactagttactcgtcctacttacgttcgttggtgtggctttggcgtacgttagtcgggacgggaacggaccgtacgtacgtcggtaaccgttacgttaaacgcgacggcccgttacgccgtcccgttccccgttcgttccctaactccgtcccttacccctccgttcctccgttcgtaacg

SEQ ID NO: 384216 - DNA, 660 bp, Homo sapiens
  misc_feature: GZ8MTXP01CFT4N.15.76.G10.1.454.CMB.2.raw
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgccttccaacactggagcagtcaccagtgcttactataccaaacttggttccagcagaaacctggacaagcacccagggcactcatttatagtaacaaaacaacaaacactaccctacggaccccctcgccccgaattcctcacggcctccctccgttcgggggacaaagctcgccctagacaactcgtctggtgtgctagccctgaggacgaggctagactattactcgtcctactcttacgttggtggtcggtcgttggtcgtcgtagttcgggcgggacgggtaaccgaaggtccgtacggtacccgttacgttaaacggttccgaccggtaccccgaaacgggtcccgtcccgggttcccccccgttccggggttacccctaacccggttccctttcccggtttacccccctaccccctttccccgttcccgggttccctttaaacccgggg

SEQ ID NO: 384217 - DNA, 623 bp, Homo sapiens
  misc_feature: GZ8MTXP01DOSFQ.15.76.G10.1.454.CMB.2.raw
  modified_base (288)..(288): a, c, t, g, unknown or other
  modified_base (305)..(305): a, c, t, g, unknown or other
  modified_base (332)..(332): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaactggacaagcaccaggcactctattanataacaaacaacaaacnctcctacgacccctcgacccgtattcncacgcctcccgtcggtcgggacaaagctcgccctagactcgtgtcgtggtgtcgcgacgccgtaggacggacgtacggtcttaacttacttactcgtccttactcgttacgtttggtgtcgtcgtgtgtcttaggttccggcggtacggaccaagtccgtacggtaccgtacgttaacgaaccgtaccgacccggtaacggttccgtccccggtcccccgttccggttccttacccgttccgttccccgttcccccggtcccctccccgttcgtcccgttaacggtaaccg

SEQ ID NO: 384218 - DNA, 546 bp, Homo sapiens
  misc_feature: GZ8MTXP01ANQNR.15.76.G10.1.454.CMB.2.raw
  modified_base (371)..(371): a, c, t, g, unknown or other
  modified_base (471)..(471): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcagaaacctggacaagcaccaggcactcatttatagtacaaacaacaaacactcctaggacccctgccccgaattctcaggcctcccgtccgttcgggggcaaagctcgccctgaccnctgtccgtggtgtgcacgcctgaggacgaggctgactatactgcctactcttacttggtggtgcgtgtgctagttcggcggaggaccaagtctgaccgtntaacgtcgacgccgaaggcctcgcccccgttggttccaacgttctcgttcccgcccttcctcgttccgtaaccgg

SEQ ID NO: 384219 - DNA, 606 bp, Homo sapiens
  misc_feature: GZ8MTXP01BRO5K.15.76.G10.1.454.CMB.2.raw
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactctattatagtaaacaaacaaacaaacactccgtacggacccctgaccccgtattcctcacggcctccctcgtcggggacaaagctcgccctagactctgtcgtggtgtgcgagcccgtaggacggacggacggtacttactaactttacgtctaccttactcttacgtttggtgtgtcgttgtgtctagttcgggcggtacggaccgtaagcgtcggaccgttcgttaacgtcaacgccgaacggccgtcccgtccccgttcggttccttaccgttccgttcccgttcccctcccgttccgttccgtccgttaacggtaacg

SEQ ID NO: 384220 - DNA, 538 bp, Homo sapiens
  misc_feature: GZ8MTXP01BBRFH.15.76.G10.1.454.CMB.2.raw
  modified_base (292)..(292): a, c, t, g, unknown or other
  modified_base (315)..(315): a, c, t, g, unknown or other
  modified_base (333)..(333): a, c, t, g, unknown or other
  modified_base (371)..(371): a, c, t, g, unknown or other
  modified_base (507)..(507): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaaacctggacaagcacccgaggcactcatttanagtaacaaacaacaaacactccnggacccctgcccgattcncaggcctccctcgttcggggcaaagctcgccctagacnctgtctggtgtgcagccctgaggacgaggctgactattactgcctacttctacgtttggtgtggctgtgctagttcggcggtacgggaccaagctcgtacgtctaagtcacgccgagcctcgccccttcggttccnctcctccgttcccgcccttcctcgctaacgg

SEQ ID NO: 384221 - DNA, 524 bp, Homo sapiens
  misc_feature: GZ8MTXP01C1TK1.15.76.G10.1.454.CMB.2.raw
  modified_base (334)..(334): a, c, t, g, unknown or other
  modified_base (360)..(360): a, c, t, g, unknown or other
  modified_base (391)..(391): a, c, t, g, unknown or other
tcagtctacgtagccacgaccggtgctcgatttagtcactcatacaggggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgatctcagctccnccttcggggcaaagctgccctagacnctgtctggtgtgcagccctgagacgagggcngactagttactgcctactctactttggtgtggctgtgcgtattcggcggtagggaccaagctgccgtctaagtcagtcccaaggctcgccccgttcggttcaacctctgtccccaccttcctccgctaaccgg

SEQ ID NO: 384222 - DNA, 520 bp, Homo sapiens
  misc_feature: GZ8MTXP01DHLKV.15.76.G10.1.454.CMB.2.raw
  modified_base (290)..(290): a, c, t, g, unknown or other
  modified_base (366)..(366): a, c, t, g, unknown or other
  modified_base (398)..(398): a, c, t, g, unknown or other
  modified_base (465)..(465): a, c, t, g, unknown or other
  modified_base (495)..(495): a, c, t, g, unknown or other
  modified_base (505)..(505): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttanagtaacaaacaacaaacactcctggaccccctgccccgtatctcagctcctccttgggggcaaagctgccctgacnctgtctgggtgtgcagccctgaggacgaggcngactatactgcctactctacttggtgtggcttgtgtctagtcggcggagggaaccaagtctgacctntaagtcagccaagctcgccccgttgttccntctcgtcccnccttcctcgctaacg

SEQ ID NO: 384223 - DNA, 549 bp, Homo sapiens
  misc_feature: GZ8MTXP01DLKWG.15.76.G10.1.454.CMB.2.raw
  modified_base (369)..(369): a, c, t, g, unknown or other
  modified_base (399)..(399): a, c, t, g, unknown or other
  modified_base (408)..(408): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccaggcactcatttatagtaacaaaacaacaaaacactacctggacccctgcccgattctcaggctcctccttgggggcaaaagctgccctgacnctgtctgtgtgcagcctgaggacgaggctnatatactcnctactctacttgtggtggtcgtgtgtcgtacgttcggcgggacggaacgaacgtacgtacgtaccgtacgttaaacgtacgacgaccgaacggcgtcgcccgcttcgtctactctcgttcccgttccctcccgttccgtcg

SEQ ID NO: 384224 - DNA, 692 bp, Homo sapiens
  misc_feature: GZ8MTXP01BXZL7.15.76.G10.1.454.CMB.2.raw
  modified_base (314)..(314): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgcttaccaacactgggagcagtcaccgagtcgtcttaactactaccaaacgtcggttaccagacaacgaaacctggaacaagccacccgaggacactactaatttaanaagtaaacaaaacaaaccaaacacctacctacggacccctcgacccgtaattcacacggtcctcccgtcggtacggggacaaagtcctcgccctagaactcgtgtcgtggtatcgactacgccgtaggacggacggacggcgtagtaacttaacgttaccgtacgtaccctacgttacgttacgtttgggtggtcggtcgttggtcgtcgttaggtccggggacggaacgggaccgtaagtccgtacggttaaccgtaaggtttaaccgcgaccggtaaccccgaaggtccccgttcccggttcccccgttcggttccctaaccctttcctccccggttacccccgtaccccttccccgtcgttaacccgttaaccgg

SEQ ID NO: 384225 - DNA, 535 bp, Homo sapiens
  misc_feature: GZ8MTXP01CTULC.15.76.G10.1.454.CMB.2.raw
  modified_base (368)..(368): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtccagcagaaacctggacaagcacccagggcactcatttatagtacaaacaacaaacactacctggacccctgcccgattctcagctccctccgttcgggggcaaagctgccctagacnctgtctggtgtgcagccctgaggacgaggctgactattactgcctactctacttggtgtggctgtgctagttcggcggaggaccaagtctgccgtcttaagtcagcccgaaggcctcgcccccgttcggttccaactctcgttccccgcccttcctcgcgttaaccg

SEQ ID NO: 384226 - DNA, 542 bp, Homo sapiens
  misc_feature: GZ8MTXP01AW25B.15.76.G10.1.454.CMB.2.raw
  modified_base (288)..(288): a, c, t, g, unknown or other
  modified_base (364)..(364): a, c, t, g, unknown or other
  modified_base (375)..(375): a, c, t, g, unknown or other
  modified_base (474)..(474): a, c, t, g, unknown or other
  modified_base (522)..(522): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcattanagtaacaaacaacaaacactctcgacccctgcccgattctcagctccctcgttcggggacaaagctgccctagacnctgtctgggtntgcagcctagaggaacggaggtacttactacttaactcgcctacttcttacttgggtggtgcgtgtgctagttcggcggacggacaacgctgacccgtntaacggtcacgcccgaagcgtcgccccttcggttccactctcgtcccncctccttactcgttcgtaag

SEQ ID NO: 384227 - DNA, 530 bp, Homo sapiens
  misc_feature: GZ8MTXP01A72MC.15.76.G10.1.454.CMB.2.raw
  modified_base (366)..(366): a, c, t, g, unknown or other
  modified_base (378)..(378): a, c, t, g, unknown or other
  modified_base (388)..(388): a, c, t, g, unknown or other
  modified_base (515)..(515): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcattatagtacaaacaacaaacactcctggacccctgcccgattctcagctccctccttcgggggcaaagctagccctagacnctgtcctgggtntgcagcctgngacgaggctgactatactgcctatctactttgtggtggctgtgcgtattcggcggaggggacccaagtctaggaccgttcgtaaagtcagcccaagggctcgccccgttcggcaacgtctcgtcccncccttctcgctaacg

SEQ ID NO: 384228 - DNA, 553 bp, Homo sapiens
  misc_feature: GZ8MTXP01AOP95.15.76.G10.1.454.CMB.2.raw
  modified_base (290)..(290): a, c, t, g, unknown or other
  modified_base (387)..(387): a, c, t, g, unknown or other
  modified_base (458)..(458): a, c, t, g, unknown or other
  modified_base (468)..(468): a, c, t, g, unknown or other
  modified_base (489)..(489): a, c, t, g, unknown or other
  modified_base (537)..(537): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttcccagcagaaacctggacaagcaccaggcactcatttanagtaacaaacaaacaaacactcctacggaccccctgcccgaatttcctcacggcctaccccgtccgtttcgggggaccaaagcctcgccctagaccncgtgtccgtggtgtgcagcctgaggacgaggctagacttatactgtcctacttctacgttggtgtgcttgngctagtcggnggagggacaagtctgaccgtntaagtcacgtccaggcctcgccccgttcgctaacctcgtccttccccnccttcctcgccgtaag

SEQ ID NO: 384229 - DNA, 521 bp, Homo sapiens
  misc_feature: GZ8MTXP01AVBPG.15.76.G10.1.454.CMB.2.raw
  modified_base (364)..(364): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcattatagtacaaacaacaaacactcctggacccctgcccgattctcaggctccctcttcgggggcaaagctcgccctgacnctgtctcggtgtgcagcctgaggacgaggctgactattactgcctactctacttggtggtgctgtgcttatggcggagggaccaagctgaccgtctaagtcagcccaggctgcccccgttggttccaactctcgttcccacccgttctcgctaaccg

SEQ ID NO: 384230 - DNA, 579 bp, Homo sapiens
  misc_feature: GZ8MTXP01CSTGR.15.76.G10.1.454.CMB.2.raw
  modified_base (214)..(214): a, c, t, g, unknown or other
  modified_base (371)..(371): a, c, t, g, unknown or other
  modified_base (551)..(551): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaaanactggagcagtcaccagtgcttactatccaaactggttaccagcagaaacctggacaagcaccaggcactcattatagtaacaaacaacaaacactccacggacccctgcccgtaatctcacggcctcctccgtcggggacaaagctgccctagacnctgtctggtgtgcagccgtgacggacgaaggctgactagttactgacctatctacgttggtgtcgcttgtcgcgttagttcggcggacggaaccgtaagccgtacgaccgttgttaacgcacggtacccgaacggtcctccgttcccccgttcggttacctccgtccttccggttccccncccgttcctccggttaacttaacccggg

SEQ ID NO: 384231 - DNA, 573 bp, Homo sapiens
  misc_feature: GZ8MTXP01D26A7.15.76.G10.1.454.CMB.2.raw
  modified_base (292)..(292): a, c, t, g, unknown or other
  modified_base (376)..(376): a, c, t, g, unknown or other
  modified_base (380)..(380): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgccccagggtccaattctcagactgtggtgactcaggagccctcactgattgtgtccccaggagggacagtcactctcacctgtgcttccaacactggagcagtcaccagtgcttactatccaaactggttaccagcagaaacctggaacaagcaccaggcactcatttanagtaacaaaacaacaaacactcctacggacccctgcccgtattctcacgcctcccgtccgttcggggacaaagctcgcccgtanaccncgtgtctcggtgtcgcgagcctaggaaggacgaggctgacttacttactcgtcctacgttctacgtttgggtcggttggcttggtctcgtagttcgggacggacggaccagtcgtcgaccgtctaaacgtcacgaccgaggtcctcgccccgttcgactctctccgttcccacccttccgtccgttcgtaacg

SEQ ID NO: 384232 - DNA, 578 bp, Homo sapiens
  misc_feature: GZ8MTXP01CCWFA.15.76.G10.1.454.CMB.2.raw
  modified_base (373)..(373): a, c, t, g, unknown or other
  modified_base (495)..(495): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtaacaaacaacaaacactcctggacccctcgcccgattctcacgcctcccgtccgttcgggggcaaagctcgccctgacncgtcgtcgtgggtgtgcgacgccgtggaggtacggaggcgtgacttacgttactcgccttactctacgtttggtggttggtcgtgtgtctagtcggcgggagggaccgagtcgtgaccgttntaacgtcacgcccgaacggtccgtcgcccccgttcgttcctaacctttcgttcccctaccctccgttctccgttaacgtaacg

SEQ ID NO: 384233 - DNA, 639 bp, Homo sapiens
  misc_feature: GZ8MTXP01CQZDF.15.76.G10.1.454.CMB.2.raw
  modified_base (221)..(221): a, c, t, g, unknown or other
  modified_base (296)..(296): a, c, t, g, unknown or other
  modified_base (340)..(340): a, c, t, g, unknown or other
  modified_base (383)..(383): a, c, t, g, unknown or other
  modified_base (396)..(396): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttaccaacactggancagtcaccagtgcttactataccaaactggttaccagcaagaaacctggaacaagcaacccaggcactcatttanagtaacaaacaacaaacactcctacggacccctgacccgtatcncacggcctccctccgttcggggaccaaagctcgccctaagacncgtgtcgtgggtntgcacgctagaggacgagctagactattactgacccttacttacttacgtttgggttggtggtcttggtcgtcgttacggttccgggacgggacgggtaaccgaagtcgttacggtaaccgttaccgttaaacgtccgaaccggtaccccgaaaggtccctacccgttccccccgttcgggacccttaaccgttcccgttcggtttcccccgcccgttccccgtccgttcccgtttaaccggg

SEQ ID NO: 384234 - DNA, 641 bp, Homo sapiens
  misc_feature: GZ8MTXP01DZBOR.15.76.G10.1.454.CMB.2.raw
  modified_base (205)..(205): a, c, t, g, unknown or other
  modified_base (291)..(291): a, c, t, g, unknown or other
  modified_base (336)..(336): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtncttccaacactggagcagtcaccagtgcttactatccaaactggttccagcagaaacctggaacaagcaccaggcactcaatttanagtaacaaacaaacaaacactacctggacccctgacccgtattcncacggctcccgtccgttcgggggacaaagctacgccctagactcgtgtcgtggtgtgcagcctagacggacggaggctaggtaccttaacgtttactcgtcccttactacgttacgtttgggtggttcggtcgttggtgtacgttagtccggggacggaagggacccaaggtcctacggtacccgttacgttaaacgtcgacggtacccgaaaggtccttccggttacccccgttcggttacccgtaacccgttccttcccggttccccctacccctttcccgtcccgttaaccgttaacccggg

SEQ ID NO: 384235 - DNA, 564 bp, Homo sapiens
  misc_feature: GZ8MTXP01B3PYE.15.76.G10.1.454.CMB.2.raw
  modified_base (382)..(382): a, c, t, g, unknown or other
  modified_base (485)..(485): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttaccagcagaaacctggacaagcacccaggcactcattatagtaacaaacaacaaacactacctaggaccccctgccccgattcctcaggcctccctccgttcggggggacaaacgctacgccctagaccncgtgtcctgggtgtcgcagcctgagacgaggctgactattactgacctatcttacgttgtcggtgctgtgctagtcggcggaggaccaagtctacgtaccgtnttaacgtcaacggcccaaaggcctacgcccccgttcgggttccaactccttcgttccccgccttcctccgcgttaaccg

SEQ ID NO: 384236 - DNA, 547 bp, Homo sapiens
  misc_feature: GZ8MTXP01EC9QA.15.76.G10.1.454.CMB.2.raw
  modified_base (161)..(161): a, c, t, g, unknown or other
  modified_base (449)..(449): a, c, t, g, unknown or other
  modified_base (454)..(454): a, c, t, g, unknown or other
  modified_base (482)..(482): a, c, t, g, unknown or other
tcagtctacgtagccacgaccggtgctcgatttagtcactcatacagggggcgccagggtcccttccaatatcagcaccatggcctggactcctctctttctgtcctcctcacttgctgcccagggtccaattctcagactgtggtgactcaggagccctnactgactgtgtccccaggagggacagtcactctcacctgtgcttccaacactggagcagtcaccagtgcttactatccaaactggttcagcagaactggacagcaccaggcactcattatataacaaacaacaaacactacctaggaccccctagccccgtaattccgtacacggcctccctccgttcgggggaccaaaaggcctcgcccctacgaacctaacgtgtccgtggtcgtgcagccctggagacgaggctaggacttatactgcctatcctattgtgtcgntagtnctagtcggcgaggaccagtctgaccgtntaagtcagcccttaaaggcctcgccccgttcggactcctctcgttccccaccttctcgcttaacg

SEQ ID NO: 384237 - DNA, 664 bp, Homo sapiens
  misc_feature: GZ8MTXP01A3BSC.15.76.G10.1.454.CMB.2.raw
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgccttccaacactggagcagtcaccagtgcttactatccaaactggttccagcagaaacctggacaagcaccagggcactcattatagtacaaacaacaaacactcctggacccctgcccgtatctcacggctaccctcgttcgggggacaaagctcgccctgaccaactgtcctgggtcgtgcgagcccgtaggacgggacggaagggtctaggtaacttaacgttaccgtcgtacccttaacgttccttaacgtttcgggtgggtgtcgttgtgtcttagttccgggacggaagggtacccaaaggtcctaggtacccgttacgtttaaacggtccgaacggtaccccgaaacgggtcccttaccggcccccccgttccgggttaccctaacccgtttcccgttccccggttccccccgtcccccgttccccgttccggttaacccgtttaaccggg

SEQ ID NO: 384238 - DNA, 597 bp, Homo sapiens
  misc_feature: GZ8MTXP01DU5X7.15.76.G10.1.454.CMB.2.raw
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactactccaaactggttaccagcaagaaacctggacaagcacccaggcactcatttatagtaacaaacaaacaaacactacctacggacccctcgacccgtattctcgacggcctcccgtccgttcgggggacaaagctacgccctagactctcgtcgtggtgtgcacgcctggacggacgaggctagactattactcgtcctactcttacgtttggtcggtgtcgtgtcgtcgtagttcggcggtacggaccagtctacgtaccgtcgttaacgtcgacgaccgaacggccgtcccgccccgttcggttccctaaccgttccgttccgttcccctacccttccgtcccgttcgttaaccgg

SEQ ID NO: 384239 - DNA, 552 bp, Homo sapiens
  misc_feature: GZ8MTXP01DBCC9.15.76.G10.1.454.CMB.2.raw
  modified_base (213)..(213): a, c, t, g, unknown or other
  modified_base (285)..(285): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaanactggagcagtcacagtgcttactatccaaactggttccagcagaaactggacagcaccaggcactcattanagtacaaacaacaaacactcctacggacccctgcccgtatcctcacggcctccctccgttcgggggacaaagctcgccctgaacctctgtctgggtgtcgcgacgccctgacggacgacgggctagtactattactgcctactctacgttggtggtcgtctgtgctagtcggcggaggaccaagtctacgtacgtcttaagtcacgaccgaagcctcgccccgttggttcctaactccgtcgttccccgcccttcctcgcgtaaccg

SEQ ID NO: 384240 - DNA, 695 bp, Homo sapiens
  misc_feature: GZ8MTXP01CPHQL.15.76.G10.1.454.CMB.2.raw
  modified_base (215)..(215): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtcgcttaccaanactggagcagtcaccagtcgacttactactaccaaactcggttaccagcaacgaaaccgtggaacaacgcacccgagggacactacatttaatacgtaaacaaacaacaaactactaccgtacggacccctcgacccgtattcctcgacggtcctcccgtccggttaccggggggactaaaacggtccgtacgccctaacgaactcgtcgtaccgtgggtgtcgacgtacgccgtaggacggaggacggtctacgaacttacttacgtcgtcccgtacttcgttacggttgggttggtcggtcgttaggtcgtacgttacgttcggggacgggtacgggtaaccgaggtccgtacggtacccgttagttaacggtcgacggtacccgaacggtcccgtcccggttaccccgttcgggttaccctaaccgttaccgttcccggttacccctacccgttccgtaaccgttccgttaaccggg

SEQ ID NO: 384241 - DNA, 630 bp, Homo sapiens
  misc_feature: GZ8MTXP01DUTXP.15.76.G10.1.454.CMB.2.raw
  modified_base (232)..(232): a, c, t, g, unknown or other
  modified_base (336)..(336): a, c, t, g, unknown or other
  modified_base (431)..(431): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtncttactatccaaactgttccagcagaaactggacaagcaccgaggcactctaattatagtaaacaaacaaacaaacactccgtacgacccctgcccgtattccncacggtcctcccgtcgttcggggacaaagctcgccctacgactcgtgtcgtggttgcgcgagcctaggaggacggacggctaggtactacttacncgtaccttactccgttacgttggtggtcggtcgtggtcgtcgttaggttccgggacgggtaggaaccgaagtcgtacggtaccgttacgtttaaacggcacggacccgaaacggtcccgtcccgttcccccgttcgggttccctaaccgttccctcccggttacccccaccccttccgtcccgttaaccgttaaccggg

SEQ ID NO: 384242 - DNA, 533 bp, Homo sapiens
  misc_feature: GZ8MTXP01CCJKH.15.76.G10.1.454.CMB.2.raw
  modified_base (292)..(292): a, c, t, g, unknown or other
  modified_base (376)..(376): a, c, t, g, unknown or other
  modified_base (388)..(388): a, c, t, g, unknown or other
  modified_base (445)..(445): a, c, t, g, unknown or other
  modified_base (484)..(484): a, c, t, g, unknown or other
  modified_base (494)..(494): a, c, t, g, unknown or other
  modified_base (517)..(517): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgccccagggtccaattctcagactgtggtgactcaggagccctcactgactgtgtccccaggagggacagtcactctcacctgtgcttccaacactggagcagtcaccagtgcttactatccaaactggttccagcagaaacctggacaagacacccaggcactcatttanagtacaaacaacaaacactacctcggacccctgccccgatcctcacggcctccctccgttcgggggacaaagctcgccctgacnctgtcgtgggtntgcagctggaggacgaggctagactatactcgtcctactcttactttggtggtggtnttggtgtctagtcggcggaggaccagtctgctctaagcncgccgagtcncgccccgttgcctctctctcccncccttcctcgctaacg

SEQ ID NO: 384243 - DNA, 622 bp, Homo sapiens
  misc_feature: GZ8MTXP01AE9LO.15.76.G10.1.454.CMB.2.raw
  modified_base (163)..(163): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctnactgactgtgtccccaggagggacagtcactctcacctgtgcttccaacactggagcagtcaccagtgcttactatccaaactggttccagcagaaacctggacaagcaccaggcactcattatagtaacaaacaacaaacactcctacggacccctgccccgattctcacggcctccctccgttccgggggacaaacgctcgccctgacctctgtctgggtgtcgcacgccgtgagggacgaggctagactattactcgcctacttcttacgtttgggtcggtgtcgtggttactcgttacgttcgggcgggacggtaacccgaaggtccgtacggtaccgttcgttaaacgtccgttacgaccccgaacgggtccgtacccgttcccccgttccggttaccctaaccgttccgttccggttccccccgtcccgttcccctccggttccttaacccgg

SEQ ID NO: 384244 - DNA, 782 bp, Homo sapiens
  misc_feature: GZ8MTXP01B9SFI.15.76.G10.1.454.CMB.2.raw
  modified_base (164)..(164): a, c, t, g, unknown or other
  modified_base (214)..(214): a, c, t, g, unknown or other
  modified_base (284)..(284): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctnactgactgtcgtcccaggagggacagtcactctcacctgtgcttccaacnctggagcagtcaccagtgcttactatccaaatgtccagcagaacctggacagcaccgaggcactcattanataacaaacaacaaacactaccgtacggacccctcggaccctattcctccgtacggtcccttaccccgtcccggtttacggggggacctaaacgggtcctaccggtaccccgtaacgtaacccgtaacgttcggttaccgttggggtcggttaccgcgacgggtcccttaggggaacgggtacccggaagggtccgttacggtaaccttaacgtttaacccttcggtacccttaacctttccgtttaaccggttttcggggttagggtttcggggttaccgtttgggtttacgtcgtttaacggttcccggggaaccgggtaacggggtaaaccccgaaggtcccggttacggtaaccccggttacgttaaacggtaccgaaccgggacccgttaaacggggtccctcccggttcccccgttcgggttccccttaaccgttcccgtttcccggttcccccggtccccttaacccgttccggttcccgtttaacccggg

SEQ ID NO: 384245 - DNA, 600 bp, Homo sapiens
  misc_feature: GZ8MTXP01AS245.15.76.G10.1.454.CMB.2.raw
  modified_base (292)..(292): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactatccaaactggttccagcagaaacctggacaagcacccgaggcactcatttanagtaacaaacaacaaacactacctcgacccctgacccgtattctcgacgtcctcccgtccgtcggggacaaacgcgtcgccctagactcgtgtccgtgggtgtgcacgtcctgaggacgaggctagactattctgcctactcttacgttggtgtcggtcgtgtgtcttaggttcggcgggacggaaccagtcgtcgaccggttctaaacggtcgacggtaaccgaacgggccgtccggacccccgttcgggttccctaaccgttccgtcccgttccccggcccttccgtccgttaaccgttaaccggg

SEQ ID NO: 384246 - DNA, 659 bp, Homo sapiens
  misc_feature: GZ8MTXP01CWD0K.15.76.G10.1.454.CMB.2.raw
  modified_base (385)..(385): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaactggacaagcacccagggcactcatttatagtaacaaacaacaaacacctcctacggaccccctgaccccgtattcctacgacggcctcccgtccgttcgggggacaaacgctcgccctagacncgtgtcgtggtgtgcgagccgtggacggacggaggtctgactattactcgtcctactcttacgtttgggtgggttgtcgttaggtgtacgttagttccggggacggggacgggtacccgaaacggtccgtacggtacccgttacgttaacggtcccgaacggtccccgaaacgggtacccgtcccggttccccccgttcgggttaccccttccgttcccgttcccggttcccccggtccccttccccgttaacccggttccgtttaaacccggg

SEQ ID NO: 384247 - DNA, 742 bp, Homo sapiens
  misc_feature: GZ8MTXP01BQJEX.15.76.G10.1.454.CMB.2.raw
  modified_base (221)..(221): a, c, t, g, unknown or other
  modified_base (232)..(232): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggacgccctcactgattgtcgtcccaggagggacagtcactctcacctgtgcttccaacactggancagtcacagtncttactatacaaactggttacagcagaaactggacaagcacccgaggacactctaatttaatagtaaaccaaaactaacaaaacactacctacgacccctcgacccgatctcacggctcccgtccgttcggggacaaacgtcgtacgccctaacgacctcgtgtcgtcgggtgtcgacgacgtccgtagacgggaacggacgggacgttacggtaaacgttaactttaccggttacgtaccccgttacttaccgtttaaccggttttaggggtaggttcgggtacggttgtttcggtacgtttaacgggttccggggaacggggtaacggggaaccgtaacggtcgttaaccggttacccggttaacgttaaacggttccgaaaccggaaccccgttaaaggggtcccctcccgggttccccccggtttcgggttacccgtaacctttccccgggttcccgtttaccccccgtaaccccttcccggtcccgttaaccgtttaaacccggg

SEQ ID NO: 384248 - DNA, 624 bp, Homo sapiens
  misc_feature: GZ8MTXP01ED0A1.15.76.G10.1.454.CMB.2.raw
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaactggacaagcacccagggcactcatttatagtaacaaacaaacaaacactacctacggacccctgccccgattcctacacggcctacccgtccgttcgggggacaaagctcgccctagacaacgtgtcgtggtgtgcagcctgaggacgaggctgacttattactgtaccctatcttacgtttgggtggttggtcgttgtcgtcgttacggttcgggaccgggtagggaaaccgaaggtcgtacggtacccgtacgttaacgtcgacggccccgaaacggtccgtcccgttcccccgttcggttccctaaccgttccgttcccgttcccccggtccccttcccgttccgttccgttaaccggg

SEQ ID NO: 384249 - DNA, 708 bp, Homo sapiens
  misc_feature: GZ8MTXP01EFM7B.15.76.G10.1.454.CMB.2.raw
  modified_base (206)..(206): a, c, t, g, unknown or other
  modified_base (233)..(233): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtncttccaacactggagcagtcaccagtncttactatccaaactcggttaccagcaacgaaacctggacaagcacccgaggcactctattatagtaacaaaacaaacaaacacctacctacgacccctgaccccgattcctcacgcctccccgtccgtttccgggggaccaaaagtcgtcgtccccgtacgacctaacgtgttccgtgggtgtcgcgacggtccctagggaagggaccgagggtacgtaggaactttaactttacgtacgtcccttacttaccgtttaacgtttgggttgggtcgttcgtggttcgtcgttacgttccggggacggggtaacgggaaccctaaggtcgttacggtaaccccgttagttaaacggttcgaaccggacccttaaacgggtcccgttcccgggttcccccgttcgggttccctaacccgttcccgtttcccggtttcccccgtccccgttcccgtcccggttccgtttaaacccggg

SEQ ID NO: 384250 - DNA, 616 bp, Homo sapiens
  misc_feature: GZ8MTXP01AHX0Q.15.76.G10.1.454.CMB.2.raw
  modified_base (287)..(287): a, c, t, g, unknown or other
  modified_base (309)..(309): a, c, t, g, unknown or other
  modified_base (326)..(326): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcacagtgcttactataccaaactggtccagcaagaactggacagcaccaggcactctattanagtaacaaacaacaaacactcncgacccctgccctatcncacgtcctccgtccgtcgggggacaagtcgtcgccctacgactcgtgtcgtgggtgtcgcgagcccgtggacgggacggaggtcgtacgtacttaacgttactccgtaccttacttacgttacgtttgggtggtcggtcgttgtcgtcgttacgttcgggcggtaacgggacccgaagtccgtacgtacgttcgttaacggtccgacgtacccgacggtccgtccgttccccgttcgttacctaaccgttcctcccgttcccctaccccttcccgtccgttcgtaaccgg

SEQ ID NO: 384251 - DNA, 664 bp, Homo sapiens
  misc_feature: GZ8MTXP01AQQ5Y.15.76.G10.1.454.CMB.2.raw
  modified_base (334)..(334): a, c, t, g, unknown or other
  modified_base (390)..(390): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtcccaggaggacagtcactctcacctgtgcttccaacactggagcagtcaccagtgcttactatccaaactggttccagcaagaaacctggacaagcacccaggcactcatttatagtaacaaacaacaaacactcctacggacccctgcccgtattccncacggcctcccgtcgttaccgggggacaaacgctcgccctagactctgtcgtggtntcgcagtcctaggacggacgaacggctacgtaacttattacgtcgaccttacgttcttaacgtttgggttcggttcgggtcgtttaggtcgtacgtttacggttaccgggacgggtaacgggaacccgtaaggtccgttacggtacccggttattaaacgtaccgttaaccggtacccgaaacggtcccgttcccggttaccccccgttcgggttaccctaaccgtcccgtttccgttccccggcccttaccgttcccgttaaccgttaaccgg

SEQ ID NO: 384252 - DNA, 619 bp, Homo sapiens
  misc_feature: GZ8MTXP01C9AF4.15.76.G10.1.454.CMB.2.raw
  modified_base (311)..(311): a, c, t, g, unknown or other
  modified_base (330)..(330): a, c, t, g, unknown or other
  modified_base (335)..(335): a, c, t, g, unknown or other
  modified_base (351)..(351): a, c, t, g, unknown or other
  modified_base (594)..(594): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtcgtcccgaggaggacagtcactctcacctgtgcttaccaacactggagcagtccacctagtcgcttaactactacctaaacgttcggttaccagacaacgtaaaccgtggaacaacgccacccgaggcactctattanaagtaacaaacaacaaacnctacncgaccctgccctatcncgacgtcctccgtcgttcggggacaagtctcgccctacgactcgtgtcgtgggtgtcgcacgtccgtggacggacggaggctagtactagttacgtcgtacctacttcgttacgtttggtcgtggtcgtggtcgtacgttgtcggcggacggtaccgagtcgtacgtaccgttacgtaacgcaccggacccaaggtcccgtcccgttaccccgttcgttacctccttccgtcccgttaccccncccgttcctccgttaacgttaacgg

SEQ ID NO: 384253 - DNA, 726 bp, Homo sapiens
  misc_feature: GZ8MTXP01CTEXB.15.76.G10.1.454.CMB.2.raw
  modified_base (566)..(566): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttaccaacacgtggagcagtcaccagtcgtcttaactacgtaccaaacgttcggtaccagacaacgaaacctggaacaacgccgaacccgaggacactactaattaataacgtaaacaaaaacaaaccaaaactaccgtccgtaccggtacccctcgtacccgtacttccgacgaccggtcccttccccggtacggttacgggggaaccaaacgtccgttccgacccgtaacgaaccgtcgttcgtccggttgggttacgtcgaccgtacgtacccgtagggaacggtacggtaacggtactttaactacgttacgtccgtaccttacttacgttacgttggtcgtgtcggttgtacgtnttacggtcgggaggaacgggactaacggtcgtaccgtaaccgttacgttaacgccgtaaccggaccgacggttcccgtaccccgtccccgttacgttcccaccgtttccgtccccgttccccgtccccgttccgttccggtaaccgttaacggtaaccgg

SEQ ID NO: 384254 - DNA, 625 bp, Homo sapiens
  misc_feature: GZ8MTXP01DUK13.15.76.G10.1.454.CMB.2.raw
  modified_base (299)..(299): a, c, t, g, unknown or other
  modified_base (344)..(344): a, c, t, g, unknown or other
  modified_base (386)..(386): a, c, t, g, unknown or other
  modified_base (602)..(602): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttaccaacacgtggagcagtcaccagtgtacttactataccaaactcggttaccagcaagaaacctggaacaagcaccgaggcactcattanagtaacaaacaacaaacactacctcggacccctgcccgtattccncgacgcctcccgtcgtcgggggacaaagcgtcgccctagacncgtgtcgtgggtgtcgcacgtcccgtggaacggacggaggtacgtagtaacttacgttacgtcgtacccttacgttacttcggtttgggtggttgtcgttggtcgtcgttacggttccggacgggtaacggaccgtaaggtcgtacgtaccgttattaacgtacacgtaccgaacggtcctacgccccgttcggttctccctacgtccttaccccncccttcgtccgttcgttaaccgg

SEQ ID NO: 384255 - DNA, 549 bp, Homo sapiens
  misc_feature: GZ8MTXP01CWNMY.15.76.G10.1.454.CMB.2.raw
  modified_base (384)..(384): a, c, t, g, unknown or other
  modified_base (467)..(467): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtaacaaacaaacaaacactcctggacccctgcccgatctcaggctcctccgttcgggggacaaaagctagccctagacaactcgtctggttgngcgagcctgagacgaggctgactatactgctactctacttgtgtgggctgtgctagttcggcggaggaccaagctagcccgtntaaacggtcacgacccaaagggcctcggcccccttgggttccctaactcctcggtttcccacccttccctccgccttaacgg

SEQ ID NO: 384256 - DNA, 680 bp, Homo sapiens
  misc_feature: GZ8MTXP01AXPQW.15.76.G10.1.454.CMB.2.raw
  modified_base (230)..(230): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacacgtggagcagtcaccngtgcttactactccaaactggttccagcacgaaactggaacagcaccagggcactcattataagtaacaaacaacaaacacctcccgtaccgtaccgccgtactacttccgacgaccgtccctaccgtcggtacgggaacacgtcgtccacgtacgaccgtcgtcgcgggtgtacgcgacgcgtaccgagggacggacgacgtcgtaacgtacttaacgttcctaccgttacctaccgtttactttcggggttacggtcggttcggtgttaaccgggttagttccgggttttaaccggggccgggggtaaccggtaacccggaaaggccggttaccgaccggttaaccgtttacgtaaaccgtcgaacccggacgttacggcccgtaccccggttcccttaccggactccgtccttcccgtcccctccttccgaaccttaacgtaaccgg

SEQ ID NO: 384257 - DNA, 708 bp, Homo sapiens
  misc_feature: GZ8MTXP01DFOFI.15.76.G10.1.454.CMB.2.raw
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgccttccaacactggagcagtccaaccagtgacttaactataccaaacttcggtaccagcaagaaaccgtggacaagccacccgaggccactcatttataagtaacaaacaacaaacacctcctcgaccccctgaccctatcctcacggtcctcccgtccggttcgggggaccaaacgtcgtccgcccctacgacctaacgtcgttcggtgggttcgtacgcacgcccgtaggaggacggaggcgtacggtaactagttaccgtcgtacccttacgttcttacgtttgggttcggtggtccgtggttcgtacgttacgttccggggacgggacgggaacctaaggtccgtacggtaacccgttcgtttaaacgtccgaaccggtaccccggttaaacggtcccgttccccgggaccccccgtttccgggttacccttaacccgggttccccttccccggtttcccccgtccccgttccccgttcccgttcccgttaaacccggg

SEQ ID NO: 384258 - DNA, 637 bp, Homo sapiens
  misc_feature: GZ8MTXP01EOYYS.15.76.G10.1.454.CMB.2.raw
  modified_base (164)..(164): a, c, t, g, unknown or other
  modified_base (345)..(345): a, c, t, g, unknown or other
  modified_base (406)..(406): a, c, t, g, unknown or other
  modified_base (609)..(609): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctnactgactgtgtccccaggagggacagtcactctcacctgtgccttccaacactggagcagtcaccagtgcttactataccaaacgtggttaccagcaagaaacctggaacaagcacccgaggcactcatttatagtaacaaacaacaaacactacctacgacccctcgaccccgtattccncgacgcctcccgtcgttcggggactaaacgccgtcgccctaagactaacgtcgtctgggtntacgcacgtccgtggacggacggaggcctaggtacttaacgttactcgtccttacttccgttacgtttgggtcggtcgtcgttgtcgtacgttagtcgggcggtaacggacaaggtcgtacgaccgttgttaacgtcaacggcccttaaaggtccgtacccgttcccccgttggttaccctccgttcccgttccggttccccncccttaccgtccgttaaccgttaacggg

SEQ ID NO: 384259 - DNA, 580 bp, Homo sapiens
  misc_feature: GZ8MTXP01BXR4Q.15.76.G10.1.454.CMB.2.raw
  modified_base (221)..(221): a, c, t, g, unknown or other
  modified_base (233)..(233): a, c, t, g, unknown or other
  modified_base (260)..(260): a, c, t, g, unknown or other
  modified_base (270)..(270): a, c, t, g, unknown or other
  modified_base (277)..(277): a, c, t, g, unknown or other
  modified_base (282)..(282): a, c, t, g, unknown or other
  modified_base (304)..(304): a, c, t, g, unknown or other
  modified_base (321)..(321): a, c, t, g, unknown or other
  modified_base (359)..(359): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggancagtcaccagtncttactatccaatggtccagcagaacngacagcaccnggcactnattanagtaacaaacaacaacactccncgacccctgcccattcncacgcctcccgtcgtcggggacaagctcgccctagacnctgtctggtcgtgcacgccgtaggacggacggaggctacgtactacgttactcgtacccttacgttcgttacgtttcgggtggtggtcgtggtgtcgtaggtccgggcggaggaccagtcgtggccgttataacgtcgacgtacccgacgtcctccgttccccgttcggttcctaacgtccttcccgttcccctacccgttcccgtccgttcgttaaccgg

SEQ ID NO: 384260 - DNA, 685 bp, Homo sapiens
  misc_feature: GZ8MTXP01DS4UU.15.76.G10.1.454.CMB.2.raw
  modified_base (224)..(224): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtcgtccccgaggagggacagtccactctcacctgtgccttccaacactggancagtcaccagtgcttactataccaaatcggttaccagcaagaaacctggaacaagcacccgagggacactctaatttataagtaaacaaaacaaacaaacacctacctacgacccctgccccgtattccacacggcctcccgtccgttcgggggacctaaagcctcgccccgtacgacctcgtcgtccgtggtcgtcgcgacggccgtaggacggacggacggtcgtagtaacttacgttactacgtccttaacttcgttaacgtttgggtcggttgggtcgttggtcgtacgtttacgtccggggtacgggacggaaccgtacggtcgtacggtaccgttagttaaacgtcgacggtacccgaacgggtccctcccggttcccccgttccggttcctaacccgtttcccgttcccgttcccccggccccttcccgttcccggttaaccgtttaacccggg

SEQ ID NO: 384261 - DNA, 513 bp, Homo sapiens
  misc_feature: GZ8MTXP01CUAGE.15.76.G10.1.454.CMB.2.raw
  modified_base (360)..(360): a, c, t, g, unknown or other
  modified_base (431)..(431): a, c, t, g, unknown or other
  modified_base (466)..(466): a, c, t, g, unknown or other
  modified_base (474)..(474): a, c, t, g, unknown or other
  modified_base (486)..(486): a, c, t, g, unknown or other
  modified_base (491)..(491): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatcaaactggttaccagcagaacctggacaagcaccaggcactcattatagtaacaaacaacaacactcctggacccctgcccgatctcagcctcctcgtcggggcaaagcgtgccctgacnctgtctggtgtcgcagcctgaggacgaggctgactattactcgcctactcttacgttggtggtgcttggtntctagtcggcggaggaccagctggactctaagtcngcccagcncgccccgttgcnccgtntcgtcccaccttctcgctaacg

SEQ ID NO: 384262 - DNA, 738 bp, Homo sapiens
  misc_feature: GZ8MTXP01DX1K3.15.76.G10.1.454.CMB.2.raw
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtcgtccttaccaacactggagcagtccaaccagtgtacttaactactaccaaacttcggttacagacaacgaaacctggaacaacgccaccgaggacactactatttaataacgtaaacaaaacaacaaaactacctaccgtacggaccccctacgacccgtattcctacgaccgtcctccccgttccggttacgggggacctaaacgtcctaccggtacccctaacggaccttaacgtcgtcgttgggtacggtcgacgacggtacccgtagggacggaccggaggtacgtacggttaacttaacttacgtcgttacccgtactttacgttacggtttgggttcggtgggtcgttggttagtacgttagttccggggacggttaacggaaccgtacgtcgtaccgtaccgttcgttaaacggtccgaacggccccgttaaacggtcccgtacccgttcccccggttcggttaccccttaaccgtcccgttcccgttacccctccccgttccttcccggttaaccgtttaaccgg

SEQ ID NO: 384263 - DNA, 656 bp, Homo sapiens
  misc_feature: GZ8MTXP01DGEJE.15.76.G10.1.454.CMB.2.raw
  modified_base (164)..(164): a, c, t, g, unknown or other
  modified_base (234)..(234): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctnactgactgtcgtccccaggagggacagtcactctcacctgtgcttccaacactggagcagtcaaccagtncttactataccaaactggttaccagcaagaaacctggaacaagcacccagggacactctatttataagtaaacaaaacaaacaaaacacctacctacggacccctgccccgtaattctcacggcctcccgtccgttcggggacaaagctcgccctaacgacctaacgtcgtccgtgggtcgtagcagtccgtagacggacggaggctagtaacttaagttcctacgtccttactcgttaacgtttggtggttggtcgttggtacgtcgttaacgttccgggacggtagggaaccgtaagtcgtacggtaccgttacgttaaacgtcgacggtacccgaacggtccgtccgacccccgttcggttccctaaccgttccgttcccggttccccctacccgttcccgtccgttccgttaaccggg

SEQ ID NO: 384264 - DNA, 724 bp, Homo sapiens
  misc_feature: GZ8MTXP01DEMHP.15.76.G10.1.454.CMB.2.raw
  modified_base (292)..(292): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtccaccagtgcttactatccaaactggttccagcaagaaacctggacaagcaccagggcactcatttanagtaacaaacaacaaacacctcctacgacccctgccccgtatctcacgcctcccgtccgttcgggggcaaagctcgcccctacgactaactgtcgttgggtcgtcgcgacgtcccgtagacgggtacggaacggtcgtaggtaactagttaaccgttcggtcccttaacgttcgttaaccgttttggggttcgggttcggggttaccgttcggttcggttaccgttacgggtttccggggaccgggggttaacggggaacccggtaaacggtcccgttagggacccccggtttaacggtttaacgtaaccgaccggtaccccgaaacgggtcccgttacccgggttccccccgttccgggttaccctaacccgttccccgtttccggtttccccctaccccgttccccgttccgttccccgtttaaaccggg

SEQ ID NO: 384265 - DNA, 634 bp, Homo sapiens
  misc_feature: GZ8MTXP01EQWSF.15.76.G10.1.454.CMB.2.raw
  modified_base (291)..(291): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggtaccagcaagaacctggacaagcaccgaggcactcatttanagtaacaaacaacaaacactcctacggacccctgcccgtattctcagcctcccgtcgttcggggacaaagctcgccctcgaccaacgttgtcgtggtgtcgacacgccctggaggacggaggtctggacttattactcgtacctacttcgttagtttcgggtgggtgtcgttggttacgcgttacgttcgggcgggtacgggaacctaagtcgtacggtacccgttcgttaaacggtcacggtaccccgttaacggtcccgtaccggttcccccgttcgggttacccgtcctttcccgtccgtttcccccaccccgttcccgttcccgttccgtttaacccgg

SEQ ID NO: 384266 - DNA, 630 bp, Homo sapiens
  misc_feature: GZ8MTXP01AU05E.15.76.G10.1.454.CMB.2.raw
  modified_base (373)..(373): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttaccaacactggagcagtcaccagtgcttactataccaaactgttccagcaagaaacctggacaagcaccagggcactcatttatagtaacaaacaacaaacactcctacggacccctgcccgattctcacggcctccctcgtcggggcaaagcctgccctagacnctgtcgtgggtgtgcagccgtgacgacggagcgtagtacttattactgtccctacttcttacgtttggtggtggtcgttggtcgtcgttacgttcgggccgggtagggaccccgtaaggtccgtacggtacccgttacgttaaacgtcgaccggtacccgaacggtccgtcccggcccccgttccgggttacccgtaacccttcccgttcccggtttccccctaccccgttccccgttcccggccgtttaacccggg

SEQ ID NO: 384267 - DNA, 627 bp, Homo sapiens
  misc_feature: GZ8MTXP01DIS05.15.76.G10.1.454.CMB.2.raw
  modified_base (213)..(213): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttaccaanacgtggagcagtcacagtgacttactataccaaactcggtaccagcaagaaaccgtggaacaagcacccgaggcactctattaatagtaacaaacaacaaacactcctacgacccctgacccgtatcctcacgcctcccgtcgtcggggacaaagctcgccctagactctgtcgtggtgtcgcagccctgaggacgacggctagtactattactcgccttactcttacgttggtcgtggtcgttggtctacgttacggtcgggcggtaagggaacccaagtccgtacggtaccttacgttaacgtacgaccggtacccgaaggtcccgtacccgttcccccgttcgggttaccctaaccttcccggttcccgtttcccccaccctttcccgtaaccgttcccgttaaacccggg

SEQ ID NO: 384268 - DNA, 625 bp, Homo sapiens
  misc_feature: GZ8MTXP01D6R8J.15.76.G10.1.454.CMB.2.raw
  modified_base (222)..(222): a, c, t, g, unknown or other
  modified_base (302)..(302): a, c, t, g, unknown or other
  modified_base (322)..(322): a, c, t, g, unknown or other
  modified_base (350)..(350): a, c, t, g, unknown or other
  modified_base (505)..(505): a, c, t, g, unknown or other
  modified_base (607)..(607): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactggtcgtcccaggagggacagtcactctcacctgtgtcttccaacactggancagtcaaccagtcgcttaactataccaaacttggttaccagcaagaaccgtgaacaagcaccgaggctactctaatttanagtaaacaaactaacaaacnctccgtacgaccccttgacccgtattcncgacgtcctcccgtcgttacggggaccaaaggtctcgtaccctaacgactcgtgtccgtgggtcgtcgacgacgtccgtaggacggacgtacggctacggtacttaagttacgtcgttacctattaccgttagtttgggtcgtggtcgtcggttntccgttaggttcggacgggtaggaaccagtcgtacgtacgttactaagtccacgggaccttaaggcctaccggccccttggttacctcttacgtcctacccncttccgtcgttcgtaacg

SEQ ID NO: 384269 - DNA, 791 bp, Homo sapiens
  misc_feature: GZ8MTXP01BPFG6.15.76.G10.1.454.CMB.2.raw
  modified_base (210)..(210): a, c, t, g, unknown or other
  modified_base (228)..(228): a, c, t, g, unknown or other
  modified_base (379)..(379): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcgaggacgccctcactgactgtcgtccccgaggagggacagtcactctcacctgtcnccttaccaacacgtggancagtcaaccagtgtacttactactaccaaacgttcggtaccagacaacgaaacctaggaacaacgacaacccgagggacctacgtactaatttaataacgtaaacaaaacaaacaaacacctaccgtacgacccctcgaccccgtattccncgacggtcctccccgttccgggttacgggggaccaaacggtccgtcgtccccgtaacgaaccctaacgttgggtccgttgggttcggtcgaccgacgggtccgttagggaacgggtacggacggtacgttacggtaacgttaacgtttaccgtacgtacccctttaccgttaccgtttacggtttgggggttcgggttcggtccggttcgggttgtaccggtttacgggttccggggaccggggtaacgggtaacccgaacggtccggttacgtaacccggttacgttaaacggccgttaccggtaaccccgaacgggtccccgtacccgggttcccccgttcgggttaccctaacccgtttcccgttccccggttccccgtccccgttcccgttccgttccgttaaccggg

SEQ ID NO: 384270 - DNA, 635 bp, Homo sapiens
  misc_feature: GZ8MTXP01C5H93.15.76.G10.1.454.CMB.2.raw
  modified_base (376)..(376): a, c, t, g, unknown or other
  modified_base (388)..(388): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcacgaaacctggacaagcaccaggcactcattatagtaacaaacaacaaacactacctacggacccctgccccgtattctcacgcctccctccgttcgggggcaaagctcgccctagacnctgtctagggtntgctagccgtgagacgaggcgtgtactattacgtgtacccttactccgttacgtttgggtcggttggtccgtggttcgtacgtacgtttccggggacggacggggaaccaacggtcgttacgtaacccgttcgttaaacgtcgacggccccgttaaggtccctcggttaccccccgttcgggttccctaactttccccgtcggtttcccccggcccccgttcccgttcccggccgttttaacccggg

SEQ ID NO: 384271 - DNA, 667 bp, Homo sapiens
  misc_feature: GZ8MTXP01CYHAW.15.76.G10.1.454.CMB.2.raw
  modified_base (165)..(165): a, c, t, g, unknown or other
  modified_base (305)..(305): a, c, t, g, unknown or other
  modified_base (424)..(424): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtcccaattctcagactgtggtgactcaggagccctnactgactgtcgtcccgaggagggacagtcactctcacctgtgccttacaacactggagcagtcaccagtgtcttaactactacctaaactggttaccagacaagaaacctggacaacgcacccgaggacactcaatttanaagtaaacaaacaaacgaaacactacctacggacccctgacccgtattccacgtacggcctccgtcggtacgggggacaaacgtcgtcgccctaagacctaacgtcgtcgtggttacgngacgacgccgtaggacggacgaggctagtaactaagtttaccgtacgtcctacgttcctagtttagggtggtcgtgtcggttagtcgtaacggttccggggaacgggtacgggaacctagggtaccgtacggtaacccgttgttaaacggtcgaccggtaacccggacgtaccgtcccggaccccgttcgggttacctaaccgtcccgttccgtccccgtccttcccgttaacgcgttaacgg

SEQ ID NO: 384272 - DNA, 649 bp, Homo sapiens
  misc_feature: GZ8MTXP01EW5NQ.15.76.G10.1.454.CMB.2.raw
  modified_base (191)..(191): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggacgccctcactgactgtcgtccccaggagggacngtccactctcacctgtgcttccaacactggagcagtcaccagtgcttactataccaaactggttaccagcagaaacctggacaagcacccaggcactcatttatacgtaacaaacaactaaacacctcctaggacccctgaccccgtattctcgacggtacctccccgtccgttcggggaccaaagccgtcgccccgttacgactaacttgtacgtgggtagtcgcgacgtccgtgacgggtacgcggctacgacttaacgttactcggtaccttacttcgttacggtttgggtggttcggtacgttggttcgtcgttacgtccgggtcgggacggaccgtacgtccgtagtacccgttcgtaaacgttccgaggtaaaccgaggccttccggcccccgttacggttcctaaccgtccgtccgttcccccgcccttccgtaaccgttcgttaacccgg

SEQ ID NO: 384273 - DNA, 525 bp, Homo sapiens
  misc_feature: GZ8MTXP02HWD01.15.76.G10.1.454.CMB.2.raw
  modified_base (363)..(363): a, c, t, g, unknown or other
  modified_base (375)..(375): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgattctcagctccctccttcggggcaaagctgccctgacnctgtctggtgtncagcctgagacgagctgactatactgcctactctactttggtcgtgtcttgtgctagttcggcggaggaccaagctgaccgtcttaagtcagccctaaaggctcgccccctcggtcaacgtttcgtcccaccctcctccgcttacgtacg

SEQ ID NO: 384274 - DNA, 616 bp, Homo sapiens
  misc_feature: GZ8MTXP02FR6AF.15.76.G10.1.454.CMB.2.raw
  modified_base (291)..(291): a, c, t, g, unknown or other
  modified_base (314)..(314): a, c, t, g, unknown or other
  modified_base (330)..(330): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaaagcacccaggcactcatttaanagtaacaaacaacaaacactccncgacccctgcccatcncagctccctcgtcggggacaaagctcgccgtcgacactgtcgtggtgtgcgacgctgaggacggacggacgtagaacgtaacttactacgtacctacctacttacgtttaggttggttggtcgtgtgtcgttacgttacgggtacggggaacggggaaccgaaacgacgtacgtaaccgtaccgttaaacgttacgaacgacccgaaacggaccgtaccgtcccccgtcccggtaccgtaaccgtaccgttaccgttaccccgtcccgtccctccgtaccgtaacg

SEQ ID NO: 384275 - DNA, 511 bp, Homo sapiens
  misc_feature: GZ8MTXP02GTW5D.15.76.G10.1.454.CMB.2.raw
  modified_base (366)..(366): a, c, t, g, unknown or other
  modified_base (395)..(395): a, c, t, g, unknown or other
  modified_base (437)..(437): a, c, t, g, unknown or other
  modified_base (498)..(498): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaaacaacaaaacactacctaggacccctgcccgattctcagctccctctcggggcaaagctcgccctgacnctgtctggtgtgcagcctgaggacgagcngactatactgcctatctactttggtgtgctgtgctagtcggnggagggaccaagctagacgtctaagtcagcccaaggctcgcccctcgcaactctcgtcccnccctctcgctacg

SEQ ID NO: 384276 - DNA, 540 bp, Homo sapiens
  misc_feature: GZ8MTXP02GSD8P.15.76.G10.1.454.CMB.2.raw
  modified_base (366)..(366): a, c, t, g, unknown or other
  modified_base (425)..(425): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgattctcaggctccctccttcggggccaaagctcgccctgacnctgtctggtgtgcagccctgaggacgaggctgactagttactgcctactctactttggngtgcttgtgctagttcggcggagggtaccaaggctagaccgtacgttaagtcagtcccaaaggcctcgccccctaggtccaacgtcgtcgttccccgccctcctccgctaaccgg

SEQ ID NO: 384277 - DNA, 518 bp, Homo sapiens
  misc_feature: GZ8MTXP02HYZ2M.15.76.G10.1.454.CMB.2.raw
  modified_base (364)..(364): a, c, t, g, unknown or other
  modified_base (374)..(374): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttcccagcagaaacctggacaagcacccagggcactcatttatagtacaaacaacaaacactcctggacccctgcccgattctcagctccctccttcggggcaaagctgccctgacnctgtctggtntgcagcctgaggacgaggctgactagttactgcctactctactttggtggtgcttgtgctattcggcggagggccaagctgaccgtcttaagcagccaaggctcgccccctgtcaacgtctcgttcccacccgtcctcgctacg

SEQ ID NO: 384278 - DNA, 523 bp, Homo sapiens
  misc_feature: GZ8MTXP02HIK77.15.76.G10.1.454.CMB.2.raw
  modified_base (281)..(281): a, c, t, g, unknown or other
  modified_base (287)..(287): a, c, t, g, unknown or other
  modified_base (310)..(310): a, c, t, g, unknown or other
  modified_base (368)..(368): a, c, t, g, unknown or other
  modified_base (397)..(397): a, c, t, g, unknown or other
  modified_base (406)..(406): a, c, t, g, unknown or other
  modified_base (461)..(461): a, c, t, g, unknown or other
  modified_base (467)..(467): a, c, t, g, unknown or other
  modified_base (481)..(481): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcacncattanagtacaaacaacaaacactaccnggacccctgcccgattctcaggcctccctcgttcggggacaaaagctacgccctgacnctgtctggtgtgcagccctgagacgagcngactatacngcctactctacttggtggtgctgtgctagttcggcggaggaccaagctgaccgtnttaacncgagaccaaggccncgccccgtcgtccaactctcgttcccacctcctcgtactacg

SEQ ID NO: 384279 - DNA, 537 bp, Homo sapiens
  misc_feature: GZ8MTXP02GVOVZ.15.76.G10.1.454.CMB.2.raw
  modified_base (375)..(375): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaaacaaaacactacctcggacccctgccccgattcctcacggcctcccctccttcgggggcaaagctcgccctgacnctgtctggtgtgcagcctgaggacgaggctgactattactgcctactctactttggtgtgctgtgctagttcggcggagggaccaaggctagaccgtcttaacgtcagcccaaggctcgccccctcggtccaacgtcctcgttccccaccctcctcgctacg

SEQ ID NO: 384280 - DNA, 524 bp, Homo sapiens
  misc_feature: GZ8MTXP02GVW2T.15.76.G10.1.454.CMB.2.raw
  modified_base (362)..(362): a, c, t, g, unknown or other
  modified_base (405)..(405): a, c, t, g, unknown or other
  modified_base (442)..(442): a, c, t, g, unknown or other
  modified_base (518)..(518): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaaagcacccaggcactcatttatagtacaaacaacaaacactcctggacccctgcccgattctcagctccctcctggggcaagctgccctgacnctgtctggtgtgcagcctgacggacgaggctggactattaccngcctactctactttggtggtgctgtgcttagttcggnggacgggaccaagcgtagacgtctaacgtcagcccgaaggctcgcccctcgtcaacgtctcgttcccaccctctcncgtacg

SEQ ID NO: 384281 - DNA, 517 bp, Homo sapiens
  misc_feature: GZ8MTXP02GTI5J.15.76.G10.1.454.CMB.2.raw
  modified_base (311)..(311): a, c, t, g, unknown or other
  modified_base (362)..(362): a, c, t, g, unknown or other
  modified_base (404)..(404): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactccnggacccctgcccgatctcagctccctcttcggggcaaacgctgccctgacnctgtctggtgtgcagcctgaggacgaggctggactagttacngcctactctacttggtgtgctgtgcttattcggcggtacgggcaagctgaccgtcttaagtcagcccaaggctcgccccctggtcaactctcgttcccgcctcctcgctaccg

SEQ ID NO: 384282 - DNA, 601 bp, Homo sapiens
  misc_feature: GZ8MTXP02INO6I.15.76.G10.1.454.CMB.2.raw
  modified_base (287)..(287): a, c, t, g, unknown or other
  modified_base (332)..(332): a, c, t, g, unknown or other
  modified_base (373)..(373): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtccagcagaaacctggacaagcacccaggcactcattanagtacaaacaacaaacactacctacgacccctcgacccgattccncgacggcctcccgtcgttcggggacaaacgctcgcctgacncgtgtctggtgtcgcagcctagacgacgagctgacttagtactcgacctactccgtacgtttgggtgttgcttggtcgcgttagttcgggacgggtaacgggaccgaaagtccgtacggtaccgttacgttaacggtacgaaccgtaccgaaacggtccgtacccgcccccgttacggtcctaaccgttcctacccgttccccacccgttcccgtcgtaccttaacgg

SEQ ID NO: 384283 - DNA, 625 bp, Homo sapiens
  misc_feature: GZ8MTXP02HPZ91.15.76.G10.1.454.CMB.2.raw
  modified_base (164)..(164): a, c, t, g, unknown or other
  modified_base (363)..(363): a, c, t, g, unknown or other
  modified_base (393)..(393): a, c, t, g, unknown or other
tcagtctacgtagccacgaccggtgctcgatttagtcactcatacagggggacgccaggggtcccttccaatatcagcaccatggcctggactcctctctttctgttcctcctcacttgctgcccagggtccaattctcagactgtggtgactcaggagccctnactgactgtgtccccaggaggacagtcactctcacctgtgcttccaacactggagcagtcaccagtgcttactatccaaactggttccagcagaacctggacaagcacccaggcactcattatagtacaaacaacaaacactcctggacccctgcccgattctcagcctccctcgttcggggacaacgctcgcctgacncttgtctggtgtgcagcctgagacgaggcngactatactgcctactctactttggtggtgcttgtcgtacttagttcgggcgggtaacgggacccgaaggtcgtacggtaccgttacgttaaacggttaccgacggaccccgtaaaggggtcccttacccgggtacccccccgtttcggggtaccccgtaacccgtttcccgttacccggttttaccccccggcccctttacccccggttcccggtcccgtttaaacccggg

SEQ ID NO: 384284 - DNA, 548 bp, Homo sapiens
  misc_feature: GZ8MTXP02GSFY2.15.76.G10.1.454.CMB.2.raw
  modified_base (380)..(380): a, c, t, g, unknown or other
  modified_base (409)..(409): a, c, t, g, unknown or other
  modified_base (442)..(442): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaaacactacctaggacccctgccccgattcctcaggcctccccctccgttcgggggaccaaaagcctgcccctgaacnctgtctggtgtgcagcctgaggacgagcngactatactgcctactctacttggtgtgctgtnctagttcggcggagggacccaaggcgtcgtaccgtcttaaacgtcgacgcccgaaaggctcgccccctcggtccaacgtctcgttcccaccctcctccgctaaccg

SEQ ID NO: 384285 - DNA, 536 bp, Homo sapiens
  misc_feature: GZ8MTXP02F1LR3.15.76.G10.1.454.CMB.2.raw
  modified_base (290)..(290): a, c, t, g, unknown or other
  modified_base (359)..(359): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttanagtacaaacaacaaacactcctggacccctgcccgatctcagctcctcctggggcaagctgccctgacnctgtctggtgtgcagcctgaggacgaggctgactatactgcctatctactttggtgtgctgtgctattcggcggtaggaccaagctcgtaccgtcttaagtcacgccccaaagggcctccgcccccgtcggtaccaaccttccgtcgttcccccgcccttcctaccgtcttaaccgg

SEQ ID NO: 384286 - DNA, 540 bp, Homo sapiens
  misc_feature: GZ8MTXP02H3XWL.15.76.G10.1.454.CMB.2.raw
  modified_base (367)..(367): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcagaaacctggacaagcacccaggcactcatttatagtaacaaacaacaaacactctcgacccctgcccgattctcacggcctccctcttcggggcaaagctgccctgacnctgtctggtgtgcagctgaggacgagctgactattactgcctactctacgttggtgtgctgtgctagttcggcgggtagggaccaagcgtagaccgtacttaagtacacgacccaaggcctacgccccctcggtcctaacgtcctacgttccccacccgtccctcgtctaccg

SEQ ID NO: 384287 - DNA, 513 bp, Homo sapiens
  misc_feature: GZ8MTXP02G9MDV.15.76.G10.1.454.CMB.2.raw
  modified_base (365)..(365): a, c, t, g, unknown or other
  modified_base (375)..(375): a, c, t, g, unknown or other
  modified_base (395)..(395): a, c, t, g, unknown or other
  modified_base (405)..(405): a, c, t, g, unknown or other
  modified_base (506)..(506): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaaacaaacactacctggacccctgccccgattctcaggctcctcctggggcaaagctagccctgacnctgtctggtntgcagcctgaggacgaggcngactattacngcctactctactttggtgtgctgtgactattcggcggagggcaagctgacgtctaaagtcagccaaggctcgccccctggtcaactctcgtcccaccctcncgctacg

SEQ ID NO: 384288 - DNA, 567 bp, Homo sapiens
  misc_feature: GZ8MTXP02HEI9P.15.76.G10.1.454.CMB.2.raw
  modified_base (309)..(309): a, c, t, g, unknown or other
  modified_base (328)..(328): a, c, t, g, unknown or other
  modified_base (365)..(365): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcattatagtacaaacaacaaacactccncggacccctgcccgattcncaggcctcccgtcgtcggggacaaagctgccctgacnctgtctggtgtgcagccctgacggacggagctgactagttactcgtcctactcttacgtttggtggttcgcgttgtgtcgtagttcgggacgggacgggtaccaagccgtacgaccgttacttaacgcacgacccgtaaggcctccggccccctcggtcctaaccgtcttccgtcccctaccgtccctaccgtcgttaaccg

SEQ ID NO: 384289 - DNA, 541 bp, Homo sapiens
  misc_feature: GZ8MTXP02GNOZP.15.76.G10.1.454.CMB.2.raw
  modified_base (288)..(288): a, c, t, g, unknown or other
  modified_base (528)..(528): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcattanagtaacaaaacaacaaaacactacctcggaccccctgccccgattctcacggcctcccctccgttcgggggacaaagctacgcccctgaccactgtctgggtgtgcacgcctgaggacgaggctgacttatactgcctactcttactttggtgtgctgtgtctagttcggcggaggaccaagcgtgaccgtacttaacgtcagacccgaaggctccgcccctcgcaacgtctcgtccccncctcctcgctacg

SEQ ID NO: 384290 - DNA, 584 bp, Homo sapiens
  misc_feature: GZ8MTXP02JQO6B.15.76.G10.1.454.CMB.2.raw
  modified_base (369)..(369): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcattatagtacaaacaacaaacactcctggacccctgcccgattctcaggcctcccctccgttcggggccaaagctcgccctgacnctgtctggtgtgcagccctgaggacgaggctgactattactgtccttactcttatttgggtgtgtctgtgcttagttcggcggagggaccaaggtctcggtaccgtacgttaacgtcacggacccgaacggccgtccgtccccccgtcgggtaccctaaccgttccgttaccggttcccccaccccgtttcccgtaccgtaccgtttaaacccgg

SEQ ID NO: 384291 - DNA, 600 bp, Homo sapiens
  misc_feature: GZ8MTXP02IQ8A8.15.76.G10.1.454.CMB.2.raw
  modified_base (371)..(371): a, c, t, g, unknown or other
  modified_base (391)..(391): a, c, t, g, unknown or other
  modified_base (396)..(396): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtaacaaacaacaaacactacctggacccctgcccgtattctcgagcctaccctccgttggggacaaagctcgccctgacnctgtctggtgtgcagcctgngacgngctgactattactgtcctactctacgtttggtggtgtctgtgtctacgttcgggcggacgggtaccaaggcgtacggtaccgttacgtttaaacggtctaccggacccgaaacgggtccgtacccggcccccgttccggttacctaaccgttcccttaccggtttccccctaccccttccccgtaccgtaccgtttaaacccgg

SEQ ID NO: 384292 - DNA, 529 bp, Homo sapiens
  misc_feature: GZ8MTXP02JWLII.15.76.G10.1.454.CMB.2.raw
  modified_base (361)..(361): a, c, t, g, unknown or other
  modified_base (424)..(424): a, c, t, g, unknown or other
  modified_base (428)..(428): a, c, t, g, unknown or other
  modified_base (510)..(510): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacaagcacccaggcactcattatagtacaaacaacaaacactcctgacccctgcccgattctcacgctcccctcgtcggggcaaagctgccctgacnctgtctggtgtgcagtctgaggtacgaggctgactattactgcctacgtctacgttggtggtnctgnctagtcggcggaggaccagctagcgtactaacgtcacgcctaaggcctcgtccccctggtacctaacgtccgttcgtccccncctccctcgaccttaacgg

SEQ ID NO: 384293 - DNA, 566 bp, Homo sapiens
  misc_feature: GZ8MTXP02GH34T.15.76.G10.1.454.CMB.2.raw
  modified_base (369)..(369): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtccagcagaaacctggacaagcacccaggcactcatttatagtacaaacaacaaacactcctggacccctgcccgattctcacggcctcccctccgttcggggcaaacgctcgccctgacnctgtcgtggtgtgcagcctgaggaccgagctgactatactgtcctactctacgtttggtgtgcttgtgtcgttagtcggcggtaggaccgaagcgtagaccgttacttaacgtcgacgcccgaaacggcctccgtcccccgtcggtcctaaccgtcttccgttcccctaccccgttccgtaccgacgtttaacccgg

SEQ ID NO: 384294 - DNA, 595 bp, Homo sapiens
  misc_feature: GZ8MTXP02GN2T8.15.76.G10.1.454.CMB.2.raw
  modified_base (220)..(220): a, c, t, g, unknown or other
  modified_base (379)..(379): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactataccaaactggttaccagcaagaaacctggacaagcaccgaggcactcattatagtaacaaacaaacaaacactacctacgacccctcgcccgtattcctcgacgtcctcccgtcgtcggggacaacgctcgccctgacnctgtcgtggtgtgcacgctgagacgaggctagactattctcgtcctactcttacgtttggtgtgtgttgtgtacgtagtcggtacgggacggacgaacgcgtacgaccgttacgttaacgtcgaccgaccgaacggtccgtacccgtccccgtcggtacctaaccgttcccgtacccgttacccctaccccttcccgtaccgtacccgtttaacgg

SEQ ID NO: 384295 - DNA, 506 bp, Homo sapiens
  misc_feature: GZ8MTXP02HKXFK.15.76.G10.1.454.CMB.2.raw
  modified_base (328)..(328): a, c, t, g, unknown or other
  modified_base (360)..(360): a, c, t, g, unknown or other
  modified_base (397)..(397): a, c, t, g, unknown or other
  modified_base (415)..(415): a, c, t, g, unknown or other
  modified_base (447)..(447): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtccagcagaaacctggacaagcacccaggcactcattatagtacaaaacaacaaacactactggacccctgcccgattcncagctcctcgtcggggcaaagctgccctgacnctgtctgtgtgcagcctgagacgagctgactattacngcctatctacttggtgtnctgtgctagtcggcgagggacaagctgacgtntaacgtcagcccaaggctcgcccctggaccaacgtctcgttcccacctcctcgtctacg

SEQ ID NO: 384296 - DNA, 557 bp, Homo sapiens
  misc_feature: GZ8MTXP02G9BUI.15.76.G10.1.454.CMB.2.raw
  modified_base (365)..(365): a, c, t, g, unknown or other
  modified_base (406)..(406): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtcccaaggagggacagtcactctcacctgtgcttccaacactggagcagtcaccagtgcttactatccaaactggttccagcagaaacctggacaagcacccaggcactcattatagtacaaacaaacaaacactcctgacccctgcccgattctcagcctccctcgtcggggcaaacgctcgccctgacnctgtctggtgtgcagccgtgaggacgaggctgactattacncgtcctactcttacgtttggtgtgtctgtgtcttagttcggcggacgggtacaaggcgtacgaccgtcgttaaacgtcacgacccgaagccgtccgcccccgtcggtccaaccgtccgtccgttcccctacccgtcctccgtactaaccgg

SEQ ID NO: 384297 - DNA, 559 bp, Homo sapiens
  misc_feature: GZ8MTXP02JTYZ7.15.76.G10.1.454.CMB.2.raw
  modified_base (311)..(311): a, c, t, g, unknown or other
  modified_base (374)..(374): a, c, t, g, unknown or other
  modified_base (525)..(525): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcattatagtacaaacaacaaacactaccncggacccctcgacccgtattctcacggtcctcccgtcgtcggggacaaagctacgccctgacncgtgtcgtggtgtgcagccgtagaggacgaggtcttactattactcgacctactcttacgttggtggtgtcgtgtgtcttagtcggacggacggaccaagcgtgaccgtacgttaacgtcacgaccaacggcctccgccccgtcggtaccnctcgtcgttcccgcctcccgtcgtactacgtacg

SEQ ID NO: 384298 - DNA, 601 bp, Homo sapiens
  misc_feature: GZ8MTXP02GGO2J.15.76.G10.1.454.CMB.2.raw
  modified_base (385)..(385): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacaagcaccaggcactcattatagtacaaacaacaaacactcctaggaccccctgccccgtattcctacaggtcctcccgtcgtcggggacaaacgctcgccctgactcgtcgtcgtggtntcgcagtcctagacggacgacggctagacttagtactgacctacttcttacgtttgggtgtgtcgtgtagtcttaggttccgggacgggacgggaccaaggctacgaccggttacttaacgtacgaacgaccgtaaacgggcctcccggcccccgttggtacctaaccgttccgttcccgttccccggccccttcctaaccggtccgtttaaccgg

SEQ ID NO: 384299 - DNA, 523 bp, Homo sapiens
  misc_feature: GZ8MTXP02H0OY4.15.76.G10.1.454.CMB.2.raw
  modified_base (364)..(364): a, c, t, g, unknown or other
  modified_base (370)..(370): a, c, t, g, unknown or other
  modified_base (376)..(376): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggtccagcagaaacctggacaagcacccaggcactcatttatagtaacaaacaacaaaacactacctcggacccctgcccgattctcaggctccctcttcggggcaaagctgcctgacnctgtcnggtgtncagcctgaggacgtaggctgacttattactcgacctactctactttggtggtgcttgtgtctagttcggcggagcgacaagctgaccgtctaaagtcagtcccaaggcctcgccccctcggtcacgtctcgtcccaccctctcgacc

SEQ ID NO: 384300 - DNA, 628 bp, Homo sapiens
  misc_feature: GZ8MTXP02FZBFV.15.76.G10.1.454.CMB.2.raw
tcagtctacgtagccacgaccggtgctcgatttagtcactcatacaggggggcgccagggggtcccttccaatatcagcaccatggcctggactcctctctttctgttcctcctcacttgctgcccagggtccaattctcagactgtggtgactcaggagccctcactgactgtgtccccaggagggacagtcactctcacctgtgccttccaacactggagcagtcaccagtgcttactatccaaactggttaccagcagaaacctggacaagcaccgaggcactctattatagtaacaaacaacaaacactacctcgacccctcgacccgacttcctacgacgcctccccgtcggttacggggaccaacgcgtcgccctagactcgtcgtcgtggtgtgacacgccgtaggacggacgagggactacggtaacttactacgtcgtaccttactaccttagtttggtcgtgtccgtgtacgtacgttacgttcgggcggacgggaccaaggtccgtacgtaccgtacgttaacggtacacggaccgaaacgtccgtacccgtccccgtccggtacctaaccgtttcccgtacccctaccccttccgtacgtaccgtacggttaaccg

SEQ ID NO: 384301 - DNA, 580 bp, Homo sapiens
  misc_feature: GZ8MTXP02H1L1D.15.76.G10.1.454.CMB.2.raw
  modified_base (368)..(368): a, c, t, g, unknown or other
  modified_base (404)..(404): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactgtccagcagaaacctggacaagcaccaggcactcattatagtacaaacaacaaacactacctggacccctgcccgattcctcaggcctccctccgttcggggcaaacgctacgcctgacntgtctgtgtgcagcctgagacgagctgactattacngtacctactctacgttggtcggttgtcgttgtgtctacgttcgggcgggagggaccgaaagcgtagaccgttacgttaacgtacgacgcccgtaaagggcccttccgcccccgtcggtacctaaccgttccgttccggtttcccccgcccgttccccttccgtacgtttaacccgg

SEQ ID NO: 384302 - DNA, 641 bp, Homo sapiens
  misc_feature: GZ8MTXP02GXGFI.15.76.G10.1.454.CMB.2.raw
  modified_base (220)..(220): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactactaccaaactggttccagcagaaacctggacaagcacccgaggcactctatttactaagtaacaaaacaaacaaaaccactaccgtacggacccctcgccccgattcctacgacggtcctccccgttccggttcgggggaccaaacgtcctacgcccctagacacgtgtctgggtcgtgacacgcccgtagacggacggacggacgtcgaacttattaccgtcgtacccgtactccgtacgtttggtgtcgtcgttgtcgtcgttagttccgggacggtacgggaccgaacggtcgtacggtaccgtacgttaacgccgtacgacccgaaggtccgtcccgtaccccgtcgtcctaaccgtccgttccgttcccccgtcctcccgtccgtaccgtttaaccg

SEQ ID NO: 384303 - DNA, 593 bp, Homo sapiens
  misc_feature: GZ8MTXP02HDJJJ.15.76.G10.1.454.CMB.2.raw
  modified_base (284)..(284): a, c, t, g, unknown or other
  modified_base (330)..(330): a, c, t, g, unknown or other
  modified_base (369)..(369): a, c, t, g, unknown or other
  modified_base (413)..(413): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaactggacagcaccaggcactcattanagtaacaaacaacaaacactacctacggacccctcgcccgtattcncacgcctcccgtcgttcggggacaaacgctcgcctgacncgtgtctggtgtcgacagcctagacggacgagctgacttatacngtcctacttctacgtttggtggttgcgttgtgtcgttagttcgggacgggtacgggaccgaacggtcgtacggtaccgttacgttaacggcacggacccgaaggcccgtccgcccccgttcggtacctccgttccgttcccggttcccccgtcccgttacccgtccgtaccgtaacccgg

SEQ ID NO: 384304 - DNA, 628 bp, Homo sapiens
  misc_feature: GZ8MTXP02HB533.15.76.G10.1.454.CMB.2.raw
  modified_base (289)..(289): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgattgtgtccccaggagggacagtcactctcacctgtgcttccaacactggagcagtcaccagtgcttactatccaaactggtaccagcagaaacctggacaagcacccaggcactctattanaagtaacaaacaaacaaacactcctacggacccctgccccgtattccacgacggtcctcccgtccgtccggggactaaacgcctcgccctagacctacgtgtctgggtgtcgacgacgtccgtaggacggacggacggctacgtacttaacgttacgtcgtaccttaacttcgttacgtttgggtcggttgcgttgtagtcgtagttcggcgggtaagggacccaaggcgtcgacgttcgttaaacgtcgacgtacccgaaggtcctcccgtcccccgtcggttacctccgttcccttccggttaccccctaccccgtccctaccgtccgttaaaccgg

SEQ ID NO: 384305 - DNA, 637 bp, Homo sapiens
  misc_feature: GZ8MTXP02HJAHN.15.76.G10.1.454.CMB.2.raw
  modified_base (285)..(285): a, c, t, g, unknown or other
  modified_base (405)..(405): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtccagcagaacctggacaagcaccaggcactcattanagtacaaacaaacaaacactcctacggacccctgccccgtattctcaacggtcctcccgtccgttcgggggacaaacgctcgccctgactctgtctggtgtgcagccctgaggacgagcngactattactcgtcctactcttacgtttggtggtgcttgtgtcgttagttcgggacgggacgggaaccaaggtccgtacggtaacccggttactttaaacggtccgaaccggaccccgaaaaggggtacccttacccggccccccccgttccggggttaaccctaacccggttccctttacccggttccccctaaccccctttcccgtaccccggtacctttaaaccccggg

SEQ ID NO: 384306 - DNA, 614 bp, Homo sapiens
  misc_feature: GZ8MTXP02JMPRQ.15.76.G10.1.454.CMB.2.raw
  modified_base (288)..(288): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcattanagtaacaaacaaacaaacactcctacggaccccctgaccccgtattcctcgaacggtccctaccccgttccgttaccgggggacctaaacgcctacgcccgtagacctcgtgttcgtggtcgtgcgtagcctaggaggacggagctagacttattacgtcgtacctactcttacgtttggtcggtgtcgtgttcggtcttagttccggacgggacggtaccaacggtcgtacgtaccgttacgttaacgtcgacgtaccgaacgtccgtccgaccccgttcggacctaacgtccgtccttacccgacccttccgtccgactaccgg

SEQ ID NO: 384307 - DNA, 835 bp, Homo sapiens
  misc_feature: GZ8MTXP02H5AE2.15.76.G10.1.454.CMB.2.raw
tcagtctacgtagccacgaccggtgctcgatttagtcactcatacagggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggtaccagcagaacctggacaagcaccaggcactctattatagtaacaaacaacaaacacctacctacggaccccttcgacccgtattctccaacggtccctaccccgtccggttacgggggaccaaaacgggtccctacggtccccgttaggaaccctacgttacgggttcccgttagggggtttcgtcggtaccgaacggtacccggttgggaacggggaaccggtaacgggggtcctaacgggtaacccgtttaaaccttttaaccgtccgggttaaccccttaaacccgtttccttaacccggtttttcgggggttggggtttacggttccggttttagggttcccggtggtttaaacgggtttccggggacccgggggttaacgggggtaaccccgaaagggtcccggttaacggtaacccgggtttaacctttaaaacggggtaccaaaccggtaaccccggtaaaagggcccgttaacccccgggtaccccccgttccggggtaaccctaacccgtttccccgttaccgtttaccccccgggtccccttcccgttaaacccggttccccgtttaaaaccgg

SEQ ID NO: 384308 - DNA, 591 bp, Homo sapiens
  misc_feature: GZ8MTXP02ID16Y.15.76.G10.1.454.CMB.2.raw
  modified_base (313)..(313): a, c, t, g, unknown or other
  modified_base (464)..(464): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgccccagggtccaattctcagactgtggtgactcaggagccctcactgactgtgtccccaggagggacagtcactctcacctgtgcttccaacactggagcagtcaccagtgcttacatccaaacttggttccagcagaacctggacaagcacccaggcactcatttatagtaacaaacaacaaacactaccnggacccctgcccgattctcacggcctccccgtcgtcggggacaaagtctcggcccctgacctctcgtctggttgtagcaagtcccaggaggaccggaaggctagaacttattacctgtacctactcttacgtttggtggtgtcgttggttntcgtagtcgggacggtacggacgtacgcgtacgtaccgttactacgtcgacgaccgacggccgtcccgcccgttccgtacctccgttccgtcccgttccccgtcccttcccgtaccgtaccgtaccg

SEQ ID NO: 384309 - DNA, 568 bp, Homo sapiens
  misc_feature: GZ8MTXP02GKBO3.15.76.G10.1.454.CMB.2.raw
  modified_base (360)..(360): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctcgacccctgcccgatctcagctccctctcggggcaaagctgccctgacnctgtctggtgtcgcacgtcctgacgggacgagggctaggactattacctgaccctactcttacgtttgggtgtgtctgtgtcgtagttcggcggtagggaccaaggcctagacccgttacttaacgtcgtacgacccgaaggccgtccgcccccgtcggttccaaccgttccgtccgttccccgccctcccgtccgtcgttaacccgg

SEQ ID NO: 384310 - DNA, 665 bp, Homo sapiens
  misc_feature: GZ8MTXP02H1AHA.15.76.G10.1.454.CMB.2.raw
  modified_base (292)..(292): a, c, t, g, unknown or other
  modified_base (343)..(343): a, c, t, g, unknown or other
  modified_base (391)..(391): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacataccaaactggttaccagcaagaaacctggaacaagcacccaggcactcatttanagtaacaaaacaacaaaacactacctcggaaccccctgacccctatttccncaacggcctccccgtcgttacggggacaaaaagtctcgacctgaaccncttcgtcgtggttgagccgagtccctagaaggacggtaaggcctacgtaaattattaactcgtaccctaaaccttcgttaaaccgttttggggtggttgtcgtttgggtacgtacgttaggttccggggacgggaacggggaaccaacgtaccgtacggtaacccgttacgttaaacgcgaaccgacccgaaacggtccctcccgtacccccgtacggtacctaacccgttccgtacccgttacccccaccccgttcccgtacgaccgttacgg

SEQ ID NO: 384311 - DNA, 569 bp, Homo sapiens
  misc_feature: GZ8MTXP02JNZW2.15.76.G10.1.454.CMB.2.raw
  modified_base (289)..(289): a, c, t, g, unknown or other
  modified_base (369)..(369): a, c, t, g, unknown or other
  modified_base (380)..(380): a, c, t, g, unknown or other
  modified_base (430)..(430): a, c, t, g, unknown or other
tcagtctacgtagccacgaccggtgctcgatttagtcactcatacaggggggcgccgaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcattanagtacaaacaaacaaacactcctaggacccctcgcccgattctcaggcctccctcgttcggggcaaagctcgccctgacnctgtctggtgngcagcctgaggacgaggctgactatactgcctatctacttggtgtgctgntctagttcggcggagggaccaagcgtgaccgtcttaaacggctacgacccgtaaagggccttccggcccccgtacggtacctccgtcccgttccggtttcccccggaccccgttcccgtaccctccgtttaaacccggg

SEQ ID NO: 384312 - DNA, 545 bp, Homo sapiens
  misc_feature: GZ8MTXP02I9RL5.15.76.G10.1.454.CMB.2.raw
  modified_base (288)..(288): a, c, t, g, unknown or other
  modified_base (365)..(365): a, c, t, g, unknown or other
  modified_base (432)..(432): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcattanagtacaaacaacaaacactcctgacccctgcccgattcctcaggcctcctccgttggggacaaagctcgccctgacncgtgtctggtgtgcagcctgaggacgaggctgactatacctgcctactctacttggtcggtgctgtncttagttcggacgggtagggaccaaaggcgtagaccgttcttaaacgtcaaacgccctaaaggcctacgcccccgtcggtacaaccgtctcgtttcccgctccgctaacgtag

SEQ ID NO: 384313 - DNA, 620 bp, Homo sapiens
  misc_feature: GZ8MTXP02HGD8D.15.76.G10.1.454.CMB.2.raw
  modified_base (261)..(261): a, c, t, g, unknown or other
  modified_base (279)..(279): a, c, t, g, unknown or other
  modified_base (285)..(285): a, c, t, g, unknown or other
  modified_base (311)..(311): a, c, t, g, unknown or other
  modified_base (354)..(354): a, c, t, g, unknown or other
  modified_base (363)..(363): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcacagtgcttactatccaaactggtccagcagaaaccnggacaagcaccaggcacncattanagtaacaaaacaaacaaacactaccncgacccctgcccgattctcagctccctcgtcggggacaaagcncgcctgacnctgtctggtgtgcagtccctagacggacggacggctaggacttacttacgtcgtacccttacttaccgttaccgtttgggtggttcgtcgttggtgtcgttagttccggggcgggaacggggaccgaaacggcgtacggtaccgtacgtttaaacgtccgaacggaccccgaaacggtcccgtccgccccccgttacgggttcccaaccgttccgttccgttcccccggtccccttcccgtccgtaccttaacccgg

SEQ ID NO: 384314 - DNA, 621 bp, Homo sapiens
  misc_feature: GZ8MTXP02FO1V2.15.76.G10.1.454.CMB.2.raw
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtaacaaacaaacaaacacctcctacggaccccctgccccgattcctcaacggcctccccgtcctttcgggggacctaaaacgccgtcgcccctggaacctcgtcgtctggtcgtgcgacgcccgtggacggacgaggctaggtaacttatactgccctacttcttacgtttggtgtgtctgtgtacttagttcggacgggtacgggaccgtaaggcgtacgtaccgttacgttaaacgtcgacgtacccgaacggtccgtacccggtccccccgtcggtacctaaccgttccttccgtttcccttaccgtccggtccgttacggtaacgg

SEQ ID NO: 384315 - DNA, 611 bp, Homo sapiens
  misc_feature: GZ8MTXP02HQT5Z.15.76.G10.1.454.CMB.2.raw
  modified_base (289)..(289): a, c, t, g, unknown or other
  modified_base (364)..(364): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaatggttccagcagaaacctggacaagcacccagggcactcatttanagtacaaacaacaaacactcctggacccctgcccgattctcagctccctccttcggggacaaagctgccctgacnctcgtctggtgtagtcagccctgaggacgagctagactattactgcctactctactttggtgtgtcttgtgtcgtagttcgggacggtacgggacctaaggcctacggtaacccgttcttaaacggttccgaacggacccccgaaacgggtccgttccggcccccccgttaccggggttcctaacccgttccgttcccggtttcccccgtaacccgttcccccgttcggtacccgtttaaacccggg

SEQ ID NO: 384316 - DNA, 595 bp, Homo sapiens
  misc_feature: GZ8MTXP02FPQXO.15.76.G10.1.454.CMB.2.raw
  modified_base (365)..(365): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtaacaaacaaacaaacactacctcggacccctgcccgatctcagctccctcgtcggggcaagctcgccctgacnctgtctggtgtgcagcctgaggacgagctgactatactgcctactcttacgtttggtgtgctgtgctagttcgggacggtacgggaccgaacgcgtacgtaccgttacgttaaacgtccgaacgacccgaaacggtccgtacccggtccccccgttccgggttaccctaaccgttcccgttaccggtttcccccctaccccctttcccgtcccgtaccgtttaaacccgg

SEQ ID NO: 384317 - DNA, 610 bp, Homo sapiens
  misc_feature: GZ8MTXP02I1ZQ6.15.76.G10.1.454.CMB.2.raw
  modified_base (290)..(290): a, c, t, g, unknown or other
  modified_base (337)..(337): a, c, t, g, unknown or other
  modified_base (389)..(389): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtcgcttccaacactggagcagtcaccagtgcttactataccaaagtggtccagcagaaacctggacaagcaccaggcactcattaanacgtaacaaacaaacaaacactacctacggacccctgacccgattcncacgtcctccgtcgtcggggacaacgctcgcctgactcgtcgtcgtggtcgngcagcgtagagacgagcgtagactattactagccttactcttacgtttggtgtgcttgtgtcgttagttcggacgggacggtaccgagtccgtacgtaccgttacgtaacgttcgaaccggtaccgaaacgggtccgttcccggtaccccgttccggtaacctcccgttcccgttccgtttaccccctaccccgttcccgttaccggtaccttaacccggg

SEQ ID NO: 384318 - DNA, 639 bp, Homo sapiens
  misc_feature: GZ8MTXP02H1EFQ.15.76.G10.1.454.CMB.2.raw
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacacgtggagcagtcaccagtgcttactataccaaacgtggtccagcaagaaacctggacaagcacccaggcactctatttaatagtaacaaacaaacaaacacctacctacggacccctcgcccgtattcctcgacgtcctccccgtcgttcgggggaccaaagtctcgccctgactcgtgtctaggtgtcgcgacgtcctaggacggacggacggtcgtaggtacttacgttacgtcgtacccttacgttctttaacgtttgggttcggttgtacgttgttagtcgttaagttcgggacgggtacgggaaccgaggtccgtacgtaccgttacgttaacgtacgtaccgacccgaaacgggccttacccgccccgtccggtcctaaccgtcctccgtcccgtccctcccgtcgtccgttaaccgg

SEQ ID NO: 384319 - DNA, 728 bp, Homo sapiens
  misc_feature: GZ8MTXP02GFXQK.15.76.G10.1.454.CMB.2.raw
  modified_base (222)..(222): a, c, t, g, unknown or other
  modified_base (234)..(234): a, c, t, g, unknown or other
  modified_base (291)..(291): a, c, t, g, unknown or other
  modified_base (336)..(336): a, c, t, g, unknown or other
tcagtctacgtagccacgaccggtgctcgatttagtcactcatacagggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttaccaacactggancagtcaccagtncttactatccaaactcggtccagcagaaacctggacaagcaccaggcactcatttanagtacaaacaacaaacactacctcggacccctgccccgtattccncacggtcctcccgttccggttcgggggaccaaagtcctcgccccttagactcgtcgttcgtgggttgtcgcgacgtccgtacgggaggtaccggaggacctaggtaaacttacttaccgttgtacccgttacttcgttaccgtttgggtggttgtccgttgttaccggtactttacggttcccggggacgggggaaacgggaccgtaaacggttccctacggggttaaccccgtttacgtttaaaaccgggccgttaaaccgggacccccggtaaaggtccccgttaccccgggtacccccccggttcgggttaccctaacccgtttacccgttcccgggtttcccccccgttcccccgtttcccgtacccgtttacccggtttaaacccgg

SEQ ID NO: 384320 - DNA, 604 bp, Homo sapiens
  misc_feature: GZ8MTXP02H1MSQ.15.76.G10.1.454.CMB.2.raw
  modified_base (372)..(372): a, c, t, g, unknown or other
  modified_base (395)..(395): a, c, t, g, unknown or other
  modified_base (550)..(550): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttacatccaaactggtccagcagaactggacaagccaccaggcactctattatagtaacaaacaacaaactactcctacggacccctcgacccgattccacagcctccctcgttcggggactaaacgctcgcctgacncgtgtcgtggtgtcgcagcctgnggacgaggctcgacttatactcgacctacttctacgtttggtggttgacgttgtgtccgttagttcgggcgggacggaccgtaagtcgtacgtacccgttacgttaaacggtccgaaccgcccgaaacggtcccgtccgtcccccgtcggtaccnccttcccggtcctttaccccccgtaccctccccgttacgtacccgttaaaccgg

SEQ ID NO: 384321 - DNA, 640 bp, Homo sapiens
  misc_feature: GZ8MTXP02G3F86.15.76.G10.1.454.CMB.2.raw
  modified_base (289)..(289): a, c, t, g, unknown or other
  modified_base (376)..(376): a, c, t, g, unknown or other
  modified_base (389)..(389): a, c, t, g, unknown or other
  modified_base (422)..(422): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaacttggtccagcagaaacctggacaagcacccgaggcactcattanagtaacaaacaacaaacactccacggacccctgacccgattcctcacggtcctccccgtcgttacggggacaagctacgccctgacncgtgtctggggtntgcagccgtagacggacgaggctgactattacngcctatctacgtttggtgtgcgttgtcgtcgttacgttcgggacggaacggggtacccaaaggtccgtacggtaacccgttacgtttaaacggtaccgaacggaccccgtaaaacggggccttacccggaccccccgttcgggtttaaaccccctaaccgtttcccgtttacccgttacccccgtacccctttcccgtacccggttaccgttaaccgg

SEQ ID NO: 384322 - DNA, 644 bp, Homo sapiens
  misc_feature: GZ8MTXP02GQXUH.15.76.G10.1.454.CMB.2.raw
  modified_base (220)..(220): a, c, t, g, unknown or other
  modified_base (294)..(294): a, c, t, g, unknown or other
  modified_base (384)..(384): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgattgtgtccccaggagggacagtcactctcacctgtgcttccaacactggancagtcaccagtgcttactataccaaacttggttccagcaagaaacctggacaagccaccaggcactcaatttanaagtaacaaaacaacaaaacactccctacggacccctcgaccccgtattcctacgagcctcccgtcgttcggggacaagctcgcctgacnctcgtctggtgtgcagtcctagacgacggacggctacgtaacttacgtacctcgtacccttactacgttacgttttcgggtggttcgtcgttggtcgttacgttaggttccgggacggggtacggggaacctaacgtcgtaccgggtaccgttacgttaaacgtaccgacgtaacccgacggtccctccgcccccgtcggtaccctaacgttccgttacccggttaccccctaccctccgtacccggtaccttaaaccgg

SEQ ID NO: 384323 - DNA, 599 bp, Homo sapiens
  misc_feature: GZ8MTXP02FS7D1.15.76.G10.1.454.CMB.2.raw
  modified_base (241)..(241): a, c, t, g, unknown or other
  modified_base (469)..(469): a, c, t, g, unknown or other
  modified_base (570)..(570): a, c, t, g, unknown or other
  modified_base (590)..(590): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgacttactanaccaaacttggttaccaaggtcaacgaaacctggacaacggccaacccgacgggcaactactactttaataagtaaccaaacaaacaaacacctacctacggacccctcgacccgtattcctacgacggcctccccgttccgttgggggacccaaacggctcggccctagacctactcgtccgtggtcgtgacgtacgccgtagacgaccggagcgtagactaattcncgtacctctacgttgttgggtgtgctgagtcgttagtcggacggacggacaagtcacggtacgtacttacgctacgccgaacgtctacgcccgtcggtacncgtctccgtacccaccgtcncgacttacg

SEQ ID NO: 384324 - DNA, 712 bp, Homo sapiens
  misc_feature: GZ8MTXP02GITNB.15.76.G10.1.454.CMB.2.raw
  modified_base (220)..(220): a, c, t, g, unknown or other
  modified_base (290)..(290): a, c, t, g, unknown or other
  modified_base (308)..(308): a, c, t, g, unknown or other
  modified_base (314)..(314): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggancagtcaccagtgcttactatccaaactcggttccagacaagaaacctgacagcacccaggcactcattanagtaacaaacaacaaacnctaccngacccctgacccgattcctcgacggtcctacccgttccgttcggggaccaaacgcgtcgccctacgacacgtgtccgtgggtgtgtacgacgacccgttgggaacggtaacggacggtacgtacggtaaaccgtttaatttaccgtacgtaccccggtttaacttaccgtttaaaccggtttttcggggttagggtttcggaccgtttgggtttcggtacgtttaaccggtttccgggggtaccggggtaacgggaccccgtaaaggtccgtacgggtaacgttacgtttaacggtaccgtacgacccgtaacggtccgtaccggtacccccgtcggttacccgaaccttcccgttccggttaccccctaccctcccgttaccgtaccgtttaaccgg

SEQ ID NO: 384325 - DNA, 630 bp, Homo sapiens
  misc_feature: GZ8MTXP02H8UIR.15.76.G10.1.454.CMB.2.raw
  modified_base (279)..(279): a, c, t, g, unknown or other
  modified_base (416)..(416): a, c, t, g, unknown or other
  modified_base (427)..(427): a, c, t, g, unknown or other
  modified_base (444)..(444): a, c, t, g, unknown or other
  modified_base (463)..(463): a, c, t, g, unknown or other
  modified_base (592)..(592): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggacgccctcactgactgtcgtccccgagggaggacagtcactctcacctgtcgtccttaccaacacgtggagcagtccaccagtgacttacatacctaaacgtgtaccagacaacgtaaccgngaaccaacgccaacccgacggaccactactaatttaactaagaaccaaaacaaaccaaaccacctacccgaccgtacccctcgccgtacttccacgacgtcctcccgtcggtaccgggactaacgctcgacctgacnctgtctgagtncgagtccgagacgacgngtcagtaactttacgtacncgtacctacgttacgtttagttcggttgtcgtgttgtaagttcgtagtcggggacgggaacgtaccagtccgtacggtaaccgttcttaaggccgtacgaccgacggctccccgtccctgtaacccgtntccccgtaccttcccctaccgtcctaccgtactaccgg

SEQ ID NO: 384326 - DNA, 675 bp, Homo sapiens
  misc_feature: GZ8MTXP02I0VXC.15.76.G10.1.454.CMB.2.raw
  modified_base (300)..(300): a, c, t, g, unknown or other
  modified_base (392)..(392): a, c, t, g, unknown or other
  modified_base (659)..(659): a, c, t, g, unknown or other
tcagtctacgtagccacgaccggtgctcgatttagtcactcatacagggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgtacttactataccaaactcggttaccagcaagaaacctggacaagccaccgaggcactcaatttanagtaacaaacaacaaacgactcctacggacccctgacccgtattcgcaggtccctacccgtcggttacggggacaacgtctcgcctacgacnctgtcgtaggcgtgacgacgccgtaggacggacgtagggcctaggtaacctttagttaccgttacgtacccgttaccttacgttaccggttttggggttaccgggttcggttcgtttcgggtaaggttcgttaacgggttacccgggggagggtaaccgggaacgtaacggtccgtacgtacccgttacgtaacgtcgaaccggtacccgaaacgtccgtcccgacccccgtggtcccaacgttccgtcccgttcccgcccgttccnccggtacgttaaccgg

SEQ ID NO: 384327 - DNA, 602 bp, Homo sapiens
  misc_feature: GZ8MTXP02HD9KF.15.76.G10.1.454.CMB.2.raw
  modified_base (295)..(295): a, c, t, g, unknown or other
  modified_base (362)..(362): a, c, t, g, unknown or other
  modified_base (369)..(369): a, c, t, g, unknown or other
  modified_base (375)..(375): a, c, t, g, unknown or other
  modified_base (405)..(405): a, c, t, g, unknown or other
  modified_base (430)..(430): a, c, t, g, unknown or other
  modified_base (441)..(441): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtcgtccccaggaggacagtcactctcactgtgcttccaacactggagcagtcacagtgcttactatccaaatgtcagcagaactgacagcaccaggcatcattatagtaacaaacaacaaacnctactacgacccgtgacccgatttcacgacgacctccctcgtcggggacaaacgctacgccctgacngtcgtcngtagtncagcctagacgtacgagcgtgactagtacngtcctactcgttcgttaggtcggtntcgttgtcgtntagttcgggacggtacgggaccaggtctacggtacgttcccgttaaagccgtacggacccgaaacgggtccctaccggtacccccgttcccgggttacaacccgtttcggttaccccgttccccgttcccgtcccgtttaaaccgggcctttaaacccggg

SEQ ID NO: 384328 - DNA, 684 bp, Homo sapiens
  misc_feature: GZ8MTXP02I6M44.15.76.G10.1.454.CMB.2.raw
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcacagtgcttactatccaaactggttccagcagaaacctggacaagcaccaggcactcattatagtacaaacaaacaaaacactcctaggacccctgcccgattctcaggctccctccttcgggggcaaagctcgccctggacacgtgtactcgggtgtgcgaagccctggagacggaagggctggactattactgacctacttctacctttgggtacggttgcttggtagtccgtaagttccggggacggtaacgggggaccgaaaacggtaccgtacggtaaacccggttaccgtttaaaacggtttaccgaaacggacccccggaaaaacgggttccccgtacccgggtccccccccgttacccgggggttaccctaacccgttacccgttacccgggtttttccccccggaccccctttccccccggttaccggtacccgtttaaaacccccgggg

SEQ ID NO: 384329 - DNA, 607 bp, Homo sapiens
  misc_feature: GZ8MTXP02HFM6Q.15.76.G10.1.454.CMB.2.raw
  modified_base (163)..(163): a, c, t, g, unknown or other
  modified_base (219)..(219): a, c, t, g, unknown or other
  modified_base (348)..(348): a, c, t, g, unknown or other
  modified_base (400)..(400): a, c, t, g, unknown or other
  modified_base (448)..(448): a, c, t, g, unknown or other
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctnactgactgtgtccccaggagggacagtcactctcacctgtgcttccaacactggancagtcaccagtgcttactactccaaacttggttccagcaagaaacctggacaagccaccgaggcactctatttaataagtaacaaaacaacaaaacacctccgtacggaccccctggacccctattccncgacggcccttccccgtcgttacgggggacctaaagtctcgtaccctgaccncgtgtctggtgtcgcagccgtagacggacggagcgtagtactattacncgtacctacttcttacgtttggtgttgcgttgtcgtcgtaggttcgggacggtacggacgtaagcgtcgactacgttagaccgacgaccgaacggccgtccgtccccgtggtcctaaccttccgtacccgttcccctacctccgtccggtactaaccgg

SEQ ID NO: 384330 - DNA, 841 bp, Homo sapiens
  misc_feature: GZ8MTXP02H5WLH.15.76.G10.1.454.CMB.2.raw
  modified_base (306)..(306): a, c, t, g, unknown or other
tcagtctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggacgccctcactgactgtcgtccccagggagggacagtcactctcacctgtgcttaccaacactggagctagtcaccagtgtctttaactactaccaaacgttcggttaccagcaagaacctggacaagccacccgaggcactctattanagtaacaaacaaacaaacacctaccgtacggacccctacggcccgtatctacgacgtcctccccgtcggttcggggaccaaacgcctcgtcccagacctacgtcgtcgtggtacgttcgcgagtcccggtagacgggacggtaacggcgtaacggtactttaacgtttaaccgtcggttacccttaaccgtttccgtttaacgttttccgggggttggtttcggtcggtttcggttccgtacgtttaaaccgggggtttccgggaccgggggtaaaccgggggttaacccgaaagggttacccggtacccggttaaacccggtttaccccggtttaaaacggttacccggaaacccgggttaccccggaaacccgggggtaccccgtttacccccccggggtcccccgggtttaacccggggttcccccttaaacccggtttcccccgtttaaaacccccgggggtttacccccccttcccccccggtttaccccggtttacccccggttaacccggttttaaaacccccggggg

SEQ ID NO: 384331 - DNA, 626 bp, Homo sapiens
  misc_feature: GZ8MTXP02FKG7F.15.76.G10.1.454.CMB.2.raw
tcagtctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggacgcagtccaccgagtgcttaactatccaaactggtccagcagaactgacaagcaccgaggcactctattatagtaacaaactaacaaacactacctacggacccctgacccgattcgtacacgtcctcccgttccgtcgggggaccaaacgcgtcgccgtagacgtcgtgtctggtcgtcgcgtagccgtaggaggacgaggctaggaacttagtacgtcgtaccttactacgttcgtttagggtggttcgtcgtgtgtacttaggtccgggtacggacggacaacggtcgtacgtaccgtacgtacgacgacgacccggtaaggtccgtacccgtccccgtcggtaccctaacgttccgtttcccggtcccccgtcccgttcccttaccggtactttaaacccggg

SEQ ID NO: 384332 - DNA, 593 bp, Homo sapiens
  misc_feature: GZ8MTXP01EEIPN.10.16.B05.1.454.CMB.2.raw
  modified_base (254)..(254): a, c, t, g, unknown or other
  modified_base (268)..(268): a, c, t, g, unknown or other
  modified_base (303)..(303): a, c, t, g, unknown or other
  modified_base (337)..(337): a, c, t, g, unknown or other
  modified_base (353)..(353): a, c, t, g, unknown or other
  modified_base (372)..(372): a, c, t, g, unknown or other
tcagcatagtagtgcacgaccggtgctcgatttagagctcacgtagttggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactcggacccacagttacattgtaataatgaatntgtctctgtacaanacgaccaggacaaacgccccaaatgatgtatttangatgtacaagtaatccgaccttgtaggggtttcngtatcgtctttcttcncctcaagtctgaaccaacncggccctcctgacctatctcgtcggctacgagacgtggaggacgaggtctagtattatacgtgacagtctacaattaacaacgaacggcggcgtaagggttccgggttggggtcggttaccggggacgggggtaccaacgtacggttacggacccgttacgtacgggtacacgcccgaggcctaccgccccgtggccttacgttcccgttcgttaaccccc

SEQ ID NO: 384333 - DNA, 721 bp, Homo sapiens
  misc_feature: GZ8MTXP02G47UI.10.16.B05.1.454.CMB.2.raw
  modified_base (253)..(253): a, c, t, g, unknown or other
  modified_base (310)..(310): a, c, t, g, unknown or other
tcagcatagtagtgcacgaccggtgctcgatttagagctcacgtagttggggtttgggggggtctcaggaggcggccctctcgggacgtctccaccatggcctgggctctgctattcctcaccctcctcactcagggcacgagggtcctgggcccagtctgccctgactcagcctgcctcgtgtctgggtctccgtggacagtccatcaccatctctgcactcggacccactagttacattgtaatatgaatntgtctcgtggtaccaacacgtacccaggaccaaacgacccccaaatgatgtatttangtatgtacaagtactccgtacccgtcgtaggggtttctgtacttcgtctttcgttcccgtcctaccgtaagtccgtacggacccaacgtacccgggtccccttacccgtacgaccctacttcccgtcgtaccggggtaccctacgaacggtaacgtacgggaacgggaacccggtagggtaccttaaggttaaactttttaacgtaccgtcggtaacctacggtactaactaacgtaaactacggaacggtaccggcgtaagggggttccgggttaggggtccgggttacgggggacggtaccgtaacgtcgtcgggtaaacccggtcgtaacgggtaccgaccgacccggtaacggtccgtcccggtacccccgtaggtccctaccgtttccgttacccgtttacccccc

SEQ ID NO: 384334 - DNA, 567 bp, Homo sapiens
  misc_feature: GZ8MTXP02IP28J.10.16.B05.1.454.CMB.2.raw
  modified_base (302)..(302): a, c, t, g, unknown or other
  modified_base (374)..(374): a, c, t, g, unknown or other
  modified_base (444)..(444): a, c, t, g, unknown or other
  modified_base (555)..(555): a, c, t, g, unknown or other
tcagcatagtagtgcacgaccggtgctcgatttagagctcacgtagttgggtttggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctctgcactggacccacagttacattggtaataatgaatatgtctctggtaccaacagtacccaggcaaacgcccccaaactgatgatttangatgtcagtaatcgaccctgtaggggtttctgatcgtctttctttcgccctacctaagtcctaggcctaacnccgggtcctcccctagtacccacttctcgttcgggccttccagactggaggacgagctgacttattacgngacagtctacactactacgaacgcgacgaggtcggttgggtcggttacggggacgggactacgtacgtcgaccgtacgtacgtcgacgaccgagccgtccgcccgtcgtcncctcgtcgtccc

SEQ ID NO: 384335 - DNA, 427 bp, Homo sapiens
  misc_feature: GZ8MTXP01AVANB.44.64.F09.1.454.CMB.2.raw
  modified_base (266)..(266): a, c, t, g, unknown or other
  modified_base (414)..(414): a, c, t, g, unknown or other
  modified_base (420)..(427): a, c, t, g, unknown or other
tcagacagtatatacacgaccggtgctcgatttagcgcgtatacaagggctggagtggatgggatggatgaagccctatagtggcaacacgggctttgcccagaagttccaaggcagagttagtatgatcaggagcacctccccaggtacagtctacatggaactgagcagcctgagatctgaggacacggccgtgtatttactgtgcgagagccaccagcacctggcttgacttgtggggccagggaccctggtcaccgtctccncacgcctccaccaacgggccccatccggtccttccccctggccgcccctgcctccaggacgccacccgtccgagacgcacagcccggccctgggctgcctggtcaaggctacttcctatatactgtctgacgcgggctgggcaaggcncatagnnnnnnnn

SEQ ID NO: 384336 - DNA, 418 bp, Homo sapiens
  misc_feature: GZ8MTXP02H6YI8.44.64.F09.1.454.CMB.2.raw
  modified_base (408)..(408): a, c, t, g, unknown or other
  modified_base (414)..(418): a, c, t, g, unknown or other
tcagacagtatatacacgaccggtgctcgatttagcgcgtatacaagggctggagtggatgggatggatgaagccctatagtggcaacacgggctttgcccagaagttccaaggcagagttagtatgaccaggagcacctccccaggtacagtctacatggaactgagcagcctgagatctgaggacacggccgtgtatttctgtgcgagagccaccagcacctggcttgacttgtggggccagggaaccctggtcaccgtctcctcagcctccaccaaggcccatcggtcctcccctggccgccctgcctccgaggacgccaccctccgagacgcacagccggccccctggggcctgcctggtcaaggctacttcctatatactgtctgagcgggctggcaagggcncatagnnnnn

SEQ ID NO: 384337 - DNA, 515 bp, Homo sapiens
  misc_feature: GZ8MTXP01EROLU.39.67.G01.1.454.CMB.2.raw
  modified_base (403)..(403): a, c, t, g, unknown or other
  modified_base (490)..(490): a, c, t, g, unknown or other
  modified_base (506)..(515): a, c, t, g, unknown or other
tcagtcgcactagtcacgaccggtgctcgatttagagtatacatattgggtttgggtccctgagactctcttgtgcagcctctggattcacctttacgagttattggatgagctgggtccgccaggctccagggaaggggctggagtgggtggccaacataaaaacaagatggaagtaggaaagaatatgtggactctgtgaagggccggttcaccatctccagagacaacgccaagaactccctggatctgacaaatggacagtctgagagccgaggacacggctgtctatactgcgcgagagaaggagtgggcggtttcgactacgtgggggccagggagccctggtcaccgtcctcctcagccctccaaccaagggcccatcggtccttccccctggccnccctgctccgaggcgcacctccgagacgcacagccgccgtgggctggcctggtacaaggctacgttcactagtgcgactgagcgggnttgggcaaggcgcagnnnnnnnnnn

SEQ ID NO: 384338 - DNA, 630 bp, Homo sapiens
  misc_feature: GZ8MTXP01C6BD4.39.67.G01.1.454.CMB.2.raw
  modified_base (620)..(620): a, c, t, g, unknown or other
  modified_base (622)..(629): a, c, t, g, unknown or other
tcagtcgcactagtcacgaccggtgctcgatttagagtatacatattgggtttgggtccctgagactctcttgtgcagcctctggattcacctttacgagttattggatgagctgggtccgccaggctccagggaaggggctggagtgggtggccaacataaaacaagatggaagtaggaaagaatatgtggactctgtgaagggccggttcaccatctccagagacaacgccaagaactccctggatctgacaaatggacagtctgagagccgaggacaaggctgtctattactgcgcgagagaaggagtgggcggtttcgactacgtgggggccagggacgcccgtggtcaccgtcctccctcacgccctacccgaacccgaacggggcccctagttcccgggttccctttccccccccgtgggccccgtccccgtgcccttcccgaggggacgccaccccgtccggaagacgccacgacggccggcccgtggggccctggggccccgttgggtaccaaacgggtaccttaccgttcccgaacgttaacgggtcgcccgaacgttcgggaacgggccggggtcgttcggggaccgaaaggggcccgacgaagttcggngnnnnnnnng

SEQ ID NO: 384339 - DNA, 592 bp, Homo sapiens
  misc_feature: GZ8MTXP01AMDYM.39.67.G01.1.454.CMB.2.raw
  modified_base (294)..(294): a, c, t, g, unknown or other
  modified_base (363)..(363): a, c, t, g, unknown or other
  modified_base (583)..(592): a, c, t, g, unknown or other
tcagtcgcactagtcacgaccggtgctcgatttagagtatacatattgggtttgggtccctgagactctcttgtgcagcctctggattcacctttacgagttattggatgagctgggtccgccaggctccagggaaggggctggagtgggtggccaacataaaaacaagatggaagtaggaaagaatatgtggactctgtgaagggccggttcaccatctccagagacaacgccaagactccctggatctgcaaatggacagtctgagagccgaggacacggctgtctattacngcgcgagagaaggagtgggcgtttcgactacgtgggggcccaggggacgcccgtggtccaccgttcccncctcacgccctcccaaacccgaacggggccccagtcccgggttccttccccccgtgggccgtcccctaggccctcccgagggcgccgaccctccggaacgacggccaaaccgcggtcccgggccccgtggggccttcggggacccgtgggtccgaaacgggccttaaccttcccacgttagcgcgtactggacggcgggcttggccgaaggccgcagcgnnnnnnnnnn

SEQ ID NO: 384340 - DNA, 551 bp, Homo sapiens
  misc_feature: GZ8MTXP02HASFA.39.67.G01.1.454.CMB.2.raw
  modified_base (340)..(340): a, c, t, g, unknown or other
  modified_base (517)..(517): a, c, t, g, unknown or other
  modified_base (528)..(528): a, c, t, g, unknown or other
  modified_base (541)..(541): a, c, t, g, unknown or other
  modified_base (543)..(551): a, c, t, g, unknown or other
tcagtcgcactagtcacgaccggtgctcgatttagagtatacatattgggtttgggtccctgagactctcttgtgcagcctctggattcacctttacgagttattggatgagctgggtccgccaggctccagggaaggggctggagtgggtggccaacataaaacaagatggaagtaggaaagaatatgtggactctgtgaagggccggttcaccatctccagagacaacgccaagaactcctggatctgcaaatggacagtctgagagccgaggacacggctgtctattactgcgcgagagaaggagtggggcgtttcgactacgtggggccaggggcnccctggtccaccgtcctcctcacgcctaccaccgaacggggccccctagtcccgttcccccgtcccgtcggcccctccgcgtccctacggacggccacccgtaccgccgaagccgaccacgccggcccgtcggcgtcgtcgccggttcgaacgacgtacctcctacacgtgcgcagnggcggcgtcgngacgcgcactagngnnnnnnnnn

SEQ ID NO: 384341 - DNA, 504 bp, Homo sapiens
  misc_feature: GZ8MTXP02FST10.39.67.G01.1.454.CMB.2.raw
  modified_base (409)..(409): a, c, t, g, unknown or other
  modified_base (421)..(421): a, c, t, g, unknown or other
  modified_base (496)..(504): a, c, t, g, unknown or other
tcagtcgcactagtcacgaccggtgctcgatttagagtatacatattgggtttgggtccctgagactctcttgtgcagcctctggattcacctttacgagttattggatgagctgggtccgccaggctccagggaaggggctggagtgggtggccaacataaaacaagatggaagtaggaaagaatatgtggactctgtgaagggccggttcaccatctccagagacaacgccaagaactccctggatctgcaaatggacagtctgagagccgaggacacggctgtctattactgcgcgagagaaggagtgggcggtttcgactactggggccaggggagccctggtcaccgtcctcctcagcctccaccaagggcccatcggtcttccccctgcgccctgctccaggngcacctccgagngcacagcgccctgggctgcctggtcaaggactacgttccactagtgcgactgagcgggctggcaaggcgcatagnnnnnnnnn

SEQ ID NO: 384342 - DNA, 614 bp, Homo sapiens
  misc_feature: GZ8MTXP02HR7WG.39.67.G01.1.454.CMB.2.raw
  modified_base (283)..(283): a, c, t, g, unknown or other
  modified_base (302)..(302): a, c, t, g, unknown or other
  modified_base (335)..(335): a, c, t, g, unknown or other
  modified_base (373)..(373): a, c, t, g, unknown or other
  modified_base (423)..(423): a, c, t, g, unknown or other
  modified_base (446)..(446): a, c, t, g, unknown or other
  modified_base (604)..(604): a, c, t, g, unknown or other
  modified_base (606)..(614): a, c, t, g, unknown or other
tcagtcgcactagtcacgaccggtgctcgatttagagtatacatattgggtttgggtccctgagactctcttgtgcagcctctggattcacctttacgagttattggatgagctgggtccgccaggcctccgaggggaaggggctggagtgggtggccaaacataaaaacaagatggaagtaggaaagaatatgtggactctgtgaagggccgttcaccatctcagagacaacgcaaagacctcctggatctgacaaagtggacagtctgagagccgaggacncggctgtctattactgcgngagaagaggaggtgggtcggtttcgacgtacgnggggccgagggacgcccgtgtccaccgtccctccgtcncgtccctacaccgacgggcccacgttccggtccttccccccgtgggcccncccgtcgccctaccgacgggacnccgacccgtccgaaggacaccgaccgacggtcccgggcccggtgggccgttcggcccgttaggggtacctaaacgggtaacccttaccgttcccgaacgttggtcgacccgtaacgtcgggcggtccgggcgtcgggaccgaggggcctacgctaagngnnnnnnnnn

SEQ ID NO: 384343 - DNA, 248 bp, Homo sapiens
  misc_feature: GZ8MTXP01BZC4F.17.86.H09.1.454.CMB.2.raw
  modified_base (248)..(248): a, c, t, g, unknown or other
tcagcgtagactagcacgaccggtgctcgatttagtgctatagacttgggtttggggggtgtggtggtctccactcccgccttgacgaggctgattattactgcatctcatttgtaagcagtagccttgtgttattcggcggagggaccaagctgaccgtcctgggtcagcccaaggctcgccccctggtcactctcgttcccgccctcctcctagtctacgctgagcgggctggcaaggcgcatagn

SEQ ID NO: 384344 - DNA, 247 bp, Homo sapiens
  misc_feature: GZ8MTXP02G2WSJ.17.86.H09.1.454.CMB.2.raw
  modified_base (246)..(247): a, c, t, g, unknown or other
tcagcgtagactagcacgaccggtgctcgatttagtgctatagacttgggtttgggggtgtggtggtctccactcccgccttgacgaggctgattattactgcatctcatttgtaagcagtagccttgtgttattcggcggagggaccaagctgaccgtcctgggtcagcccaaggctgccccctcggtcactctgttcccgccctcctcctagtctacgctgagcgggctggcaaggcgcatagnn

SEQ ID NO: 384345 - DNA, 595 bp, Homo sapiens
  misc_feature: GZ8MTXP02H3M26.17.86.H09.1.454.CMB.2.raw
  modified_base (375)..(375): a, c, t, g, unknown or other
  modified_base (506)..(506): a, c, t, g, unknown or other
  modified_base (520)..(520): a, c, t, g, unknown or other
tcagcgtagactagcacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaaacatagccttctccgtccccccttcgcagtaacaccaagtacaggaatattaacctgttcccatcgactacgcttcggcctcgccttagggtcactcaccctgccccgattaacgttggacaggaacccttggtcttccggcgagcgggtctttcnccgtcttatcgtactatgtcagcattcgctacttctgatacctcagcatcgcctcacacgcactaccttcacacgtcttacacgtaaacgcctacccctaaccaacaacgtcacgtaacgcgtcgctcgcnctacgcttcgggtnactagttacggtttacgcccccgttttcaaccttcccgttccccgacctacttccgtacggtacttaacgtcccg

SEQ ID NO: 384346 - DNA, 626 bp, Homo sapiens
  misc_feature: GZ8MTXP02JAKLJ.17.86.H09.1.454.CMB.2.raw
  modified_base (451)..(451): a, c, t, g, unknown or other
  modified_base (541)..(541): a, c, t, g, unknown or other
tcagcgtagactagcacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaaccgggacaaccgtcgcccggccaacatagccttctcccgtccccccttgcagtaacacaagtacaggaatattaacctgttcccatcgactacgccttcggcctcgccttaggggtcactccaccctcgccccgtattaacgttggacacggaacccttggtcttccggcgagcggtcttttccgaccgtctttatcgttaacttatgtcagtctattcgctacttctagactaccctcagcatcgccctcacanccaactacccttcacgtacgaccttaacacgaaacctccctaccccctaacccaaaccaacgaccaacgtaacgccgtcgcctcgcccgngtacgtccgttcgtcgtcctaagttcggtttaaccgtccccgtttaactcttccctacccgtacactctacggtactaacgtccg

SEQ ID NO: 384347 - DNA, 555 bp, Homo sapiens
  misc_feature: GZ8MTXP01ANM0K.52.56.F01.1.454.CMB.2.raw
  modified_base (247)..(247): a, c, t, g, unknown or other
  modified_base (314)..(314): a, c, t, g, unknown or other
  modified_base (451)..(451): a, c, t, g, unknown or other
tcagcgcagtacgacacgaccggtgctcgatttagcagacgtctgaacacacaaagggggtgggctcagaagcagagttctggggtgtctccaccatggcctggacccctctctggctcactctcctcactctttgcataggttctgtggtttcttctgagctgactcaggaccctgctgtgtctgtggtcttgggacagacagtcaggatcacatgccaaggagacagcctcaagtaaacttttangcaagttggtacaacagaagccaggacaggcccctgtagctgcatatatggtgaatctatcggcctnaggactcccagaccccgattctcgtggctccagttcgaaggtaaaccactacgtcctttaccttagaccctatcacgtggggctacgaggacggaagagtgaggctagacttagttagtcgtaaccgtcccgggaanacgacgtagtaataactctacgtagttcgtggtcggcggaggaccgaggtcgtcggaccgttcgttaggtccacgccgacggtccgttccgtccccgttcgtcc

SEQ ID NO: 384348 - DNA, 565 bp, Homo sapiens
  misc_feature: GZ8MTXP01B3AC9.52.56.F01.1.454.CMB.2.raw
  modified_base (248)..(248): a, c, t, g, unknown or other
  modified_base (367)..(367): a, c, t, g, unknown or other
  modified_base (405)..(405): a, c, t, g, unknown or other
  modified_base (445)..(445): a, c, t, g, unknown or other
  modified_base (480)..(480): a, c, t, g, unknown or other
tcagcgcagtacgacacgaccggtgctcgatttagcagacgtctgaacacacaaagggggtgggctcagaagcagagttctggggtgtctccaccatggcctggacccctctctggctcactctcctcactctttgcataggttctgtggtttcttctgagctgactcaggaccctgctgtgtctgtggtcttgggacagacagtcaggatcacatgccaaggagacagcctacaagtaaacttttangcaagttggtaccaacagaagccaggacaggcccctgtagctgtcatatatggtgaatctatcggccctgagggactcccgagaccccgtattctctggcctaccagttcaaggaaacncagtcttctgaccatcacgtgggctcgaggacggaagntggaggctagtacttattagttcgtaaaccgtccgggaanagcaagtagtaactctactagttggtggttcgggngggttacgggacccagggtcctggttacccgttcgttaacgggtcacggtcccaagggtccttaccgtcccccgttaacggtccc

SEQ ID NO: 384349 - DNA, 530 bp, Homo sapiens
  misc_feature: GZ8MTXP01C9PS5.52.56.F01.1.454.CMB.2.raw
  modified_base (223)..(223): a, c, t, g, unknown or other
  modified_base (231)..(231): a, c, t, g, unknown or other
  modified_base (244)..(244): a, c, t, g, unknown or other
  modified_base (444)..(444): a, c, t, g, unknown or other
  modified_base (459)..(459): a, c, t, g, unknown or other
  modified_base (483)..(483): a, c, t, g, unknown or other
tcagcgcagtacgacacgaccggtgctcgatttagcagacgtctgaacacacaaagggggtggctcagaagcagagttctggggtgtctccaccatggcctggacccctctctggctcactctcctcactctttgcataggttctgtggtttctctgagctgactcaggaccctgctgtgtctgtggtcttgggacagacagtcaggatcacatgaccaaggnacagcctnaagtaaacttttngcaagttgtaacacagagcaggacaggcccctgtagctgtcatatatggtagaatctatcggccctgagggtactccagaccccgtattctctcggcctacccgagttcaaggtaaaccacacgtcttcttagacccattcgacgtggggctcgaaggacgtagatgaggctgacttattgtacgtaacgtcccgggaanagactagtatatctntgttcgtggtcggcggacggacgnggctcgaccgttcgacgtcacgccgacgtccttccgtcccgttcgtc

SEQ ID NO: 384350 - DNA, 639 bp, Homo sapiens
  misc_feature: GZ8MTXP01EPUQY.52.56.F01.1.454.CMB.2.raw
  modified_base (224)..(224): a, c, t, g, unknown or other
  modified_base (234)..(234): a, c, t, g, unknown or other
  modified_base (249)..(249): a, c, t, g, unknown or other
tcagcgcagtacgacacgaccggtgctcgatttagcagacgtctgaacacacaaagggggtggctcagaagcagagttctggggtgtctccaccatggcctggacccctctctggctcactctcctcactctttgcataggttctgtggtttctctgagctgactcaggaccctgctgtgtctgtggtcttgggacaggacagtcaggatcacatgaccaaggngacagcctanaagtaaactttttgngactaagtcgaacaacagaacgccgaggacgacggccctgtagcgtgtacatatagtggtagtatcgtacgtccggacctacgacggtactccgacgtacccgtattcgtcgtcgtcctaccgtagttcgaaacgtaaaccacgtacgtaccttaccgtacgaaccctatccgtacggtcgggacctacggacgggacggaagagtcggaggtctagtacttaagttacggttacggtaaccggtacccggagtacgtacgtaagttacgtaactctacgtagttcggtcggtaacgggtcgggacgggtaccgaggtccgtacgttaccgttccgttacggtccgaccgtaacccgtacggtccgttcccgtccccggttcgtaacccg

SEQ ID NO: 384351 - DNA, 532 bp, Homo sapiens
  misc_feature: GZ8MTXP01AKDY3.52.56.F01.1.454.CMB.2.raw
  modified_base (225)..(225): a, c, t, g, unknown or other
  modified_base (233)..(233): a, c, t, g, unknown or other
  modified_base (243)..(243): a, c, t, g, unknown or other
  modified_base (254)..(254): a, c, t, g, unknown or other
  modified_base (259)..(259): a, c, t, g, unknown or other
  modified_base (274)..(274): a, c, t, g, unknown or other
tcagcgcagtacgacacgaccggtgctcgatttagcagacgtctgaacacacaaagggggtgggctcagaagcagagttctggggtgtctccaccatggcctggacccctctctggctcactctcctcactctttgcataggttctgtggtttcttctgagctgactcaggaccctgctgtgtctgtggtcttgggacagacagtcaggatcacatgccaagganacagcctnagaaactttngcaagtgacanagaancagacagccctgtanctgtcatatatggtaggaatctatcggcctgagggactcccgagacccccgattctctcggctacccagttcgaagaaacacacgcttctgacccatcacgtggggctcgaggacggaagagtgaggctagtactattagttcggtaacgtcccgggaacagacagtagtaaatctctagttgtgttcggcggagggcccgaggcctggaccgttccgttaggtccagcccgaaggcttcggtccccgttcggtcccg

SEQ ID NO: 384352 - DNA, 676 bp, Homo sapiens
  misc_feature: GZ8MTXP01CYN6X.52.56.F01.1.454.CMB.2.raw
  modified_base (237)..(237): a, c, t, g, unknown or other
  modified_base (251)..(251): a, c, t, g, unknown or other
tcagcgcagtacgacacgaccggtgctcgatttagcagacgtctgaacacacaaagggggtgggctcagaagcagagttctggggtgtctccaccatggcctggacccctctctggctcactctcctcactctttgcataggttctgtggtttcttctgagctgactcaggaccctgctgtgtctgtggtcttgggacagacagtcaggatcacatgaccaagggagacagccctanaagtaaacttttangctaagttggtaaccaagagaaagccaggacaacggcccctgtagctgtacatatagtggtaggaatctagtcggaccctgacgggactcccgagaccccgtattcgtcgtcggcctacccagttccgaaacgggtaaaaccaccgtaacgtccctttacctttacgaaccctagtccgaccggttcgggggccttaccggagggacgggaaagtagttacgggaaggtccgtagtaaccgtttaagtttaacggtttacggtaaaccggttccccggggaaactacggaccgtaaggttaagttaaacgtcttaccgtagtttcggtcgggttcgggcgggttaggacccgaggtccgtcggttacccgttcgttaaggtccacgtaacccgaagggccttaccggtccccgttaacggttccc

SEQ ID NO: 384353 - DNA, 815 bp, Homo sapiens
  misc_feature: GZ8MTXP01B72JF.52.56.F01.1.454.CMB.2.raw
  modified_base (224)..(224): a, c, t, g, unknown or other
  modified_base (234)..(234): a, c, t, g, unknown or other
  modified_base (247)..(247): a, c, t, g, unknown or other
  modified_base (264)..(264): a, c, t, g, unknown or other
tcagcgcagtacgacacgaccggtgctcgatttagcagacgtctgaacacacaaagggggtgggctcagaagcagagttctggggtgtctccaccatggcctggacccctctctggctcactctcctcactctttgcataggttctgtggtttcttctgagctgactcaggaccctgctgtgtctgtggtctgggacagacagtcaggatcacatgaccaaggngacagcctanaagtaaactttangacaagttggtaccaanagaagccaggtacacggcccctgacgctgtacatagtatggtaggactcgtaacgtccggcccttagacgggtactcccgacgtaccccgtattccgtcgtcggaccctaccgtaggttaaccgaaacgggtaaacacccgtacggcccttttacccgttacgggaaacccctacgtttacccgaacgggttcgggggtacccttacccggaagggggtaacccggtaaacgggtacgttaggggaacggggtacccttagggtaacgtttaaccgttttaacggggtttaaaccccgggttaaaccccgggttcccccgggggaaactaacgggtacccgttaaagggtttaacggttaaactttccgtaaaccttagtttcggtcgggtttaaccggggacggggttacgggtaccccgttaacggggtcccgttaacccgggttcccggttacccggttacggggttaaccccgtaaacccgggcccccgtaaacggggtccccgttaccccccgggtcccccccggtttaaggggttaacccccccg

SEQ ID NO: 384354 - DNA, 696 bp, Homo sapiens
  misc_feature: GZ8MTXP01A0BHA.52.56.F01.1.454.CMB.2.raw
  modified_base (224)..(224): a, c, t, g, unknown or other
  modified_base (233)..(233): a, c, t, g, unknown or other
  modified_base (245)..(245): a, c, t, g, unknown or other
tcagcgcagtacgacacgaccggtgctcgatttagcagacgtctgaacacacaaagggggtgggctcagaagcagagttctggggtgtctccaccatggcctggacccctctctggctcactctcctcactctttgcataggttctgtggtttcttctgagctgactcaggaccctgctgtgtctgtggtcttgggacagacagtcaggatcacatgccaaggnacagcctanaagtaactttangacaagttgaacaacagaagccaggacacggcccctgtagctgtcatatagtggtagaactcgtagtccggcctcgacgggtactcccgagacccccgtattcgtacgtcggccctaaccgtacggttccaaacgggaaacctacgtacgttcctttacccgttacggaaaccctacgtttccgaaccggtcgggggtaccttacggaacggggtaccggaaagtacggttagggaaacgggtcctaaggtaacctttaagtttaacgggtttacggtaaacccggttaccccggggaactaaggtaaccgtaaggttaacgtaaactcgttacgtaacgtttgggtcggttcggggacgggacgggtaccgaggtacgtcgttaacccggttcgttaacgggtccacggaacccgacggtccgttacccggtcccccgttgggtaacccc

SEQ ID NO: 384355 - DNA, 760 bp, Homo sapiens
  misc_feature: GZ8MTXP01DVEPJ.52.56.F01.1.454.CMB.2.raw
  modified_base (235)..(235): a, c, t, g, unknown or other
  modified_base (250)..(250): a, c, t, g, unknown or other
tcagcgcagtacgacacgaccggtgctcgatttagcagacgtctgaacacacaaagggggtgggctcagaagcagagttctggggtgtctccaccatggcctggacccctctctggctcactctcctcactctttgcataggttctgtggtttctctgagctgactcaggccctgctgtgtctgtggtcttgggacagacagtcaggatcacatcgaccaaggagacagtcctanaaagtaaacttttangacaagttggtaaccaaagaagccaggaacaggcccctgtagctagtcatatagtaggtagaatctacgtccggcctgacggactcccgacgtaccccgatttctcgtcggcctacccgtaagtttcgaaagggtaaaacccaacgtaacggtccctttaccttacggaacccctaattaccgtaaaccggttggggaacgttacccgtaaagggaaccggggttaacgggaaaacgttacggagggtaacgggtaccgtaattaaaccgtttaaggttttaacgttaaccggtaaacccggttaccgggtaaccgaacgtacggtaaaggttaaaacgtttaacgtccttaaacgttacgggtttgggttaaaccggggttcggggaaccgggggtaacgggttaaacggccgggttcgttaaccccgggttccgtttaacgggtaaccgtaacggtaacccgtaaacccggcggttacccgtcccccggttcccggtttaaccccggg

SEQ ID NO: 384356 - DNA, 662 bp, Homo sapiens
  misc_feature: GZ8MTXP02HI4YI.52.56.F01.1.454.CMB.2.raw
  modified_base (236)..(236): a, c, t, g, unknown or other
  modified_base (248)..(248): a, c, t, g, unknown or other
  modified_base (264)..(264): a, c, t, g, unknown or other
tcagcgcagtacgacacgaccggtgctcgatttagcagacgtctgaacacacaaagggggtgggctcagaagcagagttctggggtgtctccaccatggcctggacccctctctggctcactctcctcactctttgcataggttctgtggtttcttctgagctgactcaggaccctgctgtgtctgtggtcttgggacagacagtcaggatcacatgccaaggagacagcccttanaagtaaactttngactagttagaacaanagacgcagacacgccctgacgctgtacatatagtaggtagtaatctacgtccggtcctacgacggacctacccgacgtaccccgtacttccgtcgtcggtcctaccgtacgttcgaaacggaaacctacgtacgtaccttacctacgtaacctactaccgacggtcgggcctacggagggacggtaaagagtacggacggtactacgtaactttaagtttaacgttacggttaaccgtacccgggtaacgtacgtacgtaaagttaacgtaactcgttacgttacgtttggtacgggttacgggacgggtacgggaaccgtaggtaccgtacggtaccgttacgtacggtaaccgacggacccggtacggtcccgtcccggaccccgttacggtcccg

SEQ ID NO: 384357 - DNA, 685 bp, Homo sapiens
  misc_feature: GZ8MTXP02GINLI.52.56.F01.1.454.CMB.2.raw
  modified_base (249)..(249): a, c, t, g, unknown or other
  modified_base (346)..(346): a, c, t, g, unknown or other
tcagcgcagtacgacacgaccggtgctcgatttagcagacgtctgaacacacaaagggggtgggctcagaagcagagttctggggtgtctccaccatggcctggacccctctctggctcactctcctcactctttgcataggttctgtggtttcttctgagctgactcaggaccctgctgtgtctgtggtcttgggacagacagtcaggatcaacatgaccaaggagacagcctacaagtaaacttttngactaagttcgtaaccaacagaagccatgacacggcccctgagctgtcatatagtggtagaatctatccggcctgaggactccgacgaccgtattcncgtggcctcgtagttacgaacggaaaccacgtacgtcctttacgttacgaccctataccgacgtcgggggtacctacggaacgggaccgggaaagtacgtaggaacgggtccgttaggtaactttaaagtttaacgtttacggtaaacccgttccccgggggtaaactaacggtacgtaaaggttaacgtaacttcgttacgttagtttcgggttacgggttacggggacggggtaacgggtaccggtacgggtaccgtaccggtacccggttaccggtaacgggtacccgaaccgggtacccgtaacgggtcccgtaccccggtacccccgttaccgg

SEQ ID NO: 384358 - DNA, 755 bp, Homo sapiens
  misc_feature: GZ8MTXP02FZZI2.52.56.F01.1.454.CMB.2.raw
  modified_base (226)..(226): a, c, t, g, unknown or other
  modified_base (247)..(247): a, c, t, g, unknown or other
tcagcgcagtacgacacgaccggtgctcgatttagcagacgtctgaacacacaaagggggtgggctcagaagcagagttctggggtgtctccaccatggcctggacccctctctggctcactctcctcactctttgcataggttctgtggtttcttctgagctgactcaggaccctgctgtgtctgtggtcttgggacagacagtcaggatcacatgaccaagganacagcctcaagtaaacttttngactaagttgtaccaacagaagccaggacacggcccctgtagctgtacatatagtggtaggtaatctagtccggcctcgagggactcccgagaccccgtattcctactcggctccgaagttccgaacggaaaccacgtacgtccctttaccttacgaaccctaactccgtaaccggttcgggggaccttaccggaacggggtaccgggaaaacggtagttacggggaacgggtaccgttaggtaaacctttaagtttaaacggtttaaccggttaaaacccggttacccccggggaaacgtaaacgggaacccttaaaggttaaaggttaaacgttccttaccgttaaagttttacgggtcgggtttaccggggacggggtaaacggggacccgtaaacggggtccgttaccggtaaccccggttacccgtttaacgggtaacccgtaaccggtaccccgtaaaaccggggcccttaacccgggtccccccgttacgggttacccccg

SEQ ID NO: 384359 - DNA, 544 bp, Homo sapiens
  misc_feature: GZ8MTXP02HO8C2.52.56.F01.1.454.CMB.2.raw
  modified_base (247)..(247): a, c, t, g, unknown or other
  modified_base (441)..(441): a, c, t, g, unknown or other
tcagcgcagtacgacacgaccggtgctcgatttagcagacgtctgaacacacaaagggggtgggctcagaagcagagttctggggtgtctccaccatggcctggacccctctctggctcactctcctcactctttgcataggttctgtggtttcttctgagctgactcaggaccctgctgtgtctgtggtcttgggacagacagtcaggatcacatgccaaggagacagccctcaagaaacttttangcaagttggtaccaacagaagccaggacaggcccctgtagctgtcatatatggtgaatctatcggcctcgagggactcccagaccccgattctctggctccagttcaggaaacacacgtcttcctgaccatcacgtgggactcgaggacgaagatggaggctgacttatttagttacgttaacgtcccgggaanacggctaaggtagtaaacttcgtactagttgtcggttcggcaggacggtaccacggcgtacgaccgtcgtaacggtcacgcccgaagcctcgacccccgtcgg

SEQ ID NO: 384360 - DNA, 518 bp, Homo sapiens
  misc_feature: GZ8MTXP02FW64L.52.56.F01.1.454.CMB.2.raw
  modified_base (225)..(225): a, c, t, g, unknown or other
  modified_base (247)..(247): a, c, t, g, unknown or other
  modified_base (374)..(374): a, c, t, g, unknown or other
  modified_base (405)..(405): a, c, t, g, unknown or other
tcagcgcagtacgacacgaccggtgctcgatttagcagacgtctgaacacacaaagggggtgggctcagaagcagagttctggggtgtctccaccatggcctggacccctctctggctcactctcctcactctttgcataggttctgtggtttcttctgagctgactcaggaccctgctgtgtctgtggtcttgggacagacagtcaggatcacatgccaagganacagcctcaagtaaacttttangcaagttggtaccaacagaagccaggacaggcccctgtagctgcatatatggtggaatctatcggcccttcagggatcccgagaccccgtagttcctctggctccagttcaggaaacacagcttctnaccatcactgggctcgaggcgaagatgagcngactattatgtaactccggactagccagtagtaatctcattgtgttacggcggtaggacccgaggcgtcgtaaccgtccgtaggcgacgccaacggctcgccccgtcgtcccg

SEQ ID NO: 384361 - DNA, 578 bp, Homo sapiens
  misc_feature: GZ8MTXP02IYSK3.52.56.F01.1.454.CMB.2.raw
  modified_base (245)..(245): a, c, t, g, unknown or other
  modified_base (339)..(339): a, c, t, g, unknown or other
  modified_base (362)..(362): a, c, t, g, unknown or other
tcagcgcagtacgacacgaccggtgctcgatttagcagacgtctgaacacacaaagggggtgggctcagaagcagagttctggggtgtctccaccatggcctggacccctctctggctcactctcctcactctttgcataggttctgtggtttctctgagctgactcaggaccctgctgtgtctgtggtcttgggacagacagtcaggatcacatgccaaggagacagcctcaagtaaacttttngacaagttgtaccaacagaagccaggacaggcccctgtacgctgcatatatggtagaatctagtccggcctcgaggctccgagacccgattccnctggctccgagttcaaggaaacncgacgtccttacctgaccctatcacgtggggctacgagggacgaagagtgaggctagtacttacgtttagttcgtaaccgtcccgggatacgcaagtagtaatctactagttcggtacggtttacgggcgggtagggaccgagggtccgtacggacccgttccgtaacggtccgacggtacccgaacggtccctaccggtcccccgtcggttaccc

SEQ ID NO: 384362 - DNA, 644 bp, Homo sapiens
  misc_feature: GZ8MTXP02H1TUW.52.56.F01.1.454.CMB.2.raw
  modified_base (250)..(250): a, c, t, g, unknown or other
  modified_base (639)..(639): a, c, t, g, unknown or other
tcagcgcagtacgacacgaccggtgctcgatttagcagacgtctgaacacacaaagggggtgggctcagaagcagagttctgggggtgtctccaccatggcctggacccctctctggctcactctcctcactcttgcataggttctgtggtttcttctgagctgactcaggaccctgctgtgtctgtggtcttgggacagacagtcaggatcaacatgaccaaggagacagcctagaagtaaacttttgngactaaaggttgtaaccaaacgagaaacgaccgaaggaccgacggcccctgtacgctgtacatagtagtggtagtaatcgtaagtccggcctaggaacggtactccccgaagtaccccgtattcctcgtacggtcctacgtacgttcgaaacggtaaacacgtacgtccctttcgtacgacccagtccgacggtcggggactacggaggtaggaacgagtcgaggtctacgtattaaagtttacgtacggttaaccgaccggggacaggtctaaaggtgtaaactcgtacttaggtttgacggttacgggaccggtacgggaactcggtcgtaccgacccggttacgacgtccgaccggaccttacgggccttccccgccccggtttanccccg

SEQ ID NO: 384363 - DNA, 648 bp, Homo sapiens
  misc_feature: GZ8MTXP02HC9MI.52.56.F01.1.454.CMB.2.raw
  modified_base (87)..(87): a, c, t, g, unknown or other
  modified_base (248)..(248): a, c, t, g, unknown or other
  modified_base (352)..(352): a, c, t, g, unknown or other
  modified_base (415)..(415): a, c, t, g, unknown or other
tcagcgcagtacgacacgaccggtgctcgatttagcagacgtctgaacacacaaagggggtgggctcagaagcagagttctggggtntctccaccatggcctggacccctctctggctcactctcctcactcttgcataggttctgtggtttcttctgagctgactcaggaccctgctgtgtctgtggtcttgggacagacagtcaggatcacatgaccaaggagacagcctacaagttaaactttangactaaggttcggtaaccaaacgagaacgccgaggacacggcccctgacgctgacatatagtggtagaatctatccggcctgaggctaccagaccccgtatccnctgctcctagtcgaagaactactctcttacagacctatcacggtcggctagacggacggaagngtagggacgtactacggtaaactttagtttaacgttacggtaaacccgttcccggggaaactaggtaactaaacggtttaagtaaaccgttcttaccgttaaaggtttcggtacggggtttaccgggacgggtaacgggtaccgtaacgggtccgttacggtacccgttaccgtaacggtccgaccgggaacccgtacggtccctccccggacccccgtttcggtaacccccg

SEQ ID NO: 384364 - DNA, 742 bp, Homo sapiens
  misc_feature: GZ8MTXP02HO3EP.52.56.F01.1.454.CMB.2.raw
  modified_base (249)..(249): a, c, t, g, unknown or other
tcagcgcagtacgacacgaccggtgctcgatttagcagacgtctgaacacacaaagggggtgggctcagaagcagagttctggggtgtctccaccatggcctggacccctctctggctcactctcctcactctttgcataggttctgtggtttcttctgagctgacctcaggaccctgctgtgtctgtggtcttgggacagacagtcaggatcacatgaccaaggagacagcctacaagtaaacttttngctaaaggttcgaccaacgagaacgcctaaggacacggtcccctagtacggctgtacattagtatggtaggaaaacttctaacgttccgggacccctagaacggggttaaccctaccccgtaaggtacccccgtactttccgtacgtcggtaccttaccgtaagtttaccgaaacggaaactaccgttaccgtaccctttaccgtaacgaccctataccgtacggtcgggacctacggaagggtacggaaagtacggtacggaacggtcgtacgtaacgttaacgtttaacgttaacggttaaccggtaacccggtaaccgtaacgtaacgtaacggttaacgttaacgttacgttacgttacgttacggttacggttacgggtaccgggtaccgggtaaccggtacggtaccggtaccgtacccggttaccgtaacggtaaccgtaccgtacccggtaccggtaccgtacccgtaccccgtacccggtaccg

SEQ ID NO: 384365 - DNA, 779 bp, Homo sapiens
  misc_feature: GZ8MTXP02JGX0A.52.56.F01.1.454.CMB.2.raw
  modified_base (254)..(254): a, c, t, g, unknown or other
  modified_base (275)..(275): a, c, t, g, unknown or other
tcagcgcagtacgacacgaccggtgctcgatttagcagacgtctgaacacacaaagggggtgggctcagaagcagagttctgggggtgtctccaccatggcctggacccctctctggctcactctcctcactctttgcataggttctgtggtttcttctgagctgactcaggaccctgctgtgtctggtggtctgggacagacagtcaggatcactatcgaccaaggagacacgtcctactaagtaaacttttngtactaagttcggtaaccaanagaacgccgaaggaccacggcccctgtacgctgtcattatagtggtagtaactacgtagtcccggacctgaacgggtacctaccgacgaccccgtattaccgtcgtacggtcctaccgtaagttccgaaacggaaaccacgtaccgtcctttaccgtacgacctacgtcgaaccggttcggggaccttacgggaaggggacgaacggtacggtacgggtaagggtccttaaagggttaactttaacgtttaaacgggttaacccgttaaaacccccgggggtcccccgggttaaacgaagtaaaccgggttaaccgttaaaggtttaacctaccgttagttacggtttacgggttcggggtttaaccggggacgggttaaaccgggggacccggtacgggtacccgttaccggggtaacccggtaccggtttacggaacccggaccgggtaacccggtaaccgggttcccgtaccccggttcccccggtaacggtttcccccgg

SEQ ID NO: 384366 - DNA, 285 bp, Homo sapiens
  misc_feature: GZ8MTXP01COHYV.11.75.G09.1.454.CMB.2.raw
  modified_base (282)..(282): a, c, t, g, unknown or other
  modified_base (284)..(285): a, c, t, g, unknown or other
tcagcgagagataccacgaccggtgctcgatttagtatagacatcagggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttcccaccctcctcgtatctctcgctgagcgggctggcagagcanann

SEQ ID NO: 384367 - DNA, 288 bp, Homo sapiens
  misc_feature: GZ8MTXP01CQWOK.11.75.G09.1.454.CMB.2.raw
  modified_base (287)..(288): a, c, t, g, unknown or other
tcagcgagagataccacgaccggtgctcgatttagtatagacatcagggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttcccaccctcctcgtatctctcgctgagcgggctggcaaggcgcatagnn

SEQ ID NO: 384368 - DNA, 520 bp, Homo sapiens
  misc_feature: GZ8MTXP01EC2SQ.11.75.G09.1.454.CMB.2.raw
  modified_base (257)..(257): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtcccacctccaatatcggggccgttanggtatgctctggtatcaaacaacgtccaaggaatcggacccccaaaactcctcatctaatgctgacaaacaatcccgaccttgacggggtccctgaacccggttctcgtggctccaagtctggctctccgctcttgccatcactgggctcgaggctgacgagtggaggtctagattactactgtctgtcctatgacgacaactacagtacttcgggtttcgcggagggcttaaggctgaaccgtccaagttcaacgcccaagg

SEQ ID NO: 384369 - DNA, 499 bp, Homo sapiens
  misc_feature: GZ8MTXP01D5USQ.11.75.G09.1.454.CMB.2.raw
  modified_base (420)..(420): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctgggccccagggcagagggtcgccatctcctgcactggtccacctccaatatcggggccgttatggtatgctctggtatcaacaacgtccaggaatcggcccccaaatcctcatctatgctgacaacaatcgacctttcaggggtccctgaccgttctctggcctcagtctgctctccgctctgccatcactgggctcgagctgacgatgaggctgattactactgtctgtcctatgacgacgacctacngtactccggtttcggcggtaggctaagctgaccgtcttaagtcagccgaggctcgcccctgcacttctcgttccctccc

SEQ ID NO: 384370 - DNA, 538 bp, Homo sapiens
  misc_feature: GZ8MTXP01EPJOB.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggcgttatggtatgctctggtatcaacaacgtccaaggaatcggacccccaaactcctcatctatgctgacaacaatcgaccttcgacggggtccctgaccgttctctcggcctccaagtctggccttcttctcgcccttccgttcggcctatcacgtgggctcggaggctgacgatcggaggtctgattactactgtctggtccttatgaccgacgacctacagtaccttccgggtttcggcgggaggactaagcttgacccgttctaagtcacgcccaaggcctcgcccctggtcactcgttcgtcccc

SEQ ID NO: 384371 - DNA, 504 bp, Homo sapiens
  misc_feature: GZ8MTXP01BS6KT.11.75.G09.1.454.CMB.2.raw
  modified_base (328)..(328): a, c, t, g, unknown or other
  modified_base (461)..(461): a, c, t, g, unknown or other
tcagcgagagataccacgaccggtgctcgatttagtatagacatcagggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactggtccacctccaatatcggggccgttatggtatgctctggtatcaacaacgtccaaggaatcggacccccaaactcctcatctatgctgacaacaatcgacttcgagggtcctgaccgttcnctggcctcagtctgctcttccgctctgccatcactgggctgagctgacgatgaggctgattactactgtctgtcctatgacgacgacctacagaccgttcggtttcggcggaggctaagctgacgtcaagtcncgcccgaggcctcgccccctgtccacttctcgttccctaaccc

SEQ ID NO: 384372 - DNA, 653 bp, Homo sapiens
  misc_feature: GZ8MTXP01BUJE5.11.75.G09.1.454.CMB.2.raw
tcagcgagagataccacgaccggtgctcgatttagtatagacatcgaggggacaagaggcagcactcaggacaatctccaacatggcctggtctcctctcctcctcactctcctcgctcactgcacagggtcctgggcccagtctgcgctgacgcagcccgccctcagtgtcgtcggggccccagggcaggagggtcgccatctcctgcacgtggtccacctccaatagtcgggggccgttatggtatgctctggtatcaacaacgtccaaggaactccggaccccctaaactcctcatctatcgctagaacaacaatccgtaccttcgacggggtccctacggtacccggttctcgtcggccctaccgtaaggtccgtcggtccttccccgttccccgtcccttcccgtttacgggccctactccgacgtcggggtcctcggaggtcgtagacgagtgacggctagtacttacttactcgttcgttcgtctacgtcggaccgaccggtacctacgacgtaccgttcccgggtttcgggacgggtacggtacgtaagccgtcggacccgttacgttaacgtacaccggacccgacggcccgtcccgtcccccgttccggtcctccttcccgttcccgttccccttaacccccg

SEQ ID NO: 384373 - DNA, 598 bp, Homo sapiens
  misc_feature: GZ8MTXP01DDB9N.11.75.G09.1.454.CMB.2.raw
  modified_base (594)..(594): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgcctcagtgtctggggccccagggcagaggtcgcatctcctgcactcggtccacctccaagtagtcggggccgttatggtatgctctggtatcaacaacgtccaggaactcggaccccaaactcctcatctatgctgacaacaactcgaccttcgacgggtccctcgtaccggttctcgtcgtcctcctaagtctggtcctccttcccgtccttccttcggacccacttcgacgtgggtctcgaggcctagacgtagtgaacggctttagactttacgtactggttctagtcctagtggaacaccgacgtacacgttccgttaccgggtttcgggagaagggttaccaaggtcctcgttaaacccggtcttaaacgtccaacggcccttagggccctccggtcccctaacggtcctacttcccttcgtttcccccncccg

SEQ ID NO: 384374 - DNA, 515 bp, Homo sapiens
  misc_feature: GZ8MTXP01BVA9U.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccgttatggtatgctctggtatcaacaacgtccaggaatcggcccccaaatcctcatctatgctgacaacaatcgacctttcgaggggtccctgaccggttctctggcctccaagtctggctcttccgctcctggccatcactgggctcgagctgacgatgaggctgattactactgtctgtcctatgacgacgacctacagtacctcggtttcggcggaggactagctgaccgtcttagtcagcccgaggcctcgcccctcggtcacttcctcgttccctaaccc

SEQ ID NO: 384375 - DNA, 514 bp, Homo sapiens
  misc_feature: GZ8MTXP01D2L3G.11.75.G09.1.454.CMB.2.raw
  modified_base (257)..(257): a, c, t, g, unknown or other
  modified_base (450)..(450): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtcccacctccaatatcggggccgttanggtatgctctggtatcaacaacgtccaggaatggcccccaaactcctcatctatgctgacaacaatccgaccttcaggggtccctgaacccggttctctggctccaagtctgctcttccgctcctgccatcactgggctcgagctgacgatggaggctgattactactgtctagtcctatgacgcgaacctanagtacttccgggtttcggcggagggcttaaggctcgaaccgtctaagttcaacgcccgtaacgg

SEQ ID NO: 384376 - DNA, 518 bp, Homo sapiens
  misc_feature: GZ8MTXP01A4F6A.11.75.G09.1.454.CMB.2.raw
  modified_base (449)..(449): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctgggccccagggcagaggtcgccatctcctgcactgggtccacctccaatatcggggccgttatggtatgctctggtatcaacaacgtccaggaatcggcccccaaactcctcatctatgctgacacaatcccgaccttcgaggggtccctgaacccggttctctggctccaagtctggctcttcccgctcttggccatcactgggatcgagctgacgatgggaggctgattacactgtctgtcctttgactattaacnggtattggacgttagtcggcggacgggttcccacggtaacgtcctaagtcagttcccaaggttctcccg

SEQ ID NO: 384377 - DNA, 581 bp, Homo sapiens
  misc_feature: GZ8MTXP01AUVAS.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtcgtggggccccagggcagagggtcgccatctcctgcactgggtccacctcaatagtcggggccgttagtggtatgctctggtatcaacacgtccaggaactcggacccccaaactcctacatctatgctagacaaacatcccgaccttcgacgggtccctgtaacccggttctcgtggcctccagtccgtggccttccttcccgtccttccgttcgccatcacgtgggctcggagctgacgtagtgggaggtccttagtactttactacgttgtctacgtccttatcgaaccgtacgaaccctaagcgtaccgttccgggtttcgggacgggttagggttacttacgtcgtacgtaacccgtccgtaagttcccaacgttccccgtaacggg

SEQ ID NO: 384378 - DNA, 568 bp, Homo sapiens
  misc_feature: GZ8MTXP01DE30F.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtcggggccccagggcagagggtcgccatctctgcacgtggtccacctccaatagtcgggggccgttatggtatgctctggtatcaacacgtccaaggaactcggacccccaaactcctcatctatgctgacaacaatcgaccttcgacgggtccctgaccgttctcgtcgtccctaccagtcgtggtcctccgttcccgccttccttgggccctatcacgtgggctcgagctgacgatgaggtctgattacactgtctcgtactagtgaccgacgacctacgacgtaccgttccgggtttcggcggtaggacgtagcgttcgaccgttacgacgtcgacgacccgacggttccctccgacccccgtcggtcctaccgttcctccgttccccgtcccc

SEQ ID NO: 384379 - DNA, 523 bp, Homo sapiens
  misc_feature: GZ8MTXP01D6G3U.11.75.G09.1.454.CMB.2.raw
  modified_base (503)..(503): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctgggccccagggcagagggtcgccatctcctgcactgggtccacctccaatatcggggccgttatggtatgctctggtatcaaacacgtccaggaatcggacccccaaactcctcatctatgctgacaacaatcgaccttcgagggtccctgaccggttctctggcctccaagtctggctccttcccgcctccttggccatcactgggctcgagctgacgatgaggctgattactactgtctgtcctatgacgacgactacagtacgttccggtttcggcggtagggctaaggctgaccgtcttaagtcacgcccgagctcgcccctcggtcncgttctcgttcccctaaccc

SEQ ID NO: 384380 - DNA, 561 bp, Homo sapiens
  misc_feature: GZ8MTXP01BV6CC.11.75.G09.1.454.CMB.2.raw
  modified_base (258)..(258): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtcccacctccaatagtcggggccgttanggtatgctctggtatcaaagaacgtccaggaactcggacccccaaactcctcatctatgctgacaacatcccgaccttcgaggggtccctggtaacccggttctcgtgggcctaccaagtctcgggtctccttcccgtcccttccgttggccctatccgacgtcggggtctcggaggctaggacgagtggggaggtctgtaattactaatgtctgtcctagtgaccgacaacctacaggtaccgttccggtttcggcgggagggcttaagctaggaaccctctaagttccaacgcccgtaagg

SEQ ID NO: 384381 - DNA, 534 bp, Homo sapiens
  misc_feature: GZ8MTXP01A0EN9.11.75.G09.1.454.CMB.2.raw
  modified_base (393)..(393): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccgttatggtatgctctggtatcaacaacgtccaaggaactcggaccccccaaatcctcatctatgctgacaacaatccgacctttcgagggtccctgaccggttctctggccctccaagtctggctcttccgcctctggccatcactgggctcgagctgacgntgagctgatactactgtctgtcctatgacgacgtacctacagtcgttccggtttcggcgggtaggctaagctcgaccgtaccttagtcgacgcccgaggttcctcgccccctcggtctaccttctcgttccccgtaacccc

SEQ ID NO: 384382 - DNA, 515 bp, Homo sapiens
  misc_feature: GZ8MTXP01BETDN.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctctggtatcaaacaacgtccaggaatcggaccccccaaactcctcatctatgctgacaacaatcgaccttcaggggtccctgaccgttctctgcctcagtctgctctccgctctgcatcactgggctcgagctgacgatgagctgattacactgtctgtcctatgacgacgactcgagtacttcgggtttcggcgggtaggactaagctggacccgtcttaagtcagttcccgaggctccgcccctcggccacgttctcgttccctccccg

SEQ ID NO: 384383 - DNA, 504 bp, Homo sapiens
  misc_feature: GZ8MTXP01CAPK4.11.75.G09.1.454.CMB.2.raw
  modified_base (342)..(342): a, c, t, g, unknown or other
  modified_base (464)..(464): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccgttatggtatgctctggtatcaacaacgtccaggaatcggcccccaaatcctcatctatgctgacaacaatcgacttcaggggtccctgaccgttctctggcctccagtcngctctccgctctgccatcactgggctcgagctgacgatgaggctgattactactgtctgtcctatgacgacgacctacacgtacgtccggtttcggcggaggactaagctgaccgtcagtcngcccgaggcctcgcccctggtcacttctcgttcccctccc

SEQ ID NO: 384384 - DNA, 532 bp, Homo sapiens
  misc_feature: GZ8MTXP01D0G8E.11.75.G09.1.454.CMB.2.raw
  modified_base (258)..(258): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctgggggccccagggcagagggtcgccatctcctgcactgggtcccacctcaatatcggggccgttanggtatgctctggtatcaacaacgtccaggaatcggacccccaaactcctcatctatgctgacaacaatcccgacctttcgaggggtccctgtaacccggttctctggcctccaagtctggctcttccgcctccttgccatcacgtgggctcgagctgacgatgggaggtctgacttactactgtctcgtcctatcgacgacgaacctacgagtaccgttccggtttggcggagggcttaagctgaacccgttcaagttccaacgccccgtaagg

SEQ ID NO: 384385 - DNA, 572 bp, Homo sapiens
  misc_feature: GZ8MTXP01EJY7I.11.75.G09.1.454.CMB.2.raw
  modified_base (327)..(327): a, c, t, g, unknown or other
  modified_base (348)..(348): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccgttatggtatgctctggtatcaacaacgtccaggaatcggcccccaaatcctcatctatgctgacaacaatcgaccttcagggtccctgaccgttnctgcctccagtctgctctccnctctgccatcacgtggctcgagctgacgatgaggtctgtattactactgtctcgtctatcgacgacgacctacgacgtaccgttaccgggttttcgggccgggtaagggtacgtaaacggctacggttacccgtacccgttaaagtccgacggaccccgaagggttcccgtccgtcccccgttccgggtccctaccgttcccttccggttcccccttaaccccg

SEQ ID NO: 384386 - DNA, 534 bp, Homo sapiens
  misc_feature: GZ8MTXP01ANXPD.11.75.G09.1.454.CMB.2.raw
  modified_base (261)..(261): a, c, t, g, unknown or other
  modified_base (483)..(483): a, c, t, g, unknown or other
  modified_base (524)..(524): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagcccgccctcagtgtcgtcggggccccagggcaggagggtcgccatctcctgcactgggtccacctccaatagtcggggcgttanggtatgctctggtatcaacaacgtccagggaactcggacccccaaactcctcatctatgctagaacaacatcccgaccttcgacggggtccctggtaacccggttctcgtgggtcctccaagttctggccttccgttcccgtccttccgttggccctatccacgtcgggctcggagctgacgatggggagtctgtattaccatgtctgtctatgacgcaacnagtcgttcggttcggcggaggcttaggctcgccgtctagcncgccgaacgg

SEQ ID NO: 384387 - DNA, 581 bp, Homo sapiens
  misc_feature: GZ8MTXP01ACEXL.11.75.G09.1.454.CMB.2.raw
  modified_base (255)..(255): a, c, t, g, unknown or other
  modified_base (453)..(453): a, c, t, g, unknown or other
  modified_base (463)..(463): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagaggtcgccatctcctgcactgggtccacctcaatagtcggggccgttanggtatgctctggtatcaaacaacgtccaggaactcggacccccaaatcctcatctatgctagacaacaatcccgaccttgaacggggtccctggtaacccgttctctggcctcaacgtcgtcggtcttcccttcccgtccttccgttcgccacttcacgttgggctcggaggctgacgagtggagctgacttactacngtctgtcctntagacgccgaacctacgacgtaccgttccgggttttcgggcgggttaacggggttacttaaacggtctacgggtaacccttacccgtaacggttaccgaaccggccccgtaaaccggg

SEQ ID NO: 384388 - DNA, 538 bp, Homo sapiens
  misc_feature: GZ8MTXP01DCLU3.11.75.G09.1.454.CMB.2.raw
  modified_base (254)..(254): a, c, t, g, unknown or other
  modified_base (419)..(419): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctcaatatcgggccgttanggtatgctctggtatcaacaacgtccaggaactcggacccccaaatccctcatcctatgctagacaacaactcccgaccttcgacgggggtcccctgaacccggttctcgtcggcctccaagtctggctctccgctccttcgcatcacgtggctcgagctgacgntgggacggctgattactactgtctgtcctatcgacgacgaacctacgagtaccgttcgggtttcggcggttacgggcttaaggctagaaccgttactaggttacaacggcccgtaacgg

SEQ ID NO: 384389 - DNA, 528 bp, Homo sapiens
  misc_feature: GZ8MTXP01B04AO.11.75.G09.1.454.CMB.2.raw
  modified_base (259)..(259): a, c, t, g, unknown or other
  modified_base (470)..(470): a, c, t, g, unknown or other
  modified_base (518)..(518): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtcccacctccaatagtcggggccgttanggtatgctctggtatcaacacgtccaggaactcggacccccaaatcctcatcctatgctgacaacatcccgaccttgacggggtccctgtaacccgttctcgtggctccaagtctggctccttccgctcttggccatcacgtgggctcgaggctgacgagttgggaggcttagactttactactgtctgtcctaatcgacgacgaacctanaggtacttccggtttggcggagggcttaggcttgaaccttccagttcncgcccgaagg

SEQ ID NO: 384390 - DNA, 289 bp, Homo sapiens
  misc_feature: GZ8MTXP01EJ38U.11.75.G09.1.454.CMB.2.raw
  modified_base (288)..(289): a, c, t, g, unknown or other
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttcccaccctcctcgtatctctcgctgagcgggctggcaaggcgcatagnn

SEQ ID NO: 384391 - DNA, 536 bp, Homo sapiens
  misc_feature: GZ8MTXP01CG39L.11.75.G09.1.454.CMB.2.raw
  modified_base (364)..(364): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatcggcccccaaatcctcatctatgctgacaacaatcgaccttcacggggtccctgaccggttctctggccctccagtctgctcttccgctctgccntcactggctcgagctgacgatgaggctgattactactgtctgtcctatcgacgacgacctacacgtacgttccgggtttcggcggagggtactaagctcggaccgtccgttaagtccgacgcccgaggcctccgcccccgtcggtcctacgttccgtccgttccccgtcccc

SEQ ID NO: 384392 - DNA, 657 bp, Homo sapiens
  misc_feature: GZ8MTXP01COLW5.11.75.G09.1.454.CMB.2.raw
  modified_base (260)..(260): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagcccgcctcagtgtcgtggggccccagggcaggagggtcgccatctcctgcacgtcgggtccacctcaatagtcggggcgttanggtatgctctggtataacaacaacgtccaaggaactcggacccccaaactcctacattctatcgactagaacaaacaactcccgaccttcgacggggtccctacggtaacccgttctcgtcggcctacctaacgtctcggtcttcccgttcccgccttcccgttggccacgtccgacgtcgggccttcggagccgttagaacgtagtcggggaacggtcttagtaactttaccttacgttcggttctttacggtaccttaagtacgaaccgtaccggtaaaccttaacgacgggtttacccgttccggggttttacgggacgggttaacgggttacgttaacggtcctacgggtaacccgttaaccggtaagttaccgaaccggttcccgtaacggg

SEQ ID NO: 384393 - DNA, 540 bp, Homo sapiens
  misc_feature: GZ8MTXP01AVH2B.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagaggtcgccatctcctgcactgggtccacctccaatatcggggccgttatggtatgctctggtatcaacaacgtccaggaatcggacccccaaatcctcatctatgctgacaacaatcgaccttcgagggggtccctgaccggttctctggccctccaagtctggctcttccgcctctgccatcactgggctcgagctgacgatgaggctgattactactgtctgtcctatgacgacgacctacgagtacgttccggtttcggcgggtagggactaagcgtcgaccgtccttaagtccaacgccccgaagggcctccgcccccgtcggtccacttcctccgttccccgtaacccc

SEQ ID NO: 384394 - DNA, 529 bp, Homo sapiens
  misc_feature: GZ8MTXP01DRFOS.11.75.G09.1.454.CMB.2.raw
  modified_base (454)..(454): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagcccgccctcagtgtctgggggccccagggcagagggtcgccatctcctgcactgggtcccacctccaatagtcggggccgttatggtatgctctggtatcaacaacgtccaggaactcggacccccaaactcctcatctatgctgaacaacaactccgaccttcgacggggtcccctggtaacccgttctcgtggctccaagtctggtctcttccgcctccttgcctatcactgggctcgagctgacgatggagtctgtattactctgtctgtcctntcgcgacgaactacgacgtaccgttccggtttcggcggagggcttaggctgccgtctagttcaacgccgtaacgg

SEQ ID NO: 384395 - DNA, 519 bp, Homo sapiens
  misc_feature: GZ8MTXP01EPLW8.11.75.G09.1.454.CMB.2.raw
  modified_base (485)..(485): a, c, t, g, unknown or other
  modified_base (503)..(503): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccgttatggtatgctctggtatcaacaacgtccaggaatcggacccccaaactcctcatctatgctgacaacaatcgacctttcgacggggtccctgaccggttctcgtcgcctccaagtctggcctccttcccgccttccttggcccatcacgtgggctcgaggctgacgatgaggctgacttactactgtctgtcctatcgacgacactacagtacgtccggtttcggcggtaggactagctgaccgtcagtcncgcgagctcgccctgtcncttctcgttccctccc

SEQ ID NO: 384396 - DNA, 668 bp, Homo sapiens
  misc_feature: GZ8MTXP01A0JYW.11.75.G09.1.454.CMB.2.raw
  modified_base (265)..(265): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcacgcccgccctcagtgtcctcgggggcccccagggcaggagggtcgccatctcctgcactgggtcccacctcaatagtcggggccgttanggtatgctcgtggtataccaacaacgtccaaggaactccggacccccaaactcctcatctatgctagaacaacactccccgaccttcgacgggtccctcggtaacccgttctcgtcggtcctacccgtaacgttcgtcgggtccttcccgttccccggtcccttcccgttcgggcccctacgttccgtaccggttcggggccttccgggacggtcgttacgggacgtagtcgggggaacgtccgttaagtaactttacctacgttcgttccttacgtacctagtacgaccgtaaccgtaacctaacgttcggttacccgtttccggggtttacgggacgggttacggttacgttaacgtccgtacgtaacccgttactaacggccgtaacgccccgtaaccgg

SEQ ID NO: 384397 - DNA, 287 bp, Homo sapiens
  misc_feature: GZ8MTXP01DSDIX.11.75.G09.1.454.CMB.2.raw
  modified_base (285)..(287): a, c, t, g, unknown or other
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctgtcactctgttcccacctcctcgtatctctcgctgagcgggctggcaaggcgcatagnnn

SEQ ID NO: 384398 - DNA, 648 bp, Homo sapiens
  misc_feature: GZ8MTXP01BRBI8.11.75.G09.1.454.CMB.2.raw
  modified_base (220)..(220): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcacgcccgccctcagtcgtcgtcggggccccagggcaggagggtcnccatctcctgcacgtcgggtcccacctccaagtcggtccgggggtccgttatcggtatcgtctcgtaggtactaccaaacgaacgtacgaacggaactccggaccccctaaactcctactatctatcgactacgaacaaactaactccccgtaccttacggacgggttcccctcggtaacccgttctcgtcggtacctaccgtaacgtccgtcggtccttcccgttcccgtccttccgttcggcctacgtccgacgtcgggctcggacgtctaggacgtacgtcgggagtctagtacttacgtcttcgtctcgtctacgtacgaccgtacgtaacctacgacgggttccgttccggggtttcgggacgggttaacggttacttacggccgtacgtaacccgtcgtaaacgcgaacccgccgtaaccgg

SEQ ID NO: 384399 - DNA, 548 bp, Homo sapiens
  misc_feature: GZ8MTXP01A7B7E.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctctggtatcaacaacgtccaggaactcggacccccaaatcctcatctatgctgacaacaatcgaccttcagggtccctgaccgttctctggcctccaagtctggctcttcccgcctcctgccatcacgtgggctcgagctgacgatgaggctgattacgtatgtctgtcctatgaccgacgacctacagtaccgttccgggtttcggcgggtagggtactaagcgtcgaccgtccttaaagtccgacgttcccgaaggcctccggcccccgtcggtcccacgttccgtccgttccccgtccccg

SEQ ID NO: 384400 - DNA, 640 bp, Homo sapiens
  misc_feature: GZ8MTXP01EPEPF.11.75.G09.1.454.CMB.2.raw
  modified_base (259)..(259): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagcccgccctcagtgtctggggccccagggcagagggtcgccatctcctgcactcgggtccacctcaatagtcggggccgttanggtatgctctggtatcaacacgtccaggaactcggacccccaaactcctcatctatgctgacaacatcccgaccttcgacggggtccctgtaacccgggttctcgtcggcctacccgaagtccgtcgggccttccgttcccgtcccttcccgtttcgggccctactccgtaacgtcggggtccttccgggaggtccgtaggaccgagtcggggaggtccttggtaactttaccgtacgttggttccttcggttccctagtacgaccgaccgtaacctacgacggtaccgtttccgggttttcgggacgggttaacgggacttaacggtccgttacggtaacccgttaccgtaacgttccgaaccggttccccgtaaccggg

SEQ ID NO: 384401 - DNA, 572 bp, Homo sapiens
  misc_feature: GZ8MTXP01BVIRF.11.75.G09.1.454.CMB.2.raw
  modified_base (258)..(258): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttanggtatgctctggtatcaacaacgtccaggaactcggacccccaaactcctacatctatgctgaacaacactcccgaccttcgacgggggtccctggaacccggttctcgtcgggctccaagttcctcgggcttccttcccgcccttcccgttcggccctactcgacgtggggcctcggaggtctagacgatggggaggtctgtattactactgtctgtcctagtcgaccgacgaacctacgacgtaccgttccgggtttcgggcgggttagggcttaaggctcggaacccgtctagttccgaacgcccgaacgg

SEQ ID NO: 384402 - DNA, 708 bp, Homo sapiens
  misc_feature: GZ8MTXP01EJPID.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagaggtcgccatctctgcactggtccactcaatgtcgggccgttatggtatgctctggtatcaaacaacgtccaggaatcggacccccaaactcctcatctatgctagacaacaatcgtaccttcgacggggtccctgtacccggttctctcggtccctccgaaagtcgtcggccttcccgttcccgtcccgttacctttcgggaccctactccgtaccgtggggtccttccggacggtccttaggaccgtaagtggtaaacggggtcctttaggtaacttttaaccgttaacccgttggtttaccttcggtttacccgtttaacgtacgggttaacccgaacccgtaaccgtaaaccgtaacggttaccggtttacccggggtttttcgggaccggggtaacgggtaaccgttaaggcccgttacggaccccgttacttaaacggtcgaaccgacccgaacggttccgtcccggtaccccccgttcgggtcctaccgttccgttcccgtttcccccggtcccc

SEQ ID NO: 384403 - DNA, 523 bp, Homo sapiens
  misc_feature: GZ8MTXP01D2I5B.11.75.G09.1.454.CMB.2.raw
  modified_base (348)..(348): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctgggccccagggcagaggtcgccatctcctgcactgggtccactccaatatcggggccgttatggtatgctctggtatcaacaacgtccaggaatggacccccaactcctcatctatgctgacacaatcgactcagggtcctgacgttctctgcctcagtctgctctccgctctgccntcactgggctcgaggctgacgatgaggctgattactactgtctgtcctatgaccgacgacctacgcgtacgttccgggtttcgggcggtaggggactaagcgttggacccgttccttaagtcacgttacccgaggcctcggccccctggtcccacgttctccgttcccctaaccc

SEQ ID NO: 384404 - DNA, 579 bp, Homo sapiens
  misc_feature: GZ8MTXP01ELCV4.11.75.G09.1.454.CMB.2.raw
  modified_base (256)..(256): a, c, t, g, unknown or other
  modified_base (438)..(438): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgcctcagtgtctggggccccagggcagaggtcgccatctcctgcactcgggtccacctccaatagtcggggcgttanggtatgctctggtatcgaaacaacgtcaggaactcggacccccaaatcctcatctatgctagaacaaacactcccgaccttcgacggggtccctgtaacccggttctcgtcggtcctaccaacgtcgtcggcttccttcccgcttccttcggcctatcacgttcgggctcgacggctgacgngtggaggtctagtacttactacttgttctgtcctaagtcgaaccgcgtaacctcgacggtaccgtttccgggtttcgggaccgggttagggaccttaacgcgtacgtaacccggttacaacgttctaacgaaccccgaagg

SEQ ID NO: 384405 - DNA, 534 bp, Homo sapiens
  misc_feature: GZ8MTXP01CFK0A.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgcatctcctgcactgggtccacctccaatatcgggggccgttatggtatgctctggtatcaacaacgtccaaggatcggacccccaaactcctcatctatgctgacaacaatcgaccttcaggggtccctgaccggttctctggcctccagtctggctcttccgcctcttggccatcacgtgggctcgagctgacgatgaggctgattactactgtctgtctatcgacgacgtacctacacgtacgttccgggtttcgcgggagggtaactaagctcgaccgtcttaaagtcgacgcccgacggttctccgcccctcggtcacgttcctcgttccccgtccc

SEQ ID NO: 384406 - DNA, 540 bp, Homo sapiens
  misc_feature: GZ8MTXP01A25R8.11.75.G09.1.454.CMB.2.raw
  modified_base (287)..(287): a, c, t, g, unknown or other
  modified_base (302)..(302): a, c, t, g, unknown or other
  modified_base (329)..(329): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctctggtatcaacaacgtccaggaactcggacccccaaatcctnatctatgctgaacanaatcgacttcaggggtcctgaccgttnctggcctccagtctggctctccgcctcgtgccatcacgtgggctcgagctgacgatgagctgattactactgtctgtctagtgacgacgtactacgacgtacgtccggtttcggcgggtacgggactaaggctcggacccgtccttaaagtccgacgccccgaggttcccgtcgcccccgtcggtcctacttcgtccgttccccgtaaccc

SEQ ID NO: 384407 - DNA, 536 bp, Homo sapiens
  misc_feature: GZ8MTXP01CKORA.11.75.G09.1.454.CMB.2.raw
  modified_base (333)..(333): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctctggtatcaacaacgtccaggaatcggacccccaaactcctcatctatgctgacaacatccgaccttcgacgggtcctgaccggttcncgtgccctaccagtctggctccttccgcctctgcatcacgtggctcgagctgacgatgaggtctagtattactactgtctcgtctagtcgacgacgacctcgacgtacgttccgggtttcggcggtaggactaagcctcgaccgtcttaagtccacgccgttagcctccgccccgtcgtctaccgttcctccgttccctcccc

SEQ ID NO: 384408 - DNA, 302 bp, Homo sapiens
  misc_feature: GZ8MTXP01BJKCD.11.75.G09.1.454.CMB.2.raw
  modified_base (282)..(282): a, c, t, g, unknown or other
  modified_base (288)..(302): a, c, t, g, unknown or other
tcagcgagagataccacgaccggtgctcgatttagtatagacatcaggggtcccgtgaccggttctctggctccaagtctggctcttccgcctccttggccatcactgggctcgaggctgacgatgaggctgattactactgtctgtcctatgacgacgacctacagtactccggttttcggcggagggactaagctgacgtctaagtcagccaaggctcgcccctggtcactctcgttcccaccctcctcgtatctctcgctgacgcgggctggcaaggcncatagnnnnnnnnnnnnnnn

SEQ ID NO: 384409 - DNA, 520 bp, Homo sapiens
  misc_feature: GZ8MTXP01BV39E.11.75.G09.1.454.CMB.2.raw
  modified_base (502)..(502): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccgttatggtatgctctggtatcaacaacgtccaggaatcggcccccaaatcctcatctatgctgacaacaatcgaccttcgaggggtccctgaccggttctctggccctccagtctggctcttccgcctcttgccatcactgggctcgagctgacgatgaggctgattactactgtctgtcctatgaccgacgacctacgagtacgttccgggtttcggcggtaggactaagctgaccgtcttagtcacgcccgagcctcgcccctcggtcncttcgtcgttcccgtccc

SEQ ID NO: 384410 - DNA, 554 bp, Homo sapiens
  misc_feature: GZ8MTXP01CEGX6.11.75.G09.1.454.CMB.2.raw
  modified_base (383)..(383): a, c, t, g, unknown or other
  modified_base (396)..(396): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctctggtatcaacacgtccaggaatcggcccccaaatcctcatctatgctgacaacatcgaccttcgagggtccctgaccgttctcgtggcctccagtctggctcttccgctctgccatcacgtggctcgagctgacgangaggctgattacnctgtctgtcctagtcgaacgacgacctacgacgtacgttccggtttcggcgggtaacggacctaaaggtcctacggacccgttccttaaaggtccacgaccccgttaaggcccgtccgcccccgttggtccctaccgttcctccgttccccgtccccg

SEQ ID NO: 384411 - DNA, 575 bp, Homo sapiens
  misc_feature: GZ8MTXP01BHM1H.11.75.G09.1.454.CMB.2.raw
  modified_base (256)..(256): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctcaatactcggggccgttanggtatgctctggtatcaacaacgtccaggaactcggacccccaaactcctcatctatgctagacaacaatcccgaccttcgacggggtccctggtaacccggttctcgtgggcctccgaacgtctgggccttcttcccgccttccttggccctatcacgttgggcctcgagggtctggacgtatcgggagggtctgtacttactactgtctgtcctagtgaccgacgtaacctacgacgtaccgttcggggtttccggacgggacggggttacttagggcctagtaacccgtccctaaggttccaacgcccctaagggg

SEQ ID NO: 384412 - DNA, 548 bp, Homo sapiens
  misc_feature: GZ8MTXP01BERCE.11.75.G09.1.454.CMB.2.raw
  modified_base (420)..(420): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtggggccccaggggcagagggtcgccatctcctgcactgggtccacctccaatagtcggggccggttatggtatgctctggtatcaaacaacgtccaaggaatcggaccccccaaaactccctcaatctaatgctgaacaaacaatcgacctttcgacggggtccctgtaccggttctctcggcctccaagtctggctccttccgcctcctggcccatccacgtgggctcgaggctgacgatgaggtcngtaattactacgtgtctcgtctatgaccgaacgacctacagtacgttaccggtttcggacggtaggactaagctcgactcaagtcacgccgaggctccgcccctcgtcaccttctcgttccctaaccc

SEQ ID NO: 384413 - DNA, 657 bp, Homo sapiens
  misc_feature: GZ8MTXP01EYNF4.11.75.G09.1.454.CMB.2.raw
  modified_base (274)..(274): a, c, t, g, unknown or other
  modified_base (283)..(283): a, c, t, g, unknown or other
  modified_base (387)..(387): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcacgcccgcctcagtgtccgtcggggccccagggcaggagggtccgccatctcctgcctacgtcgggtacccacctccaagttacgtcggggtccgttanggtatgctntggtactacaacaacgtccaaggaactcggacccccaaatcctacatctatcgctagaacaaacatccccgaccgttcgacgggtccctacggtaacccgttcncgtcgcctaccgacgttcgtcggtcttccgtcccgtccttaccgttcggacctagtcgtacgtcgggtcctcggacgcgttagaccgaagtggggacggtacttagtaactttacctacgttcggttcttcggttacctagttacgacccgtaaccgtaaccctaacgttacggtccggtttaccggggtttcgggaacgggttaacggttaccgttaacgtctaccggtaacccgttaccgtagaccgaaccgttaacccgtaaccggg

SEQ ID NO: 384414 - DNA, 611 bp, Homo sapiens
  misc_feature: GZ8MTXP01C5XIO.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctctgcactgggtccacctccaatagtcgggggccgttatggtatgctctggtatcaacaacgtccaggaactcggacccccaaatcctcatctatgctagaacaacaatccgacctttcgacgggggtcccctgaccggttctcgtcggccctccaagttctcggtcctccttcccgcccttccttcggccctatccacgttggggcctcggaggctggacgagtcggaggtctagtattactacgtgtactcgttactatcggaacgaccgacctacgcgtaccgtttccgggtttcggacgggacgggtactaaggtcctcggacccgttacgttaagtccgacgaccccgttaagggccctccggaccccccgttggttcccaccgttccgttccggttccccgttcccc

SEQ ID NO: 384415 - DNA, 639 bp, Homo sapiens
  misc_feature: GZ8MTXP01CJ3C4.11.75.G09.1.454.CMB.2.raw
  modified_base (395)..(395): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcaggagggtcgccatctctgcactgggtccacctccaatagtcgggggccgttatggtatgctctggtatcaacaacgtccaggaatcggacccccaaactcctcatctatgctgacaacaatcgaccttcgacggggtccctgaccggttctctggccctccagtctggcctcttccgcctcttggccatcacgtgggctcgagctgacgntgaggtctgtacttacgtactggtcttgtccgtagtacgaccgaccgtacctacgacggtaccgtttcccggggttttcgggccgggtaagggtacccgtaaaggtccgtacggttaaccccggtccgttaaacggttacccgacgggacccccgttaaaggggttccccttcccgggtccccccccgttcggggttaccctacccgttcccgtttcccggttaacccccccgttaaccccccg

SEQ ID NO: 384416 - DNA, 566 bp, Homo sapiens
  misc_feature: GZ8MTXP01AUJ1B.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagaggtcgccatctcctgcactgggtccacctccaatagtcggggccgttatggtatgctctggtatcaacaacgtccaggaatcggcccccaaactcctcatctatgctgacaacaatcgaccttcgagggggtccctgaccggttctcgtggcctccagtctggctcttcccgcctccgttggccatcgactggggctcgaggctgacgatgaggctagatttactactgtctgtcctagtcgacgacgacctacgacgtaccgttccgggtttcggcgggtacgggacttaaaggctcggacccggttccttaaagtccgaacgccccgaaagggcctccggccccctcggttccacttcgtccgtttcccctaacccc

SEQ ID NO: 384417 - DNA, 672 bp, Homo sapiens
  misc_feature: GZ8MTXP01A6FYH.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacgagggtcctcgggcccagtctgcgctgacgcacgcccgccctcgagtcgtcgtcggggccccagggcaggagggtccgccatcctcctgctacgtcgggtcccacctacaagtacggtcggggtccgttagtggtatgtctcgtaggtactacaaacgtacgtaccgaaggaactccggaccccctaaactcctactatctatcgtactacgaacaaactactccccgtaccttcgacgggtccctcggtaacccgttctcgtcggtctaccgagttcgtcggtccttccgttcccgtcccttccgtcggaccctacgtccgtacggttcgggacttcggacgtcgtagacgtgtacggggaggtctagtacttactcgttcgtcttcgtctacgacgtaaccgacgtaacctacgttacggttaccggtttccgggtttcgggaacgggttaacggttaccgttaacggtccgttacggtaacccgttacgtaacggttacccgtaaccggaacccgtaacccgg

SEQ ID NO: 384418 - DNA, 303 bp, Homo sapiens
  misc_feature: GZ8MTXP01BIFBI.11.75.G09.1.454.CMB.2.raw
  modified_base (291)..(303): a, c, t, g, unknown or other
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagtactccggttttcggcggagggactaagctgaccgtcctaagtcagcccaaggctcgccccctcggtcactctcgttccccacctcctcgtatctctcgctgagcgggctggcaaggcgcatagnnnnnnnnnnnnn

SEQ ID NO: 384419 - DNA, 684 bp, Homo sapiens
  misc_feature: GZ8MTXP01BVLTC.11.75.G09.1.454.CMB.2.raw
  modified_base (263)..(263): a, c, t, g, unknown or other
  modified_base (506)..(506): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagcccgccctcagtgtcgtcggggccccagggcagagggtcgccatctcctgcacgtcgggtccacctcaatacgtcggggccgttanggtatgctctggtatacaacgaacgtccggaagtaccgaccccgaaccctacctcctactactactgcgtacgacaaaccaactaccgtacccccgttaccgtacggggtacccgttccgtacccggttaccgttccgtcggccgtacccgtaacgttacgtccggtcgttccttcccgtcccttcctttcggccgactcgtcgtacgggcgtcgacgggctacgacgatggcgggtacgttntacgttaaccttacgttcgtcgttcttaccgttacgtggaacccggtaaccgaacccgttaaccgtaacggttaccggtttccccggggttttcggggacggggaacgggttaacgttacgttaccgtccgtaaccccggttccgttaaacgccgacgtaaccccgttaacggtcccg

SEQ ID NO: 384420 - DNA, 553 bp, Homo sapiens
  misc_feature: GZ8MTXP01ERCK2.11.75.G09.1.454.CMB.2.raw
  modified_base (403)..(403): a, c, t, g, unknown or other
  modified_base (499)..(499): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccgttatggtatgctctggtatcaacaacgtccaggaatcggacccccaaactcctacatctatgctgacaacaatcgacttcgaggggtccctgtaccggttctcgtggccctccaagtcgtggcctccttcccgcccttccttggccctatcacgtgggctcgagctgacgntgaggctgattactactgtctgtccgtatcgacgtacgacctacacgtacgtccggtttcggcggtaggactaagctacgaccgtccgttaggtcncgcccgagggcctccgcccccgtcggtcacgttccgtccgttccccgtaacccc

SEQ ID NO: 384421 - DNA, 728 bp, Homo sapiens
  misc_feature: GZ8MTXP01AYSA9.11.75.G09.1.454.CMB.2.raw
  modified_base (219)..(219): a, c, t, g, unknown or other
  modified_base (264)..(264): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgtgctgacgcacgcccgccctcagtcgtcgtcggggccccagggcaggagggtcnccatcctcctgcactcgggtcccacctcaatacgtcgggcgttanggtatgctcgtggtactacaacaacgtccgaaggaactccggacccccaaactcctactactctatcgactagaacaaacaactcccgtaccttcgacgggtccctacggtaacccgttctcgtcggcctaccgtacgtccgtcggtccttcccgttcccgtcccgtttccgttcgggaccctaacgttccgtaaccgggttcggggtccgttaccgggacggtcccgttagggaaaccggtacggttacgggggtaacgggtacctttacggttaaacttttaaccgttaccgtttcggttccgtttaccggttacccttaaacggttacggaaccccggtaaccgtaacccgtaacgttacgggttacccgtttccggggtttacgggacgggttaacggttacgttaacgtccgtacggtaacccgtttacgaacgttccgaaccggaacccgtaaccggg

SEQ ID NO: 384422 - DNA, 689 bp, Homo sapiens
  misc_feature: GZ8MTXP01AOSH7.11.75.G09.1.454.CMB.2.raw
  modified_base (264)..(264): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtcgtcggggccccagggcaggagggtcgccatctcctgcacgtgggtcccacctcaatacgtcggggccggttanggtatgctctggtatccaaacacgtccaaggaactccggaccccctaaactccctacactctatcgctacgaacaacaactcccgtaccttcgacggggtccctacggtaacccgttcttcgtcggtaccgttaccctaacggttccgtcggtccctttccccttccccggtcccgtttacccgtttccgggaccctaacgttcccgtaaccggttcggggtccttaccggggaacggtccgtacgggtaaccggtaagttcgggggacgggtacgttacggtaactttactaccgttgttccttggtccttagtcgaaccgaccggtaacctacgaggtaccgtttccgggtttacgggacggaggttacgttaacgcgtacggtaaccgttaccgtaacgttccaacggttaacccgaaccgg

SEQ ID NO: 384423 - DNA, 705 bp, Homo sapiens
  misc_feature: GZ8MTXP01BAQP0.11.75.G09.1.454.CMB.2.raw
  modified_base (263)..(263): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcacgcccgccctcagtgtcgtcggggccccagggcaggagggtcgccatctcctgcactgggtcccacctcaatagtcggggccgttanggtatgtctctggtatacaaacaacgtccaaggaactccggaccccctaaactcctcatctatgactagaacaacaactccccgaccttcgacggggtccctcggtaacccggttctcgtcggtcctaccaacgtcgtcggtccttcccgttcccgtcccttacccgttcggccctactccgtaaccgtcggggtcctcgggacggtccgttaggaacgtacgtcgggggtaacgggtcgtttaacggtaacgttttaacctaccgttcggtttccgttacggttacccttaagttaccggaacccggtaacccgtaacccgtaacgttaccggttaaccggtttccccggggtttacgggaccggggttaacgggttaccgttaacggtcgtaccggtaacccttaccggtagttacccgaaccggttccccgtaaccggg

SEQ ID NO: 384424 - DNA, 646 bp, Homo sapiens
  misc_feature: GZ8MTXP01CE88G.11.75.G09.1.454.CMB.2.raw
  modified_base (284)..(284): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtgggccccagggcagagggtcgccatctctgcacgtggtccacctccaatagtcggggccgttatggtatgctcgtggtatcaacaacgtcaggaatcggaccccaaactccncatctatgactgaacaacaatcgtaccttcgacggggtccctgtaccggttctcgtcggtccctccgtaagtctcggtccttccgttcccgcccttccttcgggccctagtccgtacgttcggggccgtaccggtagggtcctagggaaccgtagtacggagggtaccttagtaacgtttaactacgttcggtacttcggttaccctattacggaaccgtaccggtacctacgtaccggtaccgtttccgggtttcggacgggtaggtactacgtcgtcgttacccgtcttaaagtccgacgacccgacggttccctccgtccccgtcggtctaccgttccgttccgttaaccccttccccg

SEQ ID NO: 384425 - DNA, 704 bp, Homo sapiens
  misc_feature: GZ8MTXP01EJF7J.11.75.G09.1.454.CMB.2.raw
  modified_base (524)..(524): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcacgcccgccctcagtcgtcgtcgggggcccccagggcaggacgggtccgccatctcctgcctacgtcgggtcccaccctaccaagttacggtccgggggtaccgttagtggtatgtctcgtaggtactacaaacaacgtaccgaaggtaactcccggaacccccctaaacttccctactaacttccttaatcgtacctacgaaacaaacctaactaccccgtaccctttacggaccggggttcccctacggtaacccggtttctccggtcggtaccctaccgtaacgttccgtcggtcctttcccgttcccgtccttccgttcgcctactcgtacggtcggcctacggngccgtaggacgtagtggggacgtcgtagtaacttactacgttgtttcgtcgttccctagtaccgtaccgaccgtaaccctacggttacgttacccggtttccgggtttacgggaacgggttacggttacttacgtccgtacgtaaccgtaccgtaagttccaaccggttcccgtaaccgg

SEQ ID NO: 384426 - DNA, 642 bp, Homo sapiens
  misc_feature: GZ8MTXP01EG7J4.11.75.G09.1.454.CMB.2.raw
  modified_base (279)..(279): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcacgcccgccctcagtcgtcgtcgggggccccagggcaggacgggtcgccatcctcctgcacgtcgggtcccacctcaatagtcggggtccgttatggtatgctntggtatcaacacgtccagaactccgacccccaaactcctactatctatcgctacgaaccaaacactccccgtaccttacgacggggtccctcggtaacccgttctcgtcgtcctaccgtaacgtccgtcggtccttcccttcccgtcccttccttcggccctatccgtacgtcgggtcctacggacgtcgtacgacgagtggggacgtctagtacttactcgttcgtccgttcgttacctaagtacgaccgaaccgtaacctacgttacggttacccgttttccgggttccgggacgggttaacgttacgttaacgtccgtacgtaacccgtacgtagttacccgaaccgttcccgtaaccgg

SEQ ID NO: 384427 - DNA, 625 bp, Homo sapiens
  misc_feature: GZ8MTXP01CIZ1U.11.75.G09.1.454.CMB.2.raw
  modified_base (327)..(327): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgcctcagtgtctggggccccagggcagagggtcgccatctcctgcactgggtccacctccaatatcggggcgttatggtatgctctggtatcaacacgtccaggaactcggcccccaaatcctcatctatgctgacaaacaatcgaccttcaggggtcctgaccgttcnctggcctcagtctgctcttccgctctgccatcatgggctcgagctgacgatgagctagattacgtactgtctgttccagtcgaccgacgaccttacgacgtccgttaccgggttttcggcgggtaacggggaacttaaaggccgttacgggttaaccccggtttccgttaaacggttacccgaaccggcccccggttaaaaacgggttcccgttaaccccggggtcccccccttaaccgggggtttccccgaacccttttccccgtttaacccgggttttcccccccggttccccccg

SEQ ID NO: 384428 - DNA, 552 bp, Homo sapiens
  misc_feature: GZ8MTXP01DVATK.11.75.G09.1.454.CMB.2.raw
tcagcgagagataccacgaccggtgctcgatttagtatagacatcaggggacaagaggcagcactcaggacaatctccaacatggcctggtctcctctcctcgctcactgcacagggtcctgggcccagtctgcgctgacgcagccgccctcagtgtctggggccccagggcaggaggtcgccatctcctgcactgggtccacctccaatacgtcggggtccgttatggtatgctctgtatcaacacgtccaggatcgaccccaaatcctacatctatgctagacaaacatcgaccttcgacgggtccctggtaccgttctcgtcggcttaccaagtctcggtcctccgttccgccttccgttcgacccatcgacgtgggctcgagctagacgatgaggctgtattactagtgtctgtcagtcgacgaccgactacgagtaccgttccggttcggcggagtacgtaacgctacgacctcgtagtcacgccgacgcgtcccgccccgttggttccttctccttaccgtcccctacctccttcgttcttcctcg

SEQ ID NO: 384429 - DNA, 757 bp, Homo sapiens
  misc_feature: GZ8MTXP01AKQ1T.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtcggggccccagggcaggagggtcgccatctcctgcacgtcggtccacctccaatagtcggggccgttatggtatgctctggtatcaacaacgtccaaggaactcggacccccaaactcctcatctatcgctagacaacatcgaccttcgacggggtccctggtaccggttctcgtcggtccctaccgtaagtccgtggtccttcccgtttcccgtcccttcccgtttcgggccctactccgtacgtcggggtcctcggacggtccgtaggaaccggtagtggtaacggtcgttaggtaactttacgttacgttcgttccttcgttaccgttagtacggaacccgtaaccgtaacccgttaaccgacggttaaccggtttccccgggggtttttacgggccggggtaacggggtaccttaaacgggtccgttaacgggttaccccgggtttacccgttaaacgggttacccgtaacccgggaccccgttaaacggggttccccgttaaccccggggtcccccccgttccgggggttaccccttacccgtttccccgtttccccggtttcccccccgttcccccccg

SEQ ID NO: 384430 - DNA, 516 bp, Homo sapiens
  misc_feature: GZ8MTXP01AG2WA.11.75.G09.1.454.CMB.2.raw
  modified_base (289)..(289): a, c, t, g, unknown or other
  modified_base (336)..(336): a, c, t, g, unknown or other
  modified_base (394)..(394): a, c, t, g, unknown or other
  modified_base (433)..(433): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagcccgccctcagtgtcgtcggggccccagggcaggagggtcgccatctcctgcacgtggtccacctccaatagtcggggcgttatggtatgctctggtatcaacaacgtcaggaactcggacccccaaatcctnatctatgctagaacaacatcgaccttcgacggggtccctgaccgttntcgtggccctacgagtcgtgcctcttccgctcgtgccatcacgtggctcgagctgagntgagctgaattctatgtactgtctatgacgaccgactancgtcgttccgggttgcggagactgctgacccgtcagtcagcccgagccgtcccgccctcggcctacttctccgttcccctccc

SEQ ID NO: 384431 - DNA, 598 bp, Homo sapiens
  misc_feature: GZ8MTXP01EK7S7.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagcccgccctcagtgtctcgggggccccagggcaggagggtcgccatcctcctgcacgtcgggtcccacctaccaatacgtcggggtccgttatggtatgctcgtggtatacaacaacgtcaggaactcggacccccaaactcctacatctatcgactagaacaaacactcccgaccttcgacggggtccctcggtaacccggttctcgtcggcctaccagtctcggcttccttcccgtccttccgttcgcctatcgtacgtgggatcggagtctagacgtagtaggggacgtcttagtaactttactacgttgttcttacgtttccttagtaactaagttaaacgtggtaattggtagttacgtcgggacggacggacccttacggttaaccctctaacgtcacgaccgtaacgccgtcccg

SEQ ID NO: 384432 - DNA, 287 bp, Homo sapiens
  misc_feature: GZ8MTXP01CPCMY.11.75.G09.1.454.CMB.2.raw
  modified_base (285)..(287): a, c, t, g, unknown or other
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggtttcggcggagggactaagctgaccgtcctaagtcagccaaggctcgccccctcgtcactctcgttcccacctctcgtatctctcgctgagcgggctggcaaggcgcatagnnn

SEQ ID NO: 384433 - DNA, 730 bp, Homo sapiens
  misc_feature: GZ8MTXP01D7NUK.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtggggcccccagggcagagggtcgccatctcctgcactgggtccacctccaatagtcggggccgttatggtatgctctggtatcaacaacgtcaaggaatcggacccccaaatcctcatctatgctagaacaaacaatcgtaccttcgacggggtccctgtacccggttctcgtcggtcccctaccaagtcgtcggtccttcccttcccggtcccttcccgttcgggtcccctaacttcccgaacgggttcgggggtccttacgggaacgggtcttacgggaaccgtagttgggaacgggtccttaggtaactttaacttaccgttgttaccgttcggttacccttaagtacggtaacccggaaccgtaacccgtaacgacgttacccggtttacccggggttttaccgggacggggtaaacggggtaccttaaaaggcccttaaccggttacccgttaacccggttaaagtacccgaacgttccccggaaacggttcccttcccggccccccttcgggtacctaccgttccttaacccggttccccccttaacccccg

SEQ ID NO: 384434 - DNA, 714 bp, Homo sapiens
  misc_feature: GZ8MTXP01D4PEX.11.75.G09.1.454.CMB.2.raw
  modified_base (294)..(294): a, c, t, g, unknown or other
  modified_base (333)..(333): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcaggagggtcgccatctcctgcacgtggtccacctccaatatcggggccgttatggtatgctctggtatcaaacaacgtccaggaactcggacccccaaatcctcatctangctgacaacatcgacttcgaggggtccctgaccggttcnctggccctaccaagtctcggtccttcccgttcccgccttccgttacggccctaacttccgaccgtggggccttcggaggtcctggacgagtcgaagggtcttaggtactttactacttggttacttcggttacccttaagttcgggaaacccgtaaccggtaacccttaaccgacggttaaccggttttacccggggttttcgggacggggtaacggggtaaccgttaaaggccttaccggttaacccgttacccgtttaaaggtacccgaaacggttacccccggaaagggttcccgttccccgggttcccccccgttaacggggtttcccctaacccttttcccggtttccccggtttcccccccggtttaaccccccg

SEQ ID NO: 384435 - DNA, 773 bp, Homo sapiens
  misc_feature: GZ8MTXP01DE22J.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtggggccccagggcaggagggtcgccatctcctgcactggtccacctcaatagtcggggccgttatggtatgctctggtatcaacacgtccaggactcggacccccaaatcctcatctatgctagacaacatccgacttcgacggggtccctggtacccggttctcgtcggcccctaccgtaaggttcgtcggtcccttcccgttcccggtcccttacccgtttcgggaccccctaagttccccgtaacggttcgggggtacccttccgggaacggtccgttacggaccggtaagttcgggtaaacgggtccttaggtaactttaaccgttaccgttcggttaccttcggttacccgttaagtacggtaaaccggtaacccggtaaacccttaccgtaacggttacccggtttacccgggggtttttacggggaccggggtaacggggtaaccgttaacgggtaaccgttcgggttaaccccggttaccgttaaacggttcccgaacgggttaacccccgttaacgggttccccgttaaccccggtccccccgttccgggttaccctcccgtttcccgttccccggttcccccgttcccccg

SEQ ID NO: 384436 - DNA, 673 bp, Homo sapiens
  misc_feature: GZ8MTXP01BMIEC.11.75.G09.1.454.CMB.2.raw
  modified_base (219)..(219): a, c, t, g, unknown or other
  modified_base (265)..(265): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcacgcccgcctcagtcgtcgtcggggccccagggcaggagggtcnccatctcctgcacgtcggtcccacctcaagtacgtcggggcgttanggtatgtctgtagtactcaaacacgtccgaaggaactccggaccccctaaactccctactactcctaatcgactagaacctaaacaacgttccccgtaccttacgaccggggtccctcggtaacccgtttctccgtcgtcctaccgtaagtccgtcggtccttcccgttcccgtccttccgtacggccctaacgtccgtacggtcgggtacctacgggacgtcgtacggacgtaacgtggggacggttcgtaacgtacgtttaactcgttgttccgttacgttcctagttacggacccgtaaccgtaacccgtacgttaaaccggttccggtttccgggtttacgggacgggttacggttacttacggtctacgtaaccgtacctacgttccgaaccgcccgtaaccg

SEQ ID NO: 384437 - DNA, 533 bp, Homo sapiens
  misc_feature: GZ8MTXP01A24YD.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtcccacctccaatagtcggggccggttatggtatgctctggtatcaacaacgtccaggaactcggacccccaaactcctcatctatgctgacaacatcccgaccttcgacgggtccctgtaacccgttctctggctccagtctgctctccgctctcgcatcacgtggctcgaggctgacgtagtcgggagggtccttagtactttactacgtgtctgtcctatcgacgacgaactacgcgtacgttccgggtttggcggagggcttaagctacgaaccgtctagttccaacgccgtaaccgg

SEQ ID NO: 384438 - DNA, 745 bp, Homo sapiens
  misc_feature: GZ8MTXP01DZ9YF.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagcccgccctcagtgtcgtcggggcccccagggcaggacgggtcgccatctcctgcactcggtccacctccaatcgtcggggccgttatggtatgctctggtatacaaacaacgtaccgaaggaactccggacccccaaaactcctacatctatgctagaacaaacaactcccgtaccttacgacggggtcccctacggtaacccggtttctcggtcgtaccgtacccgtaaagttccgtcgggtcctttcccttccccgtcccgtttcccgtttcgggaccctaacttacccgtaacggttcggggtaacttccgggaaggcccgttaggaaccgtacgttagggggaacgggtcttaacggtaactttaacctaccgttcggtttccttacgttaccgttaacgttaccggaaccgtaaacccggtaaccttaacgttaaccgggttaccggtttccgggggttttaaccggggaacggggttaaacgggggttaaccttaaacggtccgttaccggtaaccccgttttacgaaccgttaccgtaacccggaacccgtaaccccgggg

SEQ ID NO: 384439 - DNA, 685 bp, Homo sapiens
  misc_feature: GZ8MTXP01CSYH0.11.75.G09.1.454.CMB.2.raw
  modified_base (305)..(305): a, c, t, g, unknown or other
  modified_base (312)..(312): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtcgtcggggccccagggcaggaggtcgccatctctgcacgtggtccactcaatacgtcgggtcgttatggtatgctctggtactacaacacgtcaggactcggacccccaaactcncatctangctagaacaacaactcccgtaccttcgacggggtccctcggtaacccggttctcgtcgggcctaccgaagtcctcggtccttcccttcccgtccttcccgttcgggccctagttcccgacgttcggggtcctaccgggtaggcttcggaacgtaggttaggggacggggtacctttagggtaacctttaccgttaaccgttcgtttaccgttcgttaaccccgttaagttccgggaaaccgtaacccggtaaacccttaacgttaacggttcccggttttaccgggggttttacggcgggggttaaacgggttaccttaacgggtccttccggtaaccgttaccgtacgttccgaacggttccccgtaacggg

SEQ ID NO: 384440 - DNA, 620 bp, Homo sapiens
  misc_feature: GZ8MTXP01DI19F.11.75.G09.1.454.CMB.2.raw
  modified_base (213)..(213): a, c, t, g, unknown or other
  modified_base (324)..(324): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagcccgcctcagtgtctggggccccagggcagaggtcnccatctctgcactcgggtccacctccaagtacgtcggggccgttagtggtatgctcgtggtactacaaacaacgtccaaggaactccggacccccaaactcctctatctangctacgaacaacaactccccgaccttcgacggggtcccctggtaacccggttctcgtcgctacctaagtctggtcctcttcccgtccttccgtgccatcacgtcgggctcgagtcgtagtacgacgtggggacggtacttgaacttactacgttgtctcgttacctagtacgtaaccgacctaacctagttaaccgtaccgtttcccggggtttaccggcggggttaaacgggttaccttaaacggtccgtagttaacccgttacgtaacggttccaacggttaacccgtaaccgg

SEQ ID NO: 384441 - DNA, 675 bp, Homo sapiens
  misc_feature: GZ8MTXP01BUSIF.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcacgcccgccctcagtgtcgtcggggccccagggcaggagggtcgcctatctcctgctacgtcgggtcccacctcaatagtcggggccgttatggtatgctctggtactcaaacacgtccaaggaactccggacccccaaactcctcatctatcgactagaacaaactaactcccgaccttcgacggggtccctggtaacccgttctcgtggcctaccgaacgttcgtcgggtcttcccgttcccgccctttccgttcggccctaagtccgtacgtcgggtcctcgggacggcctagacgtagtacggggacggtcttagtaactttaccgtacgttcggttccttacggttcccttaagtccggaaaccggtaacccgtaacccttaacggttaaccggttacccggtttcccgggtttacgggaccggggttaacggttaccgttaaacgtccgtacggaacccgttaccgtagttacccgtaacgaacccgtaaccgg

SEQ ID NO: 384442 - DNA, 574 bp, Homo sapiens
  misc_feature: GZ8MTXP01D2FCD.11.75.G09.1.454.CMB.2.raw
  modified_base (329)..(329): a, c, t, g, unknown or other
  modified_base (365)..(365): a, c, t, g, unknown or other
  modified_base (543)..(543): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtggggcccccagggcagagggtcgccatctcctgcactgggtccacctccaatagtcggggccgttatggtatgctctggtatcaaacaacgtccaggatggacccccaaatcctcatcatgctgacaacaatcgacttcgagggtcctagtcgttcnctcggcctcagtctggctcctccgcctctgccatcncgtgggctcgagctgacgatgagtctgactacgtactgtactgtcctagtcgaccgacgactacgagtaccgttccggggtttcgccgggtaaggacctaagggtccttacggaccgttacccgttaaagttccgaacggaccccgttaggggccccttccgccccccgttgggtccnccgttcccttccggtttcccccgtaaccccc

SEQ ID NO: 384443 - DNA, 582 bp, Homo sapiens
  misc_feature: GZ8MTXP01CRATM.11.75.G09.1.454.CMB.2.raw
  modified_base (263)..(263): a, c, t, g, unknown or other
  modified_base (319)..(319): a, c, t, g, unknown or other
  modified_base (368)..(368): a, c, t, g, unknown or other
  modified_base (383)..(383): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagcccgccctcagtgtcgtcggggccccagggcaggagggtccgccatcctcctgcacgtcgggtccacctcaatgtcggggcgttanggtatgctcgtggtactcaacacgtccaggactcggcccccaaatcctacatctancgctagaacaacaactcccgaccttcgacggggtccctggacccgttcncgtcgctaccagtcnggtctctccgctcctggcctatcacgtgggctcggagccgtgacgtagtcgggaacggtctcgtaacttactcgtgttccttcgtacctagtcgaaccgccgaaccttaacgacggtacccggtttccgggtttaccggggcggttacgggacttacggcgtacgtaacccgtcgtaacgttcaaccggcccgtaacgg

SEQ ID NO: 384444 - DNA, 508 bp, Homo sapiens
  misc_feature: GZ8MTXP01B3NYQ.11.75.G09.1.454.CMB.2.raw
  modified_base (357)..(357): a, c, t, g, unknown or other
  modified_base (490)..(490): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccgttatggtatgctctggtatcaaacaacgtccaggaatcggaccccccaaaactcctcatctatgctgacaacaatcgaccttcaggggtcctgaccggttctctggcctccagtctgctcttccnctctgcatcactgggctcgagctgacgatgaggctgattactactgtctgtcctatgacgacgacctacagtactccggtttcggcggtaggactagctgacgtcttaagtcagcccgagctgcccctggtcncttctcgttccctaaccc

SEQ ID NO: 384445 - DNA, 678 bp, Homo sapiens
  misc_feature: GZ8MTXP01C5FQB.11.75.G09.1.454.CMB.2.raw
  modified_base (255)..(255): a, c, t, g, unknown or other
  modified_base (338)..(338): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcacgccgccctcagtgtccgtcggggcccccagggcaggagggtccgccatcctcctgcacgtcggtccacctccaatagtcggggccgttatggtatgctntgtatcaacacgcaggactcgaccccaatcctcatctatgctagacaacatccgtaccttcgacgggtccctgtaccggttcncgtcggcctccgtagtctcggtcccttcccgttcccgtcccttccgttcggaccctacgttccgacggttcggggccttccggaggtcctaggaaccgtagtagggaacggtcgttacgttaacttaccgttacgttcggttccgttcgttaccgttacgtaccggtaaacccggtaccgtaacccgttaccgtaacggttaccggtttacccgggggttttcgggacggggtaacggtaccgtaacggtccgtacggttacccggttacttaggtaccacgacccgttaggcccgtcccgtccccgtcggttccaccttccgtcccgttcccctccccg

SEQ ID NO: 384446 - DNA, 519 bp, Homo sapiens
  misc_feature: GZ8MTXP01DIHCO.11.75.G09.1.454.CMB.2.raw
  modified_base (361)..(361): a, c, t, g, unknown or other
  modified_base (500)..(500): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctctggtatcaacaacgtccaggaatggacccccaaactcctcatctatgctgacaacaatcgaccttcaggggtccctgaccgttctctgcctccaagtctgctcttcgctctgccntcactgggctcgagctgacgatgagctagattactactgtctcgtctattcgacgaacgaccctacacgtacttccgggtttcggcgggtagggactaagcgtgacccgtcaagtcagcccaggcctcgcccctggtcncttcgtcgttcccgtcccc

SEQ ID NO: 384447 - DNA, 761 bp, Homo sapiens
  misc_feature: GZ8MTXP01BSJL9.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacgagggtcctgggcccagtctgcgctgacgcacgcccgcctcgagtcgtccggtcggggccccgaggggcgaggacgggtccgcctatcctccgtgcctacgtcgggtacccacctacaagtacggtccggggtccgttagtggtatcgtctcgtaggtaactaccgaaaccgtaacgtaccgaacggtaacctacccggaacccccctaaactccctactactactaagtcgactacgaaaccaaactaacgtcccccgtaccgttacggtaccggggttccctacggttaacccggttcttcgtcggtacctaccgtaacgtccgtcggtcccttcccgttccccgtcccttccgttcgaccctacgtaccgtaccggtcgggcctacgggacggtcgtaggaccgtagtgggggtaacggtcgttacgtaactttacgtacgttcgttaccgttacgtacctaggtaccggtaaccgtaaccggtaaccttaacgttaccgggttaccggtttccggggtttacggggaccgggttaacgggttaccgttaacggtccgttaccggtaacccgttacgtaaccggttaccgtaaccggaacccggtaacccgg

SEQ ID NO: 384448 - DNA, 556 bp, Homo sapiens
  misc_feature: GZ8MTXP01CRB1D.11.75.G09.1.454.CMB.2.raw
  modified_base (217)..(217): a, c, t, g, unknown or other
  modified_base (261)..(261): a, c, t, g, unknown or other
  modified_base (392)..(392): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctcgggcccagtctgcgctgacgcagcccgccctcagtgtcgtggggccccagggcagagggtcnccatctcctgcactgggtccacctccaatagtcggggcggttanggtatgctctggtataccaaacaacgtccaggaactcggacccccaaactctcatctatgctagaacaacaactccgaccttcgaggggtccctgaaccgttctctgcctaccaagtcgtgccttctcccnctcctgcctatcacgtggctcgagctgacgatgggagtctgattactctgtctagtcctagtacgaccgaacgaacccctaattacggtaccgttccgggttttccggacgggacgggacttaacgtcacgtaaccgtcctaaggcctaacgaacccgtaacgg

SEQ ID NO: 384449 - DNA, 666 bp, Homo sapiens
  misc_feature: GZ8MTXP01AHYBB.11.75.G09.1.454.CMB.2.raw
  modified_base (385)..(385): a, c, t, g, unknown or other
  modified_base (388)..(388): a, c, t, g, unknown or other
  modified_base (390)..(390): a, c, t, g, unknown or other
  modified_base (395)..(395): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctcggggccccagggcaggagggtcgccatctcctgcacgtcggtccacctccaatagtcggggccgttatggtatgctctggtatcaacacgtccaggactcggacccccaaatcctacatctatgctagaacaacaactcgaccttcgaccgggggtccctggacccggttctcgtggcccctaccagtctggtcctcttcccgctcgtcgccntcngngggcngagctgacgatgaggtctagtacttacgttacgtcgtcgttacgtccgttagtcggaaaccgtaacccggtaacccttaacgtacggttaccccggttttacccggggggttttcggacggggttaacgggaaccttaaagggccgtaaccggttaccgttaccgttaacgttacccgacggttaccccgacgggttccccgttcccgggtccccccgtttcggggtacccctaccggtttcccgttcccggtttccccccggttcccccg

SEQ ID NO: 384450 - DNA, 538 bp, Homo sapiens
  misc_feature: GZ8MTXP01BVEQI.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactggtccacctccaatagtcggggccgttatggtatgctctggtatcaacaacgtccaaggaatcggaccccccaaatcctacatctatgctgaccaacaatcgaccttcgaggggtccctgaccgttctctggcctccagtctgctcctccgctccttgccatcactgggctcgagctgacgagtggagctagtattactacgtgtctgtcctagtcgaccgacgtacctagacggtaccgtttccgggtttcggcggtaggtactaaggctcggaccgtacttagcgacgcccgaggctccgcccctggtcacttcgtccgttcccgtccc

SEQ ID NO: 384451 - DNA, 632 bp, Homo sapiens
  misc_feature: GZ8MTXP01BTEO1.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgactcagcccgccctcagtgtcgtcggggccccagggcaggagggtcgccatctcctgcacgtggtcccacctcaatagtcggggccgttatggtatgctctggtactcaacacgtccaggaactccggaccccctaaactcctcactctatcgctagaacaactaactcccgtaccgttcgacggggtcccctgtaacccgttctcgtggtcctaccgtagtccgtcgggtccttccgtttcccgccttcccgttcggcctactcgaccgtcgggcttccggaggtctacggacgagtgggacggtctagtactttacgtacgttgttccttgttacccgtagtcggaaccgtaccgtaacctacgttacggtaccgtttccggggtttacgggacgggttacgggttacttaacgtccgtacggtaaccgtacccgtagttccgaaccgcccgtaaccgg

SEQ ID NO: 384452 - DNA, 587 bp, Homo sapiens
  misc_feature: GZ8MTXP01AB9QB.11.75.G09.1.454.CMB.2.raw
  modified_base (186)..(186): a, c, t, g, unknown or other
  modified_base (219)..(219): a, c, t, g, unknown or other
  modified_base (270)..(270): a, c, t, g, unknown or other
  modified_base (327)..(327): a, c, t, g, unknown or other
  modified_base (407)..(407): a, c, t, g, unknown or other
  modified_base (431)..(431): a, c, t, g, unknown or other
  modified_base (435)..(435): a, c, t, g, unknown or other
  modified_base (441)..(441): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagcccgccctnagtgtcgtcggggccccagggcaggagggtccnccatcctcctgccacgtcgggtcccacctcaatacgtcggggtccgttagnggtatgtctctggtactcaaacgacgtccaaggtaactcggacccccaaactcctanatctatcgctagaacaaacactcccgtaccttcgacgggtccctggtaaccgttctcgtgcctacagtctgtctcgtccnctctcgcatcgacgtggactcggngcgngtacgngaggaggtctagtacttacgtacgttgtcctcgtcctagtcgaaccgacgtaacctcggacgtaccggttccgggttacgggcggttacgggacttaagggtcctacggtaaccgtacgtacgttcctaaccggccgtaacccggg

SEQ ID NO: 384453 - DNA, 659 bp, Homo sapiens
  misc_feature: GZ8MTXP01EUELL.11.75.G09.1.454.CMB.2.raw
  modified_base (197)..(197): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcacgccgcctcagtgtcgtcggggccccagggcaggagggtccncatctcctgcacgtcggtccacctcaagtcgtcggggtcgttatggtatgctcgtggtactacaaacgaacgtcgaaggtactccggacccctaaactcctactatctatcgactagaacaactaacgtccgtacgttccggacgggttcctacggtccgtttctcgtcgtcctaccgtagtcgtcgtccttccctccgtcccgttcgtcgcctactcgacggttcgggctcgggagtctacggacgtagtcggtacgtcttagtaacttacgtacgttacgttcgttcgtacgttaagtacggaacctaccgtaaccgtacgaacggtttccggttaccggggttacgggacgggtaacggtacggtaagtccggttacgttaaccgtacgttaacgtcgaaccggaccgaccgttccgttaaccgccccgtcggtcctcgttcctcccgttccccgtccc

SEQ ID NO: 384454 - DNA, 629 bp, Homo sapiens
  misc_feature: GZ8MTXP01EWFOS.11.75.G09.1.454.CMB.2.raw
  modified_base (248)..(248): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtggggccccagggcaggagggtcgccatctcctgcacgtgggtccacctccaatagtcggggcgttatggtatgctntggtatcaacacgtcaaggaactcggacccccaaatcctcatctatgactgaacaacaatcgacttcgacggggtccctgtaccggttctcgtcggccccttacaagtcgtcggccttcccgttcccgtcccgtttccgttcgggcccctaacgttccgtaccggttggggtcccgtcgggaacggtccgtaggacgtagttcggaacggcttagtacttactacgttggttctcgttacgtagtacggacgtaccgaactacgacggtccgttccgggtttcgggcggtaacggtacgtaacgctacggttacctacgttaacgtcacggacccgacggcctccgccccgttcgtcaccgttctccgtttccccgaaccc

SEQ ID NO: 384455 - DNA, 665 bp, Homo sapiens
  misc_feature: GZ8MTXP01ELU06.11.75.G09.1.454.CMB.2.raw
  modified_base (223)..(223): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagcccgcccgtcagtcgtccgtcggggccccgagggcaggacgggtcnccatctcctgcacgtcgggtacccacctccaagtacgtcggggtccgttagtggtatgtctctaggtactacgaaacaacgtaccgaaggtaacctccggaaccccctaaactccctactatctaatgactacgaaccaacaacgtaccccgaccgttacgacggggtccctaccgtaacccggttctccgtcggtcctaccgaacgttctcggtcttcccgttcccgtccttccgtcgcctacgtcgacgtcgggtacctcgagtcgtagacgaagttcggggaacgtcgttaacgtacttacgtacgttcgttcttacgtcctaagtcgaaaccgaccgtaactacgacggttacccggttcgggtttacggacgggttacggaacgttacggtccgtacgtaaccgttacgtaggttaccgtaaccgcccggtaaccgg

SEQ ID NO: 384456 - DNA, 627 bp, Homo sapiens
  misc_feature: GZ8MTXP01DTJYA.11.75.G09.1.454.CMB.2.raw
  modified_base (336)..(336): a, c, t, g, unknown or other
  modified_base (407)..(407): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtggggcccccagggcaggagggtcgccatctcctgcactcgggtccacctccaatagtcggggccgttatggtatgctctggtatcaacaacgtcaaggaactcggacccccaaatcctcatctatgctagacaacaatcgacttcgagggtcctgtaccgttcnctcgcctccagtctcgctcctccgctcttgcctatcacgtgggctcggagtcctggacgtagtgacgggtnttagtacttaaccgtacgtcgtttactcggttaccttatcggaaccgtaaccgtaccctaacgacggttacccgtttcccgggggttttccgggaggggtaacggtacctaaaggtcctcggttacccgttaccgttaaagtcccgaacggttaccccgaagggttccctaacccgtcccccgtggttccaccgtttcccgtccgttccccctaaccccg

SEQ ID NO: 384457 - DNA, 696 bp, Homo sapiens
  misc_feature: GZ8MTXP01AOO0V.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagcccgccctcagtgtcgtcggggccccagggcaggagggtcgccatctcctgcacgtggtccacctccaatagtcgggggccgttatggtatgctctggtatcaacacgtcgaaggactcggacccccaaactcctacatctatcgactagaaccaaacaacgtccgtaccgttcgacgggggttcccctggtacccggttctcgtcggtcccctaccgaagtccgtcggtccctcccgttcccgtcccttccgttcgggaccctactccgtacgtcgggtcctcggacggtcgtaggacgtagtggacggtcgttgtaacttaaccttacgtcgttacgttcggtacctagtaccggaaccgtacccggaaccgttacgtaaccgttaccggtttcccggggtttacggggacgggtaacggggtaacctaaggtccgtacggttacccgttacgttaacgccgtaaccggcccgttaacggcccgtcccggacccccgttcggttacctccgttccttaacccgttccccctaaccccg

SEQ ID NO: 384458 - DNA, 712 bp, Homo sapiens
  misc_feature: GZ8MTXP01AMVB2.11.75.G09.1.454.CMB.2.raw
  modified_base (272)..(272): a, c, t, g, unknown or other
  modified_base (305)..(305): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcacggcccgccctcgagtgtccgtcgggggcccccagggcaggagggtcgccatcctcctgcacgtcgggtcccacctccaatagtcggggccgttanggtatgctcgtggtatcaaacacgtccaggaancggaccccctaaatcctcatctatcgactagacaaactacgtccccgtaccgttcgacggggttcccctggtaacccggttctcgtcggacctaccaacggttctcggtccttacccgttcccgtccctttcccgtcgggtccctaagtcccgtaaccggtcggggtccgtaccgggtaggtccctaggaccgtagttagggggaccggtgttacggtacgtttaaaccctttcgttccgttcgttaccgtaccgtacggtaccggtaacccgtaacccgtaaccgttaacgttaccgggttacccggtttacccggggttacgggtaaccggggttacggttaccgttacggtccggttaccgtaacccgttaccgtacgttaccgtaaccgttaacccgtaacgg

SEQ ID NO: 384459 - DNA, 625 bp, Homo sapiens
  misc_feature: GZ8MTXP01A0199.11.75.G09.1.454.CMB.2.raw
  modified_base (288)..(288): a, c, t, g, unknown or other
  modified_base (305)..(305): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagcccgccctcagtgtcgtcggggccccagggcaggagggtcgccatctcctgcacgtcggtccacctcaatagtcggggtccgttagtggtatgctctggtatcaacacgtcaggactcggaccccaactccncatctatgctagacaanaatcgacttcgacgggtcctgtaccgttctcgtcgcctccagtctcggcttcccgttcccgtccttccgttcggccctattccgacggttgggacctcggtaggtccgtagaccggtagtggaagggcttagtaacttaccgtacgtgttacttcgtcgtagtcgaaccgtaccgaccgtacgacgtaccggttccgggtttcgggcggtacggaccgtagtccgtacggttaccgtaccgttacgccgacgacccggaaggttcccgtcccgtaccccgtcggtcctacccttccggttcccgttaacccccttccccg

SEQ ID NO: 384460 - DNA, 615 bp, Homo sapiens
  misc_feature: GZ8MTXP01BPPK6.11.75.G09.1.454.CMB.2.raw
  modified_base (248)..(248): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtcggggccccagggcaggagggtcgccatctcctgcactcggtccacctccaatagtcggggcgttatggtatgctntggtactacaacacgtccaggaactccggacccccaaactcctacatctatcgctagaacaacaatccgtactcgacgggtcctcggtaccgttctcgtcggtccctaccgtagtcgtcggcttcccgttcccgccttccgtcggacctactccgtacgtcggggtctcgaggtcgtgacgtctgggagtctagtacttactacgtgttctgttcgttagacggtacctacgaacctcgacgtacgttccgggtttcgggacggtagggtactaggcgtacggttaacgtccgttaagaccgacgacccgaggttccctcccggtcccccgttcggtcctacggttcccgtccgttcccccgttccc

SEQ ID NO: 384461 - DNA, 746 bp, Homo sapiens
  misc_feature: GZ8MTXP01A0DQL.11.75.G09.1.454.CMB.2.raw
  modified_base (711)..(711): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtccgtggggccccagggcaggagggtcgccatctctgcacgtgggtccacctccaagtacgtcgggggtccgttatggtatgctcgtggtatcaacaacgtcaggaactcggaccccaactcctacatctatgctagaacaacatccgtaccttcgacggggtccctggtaccggttctcgtcggccctccgtagtcgtcggccttcccttcccgtcccttccgttcggccctactccgtacggtcggggacccttcggacggtcgtaggaacgtagttcgggtaacgggtctttacggtaactttaaccgttcgtttcggtccgtttacggttaccttaagttaccgggaaaccgttaacccgaaacccgttaacgtaaccggtttaccggtttacccgggggttttacggggaaccggggtaacggggtaaacccttaacgggtcccgttaacccgggttacccggttaaccgttaaacgggtcccgtacccgggaaccccgttacgggttccccgttccccgcccccggttcggtacccncccgtttcccgttaacccggtttccccctcccccg

SEQ ID NO: 384462 - DNA, 661 bp, Homo sapiens
  misc_feature: GZ8MTXP01CFGMO.11.75.G09.1.454.CMB.2.raw
  modified_base (224)..(224): a, c, t, g, unknown or other
  modified_base (552)..(552): a, c, t, g, unknown or other
tcagcgagagataccacgaccggtgctcgatttagtatagacatcgaggggggctctgcttcagctgtgggcacaagaggcagcactcaggacaatctccaacatggcctggtctcctctcctcctcactctcctcgctcactgcacgagggtcctgggcccagtctgcgctgacgcacgcccgcctacagtcgtcgtcggggccccagggccaggacgggtcnccctatcctcctagacctacgtcgggtcccactaccgaaagtcgtccggggacgttagtggtatgaccttcgtaggtaactacaaacgaaccgtccgaaaggaacctaccggaacccctaaacctcctaccaagttcctttaagcgacctagaaaccaaacgtaacttaccccgacgttacgacggggttccacgtaaccggttctcgtcgtcgtacctaacgtcgtcggtccttccgttcccgtccgtacttcggacacttcgacgttggctacgacggctagagagcggtagtgtagtaacttacttacgtgttcttacgtctaanacggaaccactaactaacgttcggtaccgttcggttaacgggcggttaaggttacttacggtaaccgtacgtaacccgtacgtaacgaccgtaaccgttaaccgtaacg

SEQ ID NO: 384463 - DNA, 707 bp, Homo sapiens
  misc_feature: GZ8MTXP01BIRPK.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtcggggcccccagggcaggagggtcgccatctcctgcacgtgggtccacctccaatagtcggggtcgttatggtatgctcgtggtactcaaacacgtcaaggaactcggaccccaaactccacatctatgctagaacaacaactccgtaccgttcgacgggggttccctaggtacccgttctcgtcggtccctaccgaagttccgtcggtcccttcccgttccccgtcccttaccgttccggcctacttccgacgttcggggccgttcggacggtcgtaggacggtagtaggtaacggtcgttaacgtacgtttaccgttacgttcggttacgttcgttaccgttagtcggaaccgtaccgtaccgtaacgtcggttaccggttaccggggttttcgggacggggtaacggtaaccgtacggtccgtacggttacccggttaccgttaaacggtccgtaacggaccccgttaggttcccgtaacccggtcccccgtaacgtcccgtaccgttcccgttccgtttcccccgtccccg

SEQ ID NO: 384464 - DNA, 565 bp, Homo sapiens
  misc_feature: GZ8MTXP01BPZNJ.11.75.G09.1.454.CMB.2.raw
  modified_base (538)..(538): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcgggggccggttatggtatgctctggtatcaacaacgtccaggaatcggacccccaaactcctcatctatgctgacaacaatcgaccttcgagggtccctgaccgttctctggcctccagtctgctcttcccgcctcctggccatcactgggctcgagctgacgatggacggtctgtactttattacctgtactacgttcctttgaacctattaaaccgtggtattggtaggttagttcgggacgggacgggacccctaggtaacccgtcgttagggtcacgcccgaagttcccgttcgaccccccgtggtacncctcgtcgttccccgcccgttcgtccg

SEQ ID NO: 384465 - DNA, 763 bp, Homo sapiens
  misc_feature: GZ8MTXP01EZ6AZ.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtcggggcccccagggcaggagggtcgccatcctcctgcacgtgggtccacctccaatagtcgggggtccggttatggtatgctcgtggtactacaaacgaacgtccgaaggaactccggacccccctaaaactccctcaattctatcggactagaaaccaaacaaacttccgtaccgttccgacggggtccctggtaccgttctcgtcggtccctaccgagtctcggtccttcccgttcccgtcccttccttcgggccctacgtccgtacgtcggggctcggagctagacgtagtgacggtctaggtacttactacgttcgtctcgttaccggtatacggtaaccgaaccgtaaaccgttaccgtaacggtttaaccggtttccccgggggttttacggggaccgggggtaaacggggtaaacccgtttaaacggggcccgtttaccggggttaaaccccggttacccgttaaaaccggacccgttaaaccccgggaaccccggttaaacgggttccccgggttcccgtcccccccggttaacgggttcccctacccgtttcccgttccccggtttcccccgttccccccgg

SEQ ID NO: 384466 - DNA, 707 bp, Homo sapiens
  misc_feature: GZ8MTXP01CIJ6T.11.75.G09.1.454.CMB.2.raw
  modified_base (166)..(166): a, c, t, g, unknown or other
  modified_base (292)..(292): a, c, t, g, unknown or other
  modified_base (299)..(299): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcacgcccgccctnagtgtcgtcggggccccagggcaggagggtcgccatctcctgcacgtcggtcccacctaccaagtacgtcgggggccgttagtggtatcgctgtggtatacaacacgcagactcgaccccaatccnatcatcnctagaacaacatccgtaccgttcggacggtcctacggtaccgttctcgtcggtccctaccgagttccgtcggtccttacccgttcccgtcccgttccgttcggccctacgtccggtacggttcgggggcccttacgggacggtaccgttagggaaccggtaggtacggaacggttaccgttaggttaaacctttacgtacgttcgttccgttacgttaccgttacgtaacggaacccgtaaccgtaaccttacgaccgttaccggtttaccccggggtttagggaccgggtacggaacgttacggccgttacggacccgtttacgaacggtaccgccgttaacccggacggttcccgtcccggtccccgttcggaccctacgttcccttaaccgttaacccccgtccc

SEQ ID NO: 384467 - DNA, 776 bp, Homo sapiens
  misc_feature: GZ8MTXP01CXNMG.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtggggccccagggcaggagggtcgccatctctgcacgtcgggtccacctaccaatagtcggggtccgttatggtatgctcgtggtatacaactacgtccgaggaactcggaccccctaaactcctacatctatgtctagaacctaacgtaactcgtaccttcgtacggggtcccttaggtacccgtttctcgtcggtccctaccgaaggttcctacggtcctttcccgttcccgtccccgttaccgttcgggaccctacgttccgaacgtcggggtccgtacggacggtccgtaggaccgtaggtacggaacgggtccgttacggtaactttactacgttcgtccgttcgttaccgtacggttacggaaaccgaaccgtaacccgtaaccggtaacgttacccggtttacccggggtttaacggggaccggggtaaacggggtaaccgtttaaacgggcccgttaacgggttaaaccccgtttaccgttaaacggttaacccgaaccgggttaccccgaaacgggttccccgttaacccgggtcccccccgttgggtaaccccttaccgtttacccgtttccccggttcccccctttaaccccgg

SEQ ID NO: 384468 - DNA, 655 bp, Homo sapiens
  misc_feature: GZ8MTXP01C0CHC.11.75.G09.1.454.CMB.2.raw
  modified_base (285)..(285): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcacgcccgcctcagtcgtcgtcggggccccagggcaggacgggtccgccatcctcctgcacgtcgggtcccacctcaatacgtcggggccgttagtggtatgctctggtanacaacacgtcgaggactccggacccccaaactcctacatctatcgctacgaacaacactcccgtaccttcgacgggtccctcggtaacccggttctcgtcgtacctacccgtagtcctggtccttcccgttccccgtccttccgttcgcctacttctacggtcggccgtcggacggtctaggacgtagtcggggaacgtcgttaacgtatttaccgtcgttcgtccgttacgttcctaagttacggaaccgtaaccgtaacccttaacggacggttacccggtttccggggtttacgggaacggggttaacggttacgttacggtcgtaccgtaaccggttactacggttaccgaaccgcccgtaaccgg

SEQ ID NO: 384469 - DNA, 757 bp, Homo sapiens
  misc_feature: GZ8MTXP01AC03Z.11.75.G09.1.454.CMB.2.raw
  modified_base (230)..(230): a, c, t, g, unknown or other
tcagcgagagataccacgaccggtgctcgatttagtatagacatcagggggggctctgcttcagctgtgggcacaagaggcagcactcaggacaatctccaacatggcctggtctcctctcctcctcactctcctcgctcactgcacgacgggtcctgggcccagtctgcgctgacgcacgcccgcctgagtcgtccggtcggggccccgagggcgagggtacgggtccncctactcctcctcgacctacgttccgggtacccacccgtactaacgtacggtccggggtaccgtttagtggtactgtcctgtaggtacacaacgtacgtccgaagtaccgtcccgacccctaaactccgtactattcctagtcgtacctaagaaacaacgtacgtacccccgttacgtcggtaccgggttccctacggtaacccttcgttccgtcgtaccgtacgtacgtcgtacggtccttacccgtccctccgtcgttacgcctacgtcgtacggtcgggcctaggcggtacttacggacgtacggttagggggacttacggtttacgttaacgtttacccgtagtttccgtaccgtttaaccgttacgtaacggttacccggaccgaaacccgtttaacgaccgttacggggtttccccggtttaccgggggtttacggggaacgggttaccgggacctttaacgggcccttaggtaacccccgttaagaccggttacccggaaccgttccggtaacccccggg

SEQ ID NO: 384470 - DNA, 805 bp, Homo sapiens
  misc_feature: GZ8MTXP01BQ5IR.11.75.G09.1.454.CMB.2.raw
  modified_base (270)..(270): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacgagggtcctgggcccagtctgcgctgacgcacgcccgccctcgagtcgtcgtcgggggccccagggcaggaggtccgcctatcctctgctacgtcgggtcccacctcaatcggtcgggcgttanggtatgctcgtggtactacaaacacgtaccgaaggaactccggaccccctaaactccctactactcttatcgacctacgaacaaactaacgtcccgtaccgttcggaacgggtcccctacggtaaacccgtttcctcgtccggtaccgtacccgtaacgttccgtacgggtcccttcccgtttccccgtacccctttcccggtttaccgggaccttaaccgttacccgtaaccgggttcgggggtccttaccggggaacggtaccgtaacgggtaacccggttaaggttacggggggtaaacggttcggttaaccgttaaaccgtttaaccttccgttacgttaccgtttaccgttaccgttaacggtacggtaacccggtaaacccgttaacccttaacggttaccgggtttacccggtttacccgggggtttaccggggacggggttaaaccggggttacttaaaccggttcgttacccggtaaccggttaccgtaacggttacccgtaacccgggttaaccccgtaaccggg

SEQ ID NO: 384471 - DNA, 725 bp, Homo sapiens
  misc_feature: GZ8MTXP01CI4G5.11.75.G09.1.454.CMB.2.raw
tcagcgagagataccacgaccggtgctcgatttagtatagacatcagggggacaagaggcagcactcaggacaatctccaacatggcctggtctcctctcctcctcactctcctcgctcactgcacagggtcctgggcccagtctgcgctgacgcagccgccctcagtgtcgtcggggccccagggcaggagggtcgccatctctgcactggtccacctccaatgtcggggcgttatggtatgctctggtatacaacaacgtccaaggaactcggacccccaaactccctcatctatgctagacaacatcgaccttcgacgggtcctcgaccgttctcgtcggcctccaagtcgtcgccttccgttcccgtccctccgtttagggccctaacgtccacggttcggggcccttcggaacgggtccgttaggaccgtaacgtgggacgggtaccgttagtaactttaacgtactttcggttcttacgttaccgtttagtacggtaacccggtaaccctaacccgtaaaccgtacgggttaacccgtttaccccgggggttttcggggaaccgggtaggggtaaccgtaaacggccgttaaccggttaacccgggttacccgttaaagttacccgaccggttaccccgaacggggttccccttcccgggcccccccttcggggtaccctaccggttacccctttccccggtttcccccttaacccccg

SEQ ID NO: 384472 - DNA, 577 bp, Homo sapiens
  misc_feature: GZ8MTXP01CKBFU.11.75.G09.1.454.CMB.2.raw
  modified_base (407)..(407): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtcggggccccagggcaggagggtcgccatctctgcactcgggtccacctccaatagtcggggccggttatggtatgctcgtggtatcaaacaacgtccaaggaatcggacccccaaactcctcatctatgctagacaacaatcgaccttcgacggggtccctgtaccgttctcgtgccctcagtcgtggccttccttcccgcctccttacggccctatccgacgttcgggcttcgnggctaggacgagtggaggtctaggtattactacttgtcttgtcctagtcggaaccacgtacctacgacgtccgttccggggtttcgacgggtacggtactaagcgtacgaccgtacttaacgtcacgccgaggcctccgcccctcgcacgttcctccgttccctaacccg

SEQ ID NO: 384473 - DNA, 683 bp, Homo sapiens
  misc_feature: GZ8MTXP01BY7FY.11.75.G09.1.454.CMB.2.raw
tcagcgagagataccacgaccggtgctcgatttagtatagacatcagggggggctctgcttcagctgtgggcacaagaggcagcactcaggacaatctccaacatggcctggtctcctctcctcctcactctcctcgctcactgcacagggtcctgggcccagtctgcgctgacgcagcccgcctcagtgtcgtcggggcccccagggcaggagggtcgccatctcctgcacgtcgggtcccacctcaatcgtcggggccgttagtggtatgctcgtggtactacaacacgtacgagactccggaccccctaaatcctactactcctaatcgacttagaactaaactacgtccccgtacccttacggaccggggttccctcggtaacccggttctcggtcgtctaccctacggtcttcgggcctttccttcccgtcgttacccgttagggccctaacgttccgtacgtcggggtactcgggaggtcgtacgacgagttaggggacggtgttacgtaaccgtttactacgttcgtttacgttacgtccgtaagtaccggaaccgtaccgtaaccctaaacgttcggttacccgtttccggggtttaggggacccgggttaagggaccttaaggtcccgttaccgaacccggttactaacggttccaaccgttcccgaacccggg

SEQ ID NO: 384474 - DNA, 566 bp, Homo sapiens
  misc_feature: GZ8MTXP01CQWDV.11.75.G09.1.454.CMB.2.raw
  modified_base (220)..(220): a, c, t, g, unknown or other
  modified_base (262)..(262): a, c, t, g, unknown or other
  modified_base (323)..(323): a, c, t, g, unknown or other
  modified_base (390)..(390): a, c, t, g, unknown or other
  modified_base (460)..(460): a, c, t, g, unknown or other
  modified_base (468)..(468): a, c, t, g, unknown or other
tcagcgagagataccacgaccggtgctcgatttagtatagacatcaggggggctctgcttcagctgtgggcacaagaggcagcactcaggacaatctccaacatggcctggtcctcctctcctcctcactctcctcgctcactgcacagggtcctgggcccagtctgcgctgacgcagcccgccctcagtgtccgtggggccccagggcaggacgggtcnccatctctgcactgggtccacctcaatagtcggggacgttanggtatgctctggtaatcaaacaacgtccaggaactcggacccccaaaatcctacattcaancgctagaacaaacaagtccccgaccttgacggggtccctggaaccgttctctcggctaccctagtcncgtctcttccgtcctctgcatcatcggctcggagcctagacgatcggggagctgacttacgtactcgttntacgtctnacgaacgaccgtaactaacgttcgttaccgttccgggtttacggcggaaggttcttaaacgtctacgtaacctacgtaacgttcgaaccgccgaacgg

SEQ ID NO: 384475 - DNA, 286 bp, Homo sapiens
  misc_feature: GZ8MTXP02HVTI6.11.75.G09.1.454.CMB.2.raw
  modified_base (286)..(286): a, c, t, g, unknown or other
tcagcgagagataccacgaccggtgctcgatttagtatagacatcagggtccctgaccggttctctggctccaagtctggctcttccgcctccttggccatcactgggctcgaggctgacgatgaggctgattactactgtctgtcctatgacgacgacctacagactccggtttcggcggagggactaagctgaccgtcctaagtcagcccaaggctgccccctcggtcactctgttcccaccctcctcgtatctctcgctgagcgggctggcaaggcgcatagn

SEQ ID NO: 384476 - DNA, 289 bp, Homo sapiens; identical to SEQ ID NO: 186182
  misc_feature: GZ8MTXP02JB9U5.11.75.G09.1.454.CMB.2.raw
  modified_base (288)..(289): a, c, t, g, unknown or other

SEQ ID NO: 384477 - DNA, 505 bp, Homo sapiens
  misc_feature: GZ8MTXP02GPF6Y.11.75.G09.1.454.CMB.2.raw
tcagcgagagataccacgaccggtgctcgatttagtatagacatcaggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatcggacccccaaactcctcatctatgctgacaacaatccgaccttcaggggtccctgaccggttctctgctccaagtctgctcttccgctcctgcatcactggctcgagctgacgatgaggctgattactactgtctgtcctatcgacgacgacctacagtacctccggtttcggcggtaggacctaagcgtacgaccgtcctaagtcacgcccaagg

SEQ ID NO: 384478 - DNA, 532 bp, Homo sapiens
  misc_feature: GZ8MTXP02IJVQ0.11.75.G09.1.454.CMB.2.raw
  modified_base (327)..(327): a, c, t, g, unknown or other
  modified_base (380)..(380): a, c, t, g, unknown or other
  modified_base (388)..(388): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggcccccagggcaggagggtcgccatctcctgcactgggtccacctccaatagtcggggccggttatggtatgctctggtatcaaacacgtccaggaatcggacccccaaatcctcatctatgctgaacaacatcgacctttcgaggggtcccngaccgttctctggcctccagtctgctcttccgctctggccatcatgggctcgngctgacgntgagctgattactactgtctgtcctatcgacgacgaccctagacgtacgttccgggtttcggacggtagggactaaggtctaggaccgtctaagcacgacccaaggcctcgccccctcggtccacgtccttcggtcccctcccg

SEQ ID NO: 384479 - DNA, 512 bp, Homo sapiens
  misc_feature: GZ8MTXP02HI8WZ.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagaggtcgccatctcctgcactggtccacctcaatatcgggccggttatggtatgctctggtatcaacaacgtccaggaatcggacccccaaatcctcatctatgctgacaacaatcccgaccttcgacggggtccctgacccggttctctggctccaagtctggctctccgcctccttgccatcacgtggctcgagctgacgatgaggtctgattacactgtctgtcctagtcgacgacgtacctacagtacgttccggtttcggcggtacggactaagcgtcgaccgtcaagtcacgtacccaagg

SEQ ID NO: 384480 - DNA, 594 bp, Homo sapiens
  misc_feature: GZ8MTXP02JP22G.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccgttatggtatgctctggtatcaacaacgtccaggaatcggcccccaaatcctcatctatgctgacaacaatcgaccttcgaggggtccctgaccgttctcgtggccctccaagtctggctcttccgcctccttgccatcacgtgggctcgagctgacgatgagctgattactactgtctgtcctatgacgacgacctacgacgtacgttccgggtttcggacgggtacgggtactaacggtcgtacggacccgttaccgtaaacggtccgaacggtacccccgaaagggtccctcccggtccccccccgttacggggttccctaacccgtttcccgtttacccggtttcccccctaacccccg

SEQ ID NO: 384481 - DNA, 574 bp, Homo sapiens
  misc_feature: GZ8MTXP02HWFRO.11.75.G09.1.454.CMB.2.raw
  modified_base (360)..(360): a, c, t, g, unknown or other
  modified_base (374)..(374): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtcccacctccaatagtcggggccgttatggtatgctctggtatcaacaacgtccaaggaactcggacccccaaatcctcatctatgctagaacaacaatccgacctttcgagggtccctgtacccggttntctggctccagtcngctctccgctcctgccatcacgtgggatcgaggctagacgagtggaggtctaggtactttacctacgtgttcttgttcctttagaccttaaagtttaaaacgtggaagtttggtaggttagttcggggacgggtaacgggtaccccaacggttaaacccgtccgttaaaaggtccacggacccccaagggtccctcccgg

SEQ ID NO: 384482 - DNA, 289 bp, Homo sapiens
  misc_feature: GZ8MTXP02IJO3L.11.75.G09.1.454.CMB.2.raw
  modified_base (288)..(289): a, c, t, g, unknown or other
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttccccgcctcctcgtatctctcgctgagcgggctggcaaggcgcatagnn

SEQ ID NO: 384483 - DNA, 536 bp, Homo sapiens
  misc_feature: GZ8MTXP02G5MNX.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctctggtatcaacaacgtccaggaatcggacccccaaatcctcatctatgctgacaacatcccgaccttcgaggggtccctgaccggttctcgtggctccagtctgctctccgctctgccatcatggctcgagctgacgatgaggctagattacatgtctgtcctatgacgacgtacctacgagtaccgttccggggtttacggcgggtaacggggtaccttaaaggccgttacggaaccccgttcgtaaacggtccaacggaccccaaaggg

SEQ ID NO: 384484 - DNA, 532 bp, Homo sapiens
  misc_feature: GZ8MTXP02FG6BG.11.75.G09.1.454.CMB.2.raw
  modified_base (327)..(327): a, c, t, g, unknown or other
tcagcgagagataccacgaccggtgctcgatttagtatagacatcagggacaagaggcagcactcaggacaatctccaacatggcctggtctcctctcctcctcactctcctcgctcactgcacagggtcctgggcccagtctgcgctgacgcagccgccctcagtgtctggggccccaggcagaggtcgccatctcctgcactgggtccacctccaatatcggggccggttatggtatgctctggtatcaaacaacgtccagggaatcggcccccaaactcctcatctatgctgacaacaatcgacctcaggggtccctgaccgtntctggcctccagctggctcttccgcctcctgccatcactggcgtcgaggcgtgacgatgaggctgattactactcgtctgtcctactgacgaccgacctaccacgactccggtttcggtcggagggacgtaacgactcgaccgtacctaacgtacacgacccgaacgacgcgcccccgtccggtccctacctcctcgtccctccc

SEQ ID NO: 384485 - DNA, 505 bp, Homo sapiens
  misc_feature: GZ8MTXP02GS72E.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccgttatggtatgctctggtatcaacaacgtccaggaatcggcccccaaactcctcatctatgctgacaacaatcgaccttcaggggtccctgaccgttctctggcctccaagtctgctcttcgcctctgcatcactggctcgagctgacgatgagctgattactactgtctgtcctatgacgacgacctacagtaccttccggtttcggcggagggactaagctcgacgtcctaagtcacgcccaagctcgccccctgtcactctcgtcccaccc

SEQ ID NO: 384486 - DNA, 524 bp, Homo sapiens
  misc_feature: GZ8MTXP02GOMGV.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtcccacctccaatatcggggccgttatggtatgctctggtatcaacaacgtccaggaatcggcccccaaactcctcatctatgctgacaacaatcccgaccttcgacgggtccctgaccggttctctggctccagtctgctcttccgctcctgccatcactgggctcgagctgacgatgaggtctagattactactgtctgtcctatgacgacgtacctacacgtaccttccgggtttcggcgggtacggactaagccgtcgaacccgttcgtaaagtccacggaccctaacgg

SEQ ID NO: 384487 - DNA, 529 bp, Homo sapiens
  misc_feature: GZ8MTXP02JT6KK.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccgttatggtatgctctggtatcaacaacgtccaggaactcggcccccaaatcctcatctatgctgacaacatccgaccttcgacggggtccctgaccggttctcgtggctccagtctgctctccgcctcttgccatcactgggctcgagctgacgagtgaggctgattactactgtctgtcctagtgacgacgtacctacgagtaccgttccgggtttcggacggtacgggtacctaagccgtacggtacccgttacgtaacgtccacgacccgaacgg

SEQ ID NO: 384488 - DNA, 530 bp, Homo sapiens
  misc_feature: GZ8MTXP02GDD3B.11.75.G09.1.454.CMB.2.raw
  modified_base (424)..(424): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgcctcagtgtctggggccccagggcagagggtcgccatctcctgcactgggtccacctccaatagtcggggccgttatggtatgctctggtatcaacacgtccaggaatcggacccccaaatcctcatctatgctgaacaaacaatcccgaccttcgacggggtcccctggacccggttctcgtggcctccagtctggctcttcccgccttccttggccctatccacgtgggctcgaggctgacgntggaggtctgattactactgtctgtcctatgacgacgacctacgacgtccgttaccgggttggacggagggactaagcgtcgaccgtctaagtcaacgcccgtaag

SEQ ID NO: 384489 - DNA, 543 bp, Homo sapiens
  misc_feature: GZ8MTXP02GYQGO.11.75.G09.1.454.CMB.2.raw
  modified_base (358)..(358): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccacggcagagggtcgccatctcctgcactgggtccacctccaatatcggggccgttatggtatgctctggtatcaacaacgtccaggaatcggcccccaaaactcctcatctatgctagacaacaatcccgaccttcgacggggtccctggacccggttntcgtggctccaagtctggctcttccgctccttgccatcactggctcgagctgacgatgaggctgattactactgtctcgtcctatgacgacgacctacagtaccgttaccgggtttcggacgggtacggaccttaaaggccgttacggacccgttaccgtaaaggtccaacggacccctaacggg

SEQ ID NO: 384490 - DNA, 527 bp, Homo sapiens
  misc_feature: GZ8MTXP02IAU08.11.75.G09.1.454.CMB.2.raw
  modified_base (328)..(328): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccaggcagagggtcgccatctcctgcactgggtccacctccaatatcggggccggttatggtatgctctggtatcaacaacgtccaggaatcggcccccaaactcctcatctatgctgacaacaatcgaccttcagggtcctgaccggttntctggcctccaagtctggctcttcgcctcttgccatcactggctcgagctgacgatgagctgtatactactgtctgtcctatgacgacgacctacagacgtccggttttcggcggtagggactaaagcgtacgaccgtacctaagtcacgcccaaaggcctcgccccctcggtccaccttcctcgttacccctaccccc

SEQ ID NO: 384491 - DNA, 595 bp, Homo sapiens
  misc_feature: GZ8MTXP02JKAJW.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtggggccccagggcaggagggtcgccatctcctgcacgtgggtccacctccaatagtcggggccgttatggtatgctctggtatcaacacgtccaggatcggacccccaaatcctcatctatgctagacaacaatcgtaccttcgacggggtccctggaccggttctcgtcgccctcaagtctggctctccgcctccgtgcctatcacgtcgggctcgagtctgacgtatgagctagtacttactactgtctgtcctagtcgacgacgtacctactacgtacgttccgggtttcggacggtacgggactaacgtcctacggtacccgttaccgtaaacgtccgaacggaccccgtaacggtcccgtaacccgtaccccccggtccgggtaccctaccgtttccgttaccgtttaccctcccccg

SEQ ID NO: 384492 - DNA, 570 bp, Homo sapiens
  misc_feature: GZ8MTXP02JY09R.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagaggtcgccatctcctgcactgggtccacctccaatatcggggccgttatggtatgctctggtatcaacacgtccaggaatggcccccaaatcctcatctatgctgacaacaatcgaccttcgaggggtccctggaccgttctctggcctccaagtctggctcttccgcctcctggccatcactggctcgagctgacgatgaggctgattactactgtctgtcctagtgacgacgacctacacgtacgttccgggtttcggcggtagggtactaaggtccgtacggacccgttcccgttaaaggtccgaacggcccccgtaaagggtccctccggcccccccgttgggtaccctaccgttccgttccggttcccccgttcccccg

SEQ ID NO: 384493 - DNA, 289 bp, Homo sapiens
  misc_feature: GZ8MTXP02G98RT.11.75.G09.1.454.CMB.2.raw
  modified_base (287)..(289): a, c, t, g, unknown or other
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcacgaccaggctcgcccctcgtcactctcgtcccaccctcctcgtactctctcgctgagcggctggcaaggcgcatagnnn

SEQ ID NO: 384494 - DNA, 539 bp, Homo sapiens
  misc_feature: GZ8MTXP02GCWQY.11.75.G09.1.454.CMB.2.raw
  modified_base (409)..(409): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctctggtatcaacacgtccaggaatcggacccccaaatcctcatctatgctgacaacaatcccgaccttcgaggggtccctgacccggttctcgtggctccagtctggctcttccgcctcctgccatcactggctcgagctgacgntgaggctgatttacacgtgtcttgtcctatacgacgacgtacctacgacgtactttccggggtttcggacgggtaagggtcctaaaggccttcggaacccgttactaacgtccaacgcccccgtaaaggg

SEQ ID NO: 384495 - DNA, 510 bp, Homo sapiens
  misc_feature: GZ8MTXP02G336G.11.75.G09.1.454.CMB.2.raw
  modified_base (408)..(408): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctctggtatcaacaacgtccaggaactcggcccccaaaactcctcatctatgctgacaacaatccgaccttcacggggtccctgaccggttctcgtgctccaagtctggctctccgcctctgccatcactggctcgagctgacgntgaggtctgattactactgtctgtcctatgacgacgtacctacagtaccttccggtttcggcggaacgggactaagctgaccgtctaagtcacgcccaacgg

SEQ ID NO: 384496 - DNA, 569 bp, Homo sapiens
  misc_feature: GZ8MTXP02FSGZB.11.75.G09.1.454.CMB.2.raw
  modified_base (334)..(334): a, c, t, g, unknown or other
  modified_base (358)..(358): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccggttatggtatgctctggtatcaacacgtcaggaatcggacccccaaactcctcatctatgctagacaacaatccgaccttcgacgggtccctgaccgttcncgtggccctcagtctgctcttccncctctgccatcacgtgggctcgagctgacgatgagctagtattactactgtctcgtcctagtcgacgaccgactacgacgtaccgttccgggtttcggacgggtaggactaaggcgtacggtaccgttaccgtaaagtccgacgaaccccgaaggtccctcccgtcccccgttcggtaccctaccgttccgttcccgttcccccgtccccc

SEQ ID NO: 384497 - DNA, 489 bp, Homo sapiens
  misc_feature: GZ8MTXP02FL1CB.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccactccaatatcggggccgttatggtatgctctggtatcaacaacgtccaggaatggcccccaaaatcctcatctatgctgacaacaatccgaccttcaggggtccctgaccggttctctggctccaagtctgctcttcgctcctgccatcactggctcgagctgacgatgaggctgattacactgtctgtcctatgacgacgactacagactcggtttcgcggtaggctaagctgacgtcctaagtcagcccaagg

SEQ ID NO: 384498 - DNA, 540 bp, Homo sapiens
  misc_feature: GZ8MTXP02HII66.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagaggtcgccatctcctgcactgggtccacctcaatatcggggccgttatggtatgctctggtatcaacaacgtccaggaatcggcccccaaaactcctcatctatgctgacaacaatcccgaccttcacggggtccctgacccggttctctggctccaagtctgctctccgcttcctgccatcactgggctcgagctgacgatgagtctgtattacctatgtcttcgtcctatgacgaacgtacctacacgtaaccgttccgggtttacgggacggtacgggaaccttaaggcctacggaccccgttactaaacgtccgaacggtaccccaacgg

SEQ ID NO: 384499 - DNA, 526 bp, Homo sapiens
  misc_feature: GZ8MTXP02IOKPR.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccgttatggtatgctctggtatcaacacgtccaggaatcggacccccaaatcctcatctatgctgacaaacatcccgaccttcgacggggtccctgtacccggttctcgtgctccagtctgctctccgctctgcatcactggctcgagctgacgatgaggtctgtattactactgtctgtcctagtcgacgacgtacctacagtaccttccgggtttcggacgggtacggtactaagccgttacggacccgttcctaaagtccgacgacccgaacgg

SEQ ID NO: 384500 - DNA, 288 bp, Homo sapiens
  misc_feature: GZ8MTXP02HDLRR.11.75.G09.1.454.CMB.2.raw
  modified_base (288)..(288): a, c, t, g, unknown or other
tcagcgagagataccacgaccggtgctcgatttagtatagacatcagggttccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttcccaccctcctcgtatctctcgctgagcgggctggcaaggcgcatagn

SEQ ID NO: 384501 - DNA, 586 bp, Homo sapiens
  misc_feature: GZ8MTXP02H9PTP.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctcggggccccagggcaggagggtcgccatctcctgcactcgggtccacctccaatacgtcggggccgttatggtatgctctggtatcaacaacgtccaggaactcggacccccaaatcctcatctatgctagacaaacaatcccgaccttcgacggggtccctgaccggttctcgtcggctcctaagtctcggcttctcccgcctccgttcgccatccacgtggctcggacgctgacgagtggaggtctagtacttactacgtgtcttcgtccgtattcgaaccgacgtaaccctacgacggtaccgtttcccggggtttacgggacggggtaacgggtaacctaaacggccgtacggaacccgttactaaaacggtccaacggaccccgaacggg

SEQ ID NO: 384502 - DNA, 561 bp, Homo sapiens
  misc_feature: GZ8MTXP02JBE06.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcaggagggtcgccatctcctgcactgggtcccacctccaatagtcggggccgttatggtatgctctggtatcaacacgtccaggaactcggacccccaaatcctcatctatgctgacaacatccgactcgagggtccctgaccggttctcgtcgctccagtctggctcttccgccttctgcatcactggctcgagctgacgatgaggtctaggtattacctagtcgtctcgttactagtcggacgtaacgtaacctacgacggtaccgtttcccggggttttacggggacggtaaacggggtacctaaacggtcgttaccggaccttaccgtaacggtaccaccggacccgaaccggg

SEQ ID NO: 384503 - DNA, 554 bp, Homo sapiens
  misc_feature: GZ8MTXP02GYU5X.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctctggtatcaacaacgtccaggaatcggacccccaaatcctcatctatgctgacaacatcgaccttcgacggggtccctgaccggttctcgtggccctccaagtctggctcttccgcctcctggcctatcactgggctcgagctgacgatgagctgtattactactgtctgtcctatcgacgacgacctacagtaccgttcgggtttacggcgggtaggtactaacgcgtacgacccgttctaaaggtccacgacccgaaggcctaaccgtccccccgtggtccaccgttcctccgttacccctaccccg

SEQ ID NO: 384504 - DNA, 509 bp, Homo sapiens
  misc_feature: GZ8MTXP02IT7YO.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctctggtatcaacaacgtccaggaactcggacccccaaatcctcatctatgctagacaaacatccgaccttcgacggggtccctgacccggttctcgtgctccagtctggctctccgctctgccatcatggctcgagctgacgatggagtctgattacctatgtctgtcctatcgacgacgactacagtaccttccggtttcggcggaggtactaagctcgaccgttcctaagtccacgcccaagg

SEQ ID NO: 384505 - DNA, 506 bp, Homo sapiens
  misc_feature: GZ8MTXP02J05RJ.11.75.G09.1.454.CMB.2.raw
  modified_base (450)..(450): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctcaatatcggggccgttatggtatgctctggtatcaacaacgtccaggaatcggcccccaaactcctcatctatgctgacaacaatccgaccttcacggggtccctgaccggttctctggctccaagtctggtcctcttccgcctccttggccatcactgggatcgagctgacgatgaggctgattactatgtctgtcctttgactattaaacnggtatgtgtatcggcgacggaccctacgtaaccgtctaagcacgcccaaggctccg

SEQ ID NO: 384506 - DNA, 503 bp, Homo sapiens
  misc_feature: GZ8MTXP02GE49S.11.75.G09.1.454.CMB.2.raw
  modified_base (445)..(445): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagaggtcgccatctcctgcactgggtccacctcccaatatcggggccggttatggtatgctctggtatcaacaacgtccaggatcggcccccaaactcctcatctatgctgacaacaatccgaccttcaggggtccctgaccggttctctggctcagtctggctctccgctcctgccatcactggctcgagctgacgatgaggtctagattactactgtctgtcctatgacgacgacctanagtaccgttcggtttcggcggaggactaagcgtcgaccgtccagtcacgacctaacgg

SEQ ID NO: 384507 - DNA, 530 bp, Homo sapiens
  misc_feature: GZ8MTXP02G20N0.11.75.G09.1.454.CMB.2.raw
  modified_base (328)..(328): a, c, t, g, unknown or other
  modified_base (341)..(341): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccgttatggtatgctctggtatcaacaacgtccaggaactcggcccccaaactcctcatctatgctgacaacatcgacttcaggggtcctgaccgttcnctggcctcagtcngctcttccgctctgcatcactgggctgagctgacgatgaggctgacttacactgtactgtcctagtgacgacacctacagaccttccgggtttcggcggaagggtactaaggtctacggaccgttctaaaggtcaacgcccaagggtcctaacggccccctcggtcaccgttcctccgttccccacccg

SEQ ID NO: 384508 - DNA, 495 bp, Homo sapiens
  misc_feature: GZ8MTXP02I9TSD.11.75.G09.1.454.CMB.2.raw
  modified_base (373)..(373): a, c, t, g, unknown or other
  modified_base (376)..(376): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccactccaatatcggggccgtatggtatgctctggtatcaacaacgtccaggaatcggacccccaaatcctcatctatgctgacaacatccgaccttcagggtccctgaccggttctctgctcagtctgctctcgctctgcntcnctggctcgagctgacgatgaggtctgattactactgtctcgtcctagtcgacgcgacctacagtaccgtccggtttcggcggtacggctaagctagaccgtacctagtcacgccaacgg

SEQ ID NO: 384509 - DNA, 559 bp, Homo sapiens
  misc_feature: GZ8MTXP02IGENK.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgtgctgatgcagccgcctcagtgtcgtcgggcccagggcagaggtcgccatcctctgcacgtggtccacctcaatagtcggggccgttatcggtatgctctggtatcaacacgtccaggaactccggaccccaaactcctacatctatcgctgaacaactaactcgaccttcgacgggtcctcggtaccgtctcgtcgctacctagtctgtcctcttccgcctcgtcgctactcacgtcggctcgacgtctgacgtagtcgtagtctgtattacgtacgtacgttcttcgtcctagtacgaacgtaccgtaaccgtacgtacgtaccgtttccgggttttaccgggacggtacggacgtaacgcgtacgtaccgtaccttaacgtcacgacccgg

SEQ ID NO: 384510 - DNA, 524 bp, Homo sapiens
  misc_feature: GZ8MTXP02JEEN0.11.75.G09.1.454.CMB.2.raw
  modified_base (233)..(233): a, c, t, g, unknown or other
tcagcgagagataccacgaccggtgctcgatttagtatagacatcagggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccactcaatatcggggccgttanggtatgctctggtatcaacacgtccaggaatggcccccaaatcctcatctatgctgacaacatcgaccttcaggggtccctgaccgttctctggcctccaagtctgctcttcgctctgccatcactgggctcgagctgacgatgaggctgattactactgtctgtcctatgacgacgacctacgagaccttccgggtttcggcggtagggactaaggcctggacccgtctaaaggtcacgacccaaggcctcggtccccctcgggtccacgtcctacgtttccccaccccg

SEQ ID NO: 384511 - DNA, 601 bp, Homo sapiens
  misc_feature: GZ8MTXP02H9Z6O.11.75.G09.1.454.CMB.2.raw
  modified_base (409)..(409): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtggggccccaggcaggagggtcgccatctcctgcactgggtccacctccaatagtcggggccggttatggtatgctctggtatcaacaacgtccaggaatcggacccccaaactcctcactctatgctgaacaacatcgaccttcgacggggttcctggaccggttctcgtggccctccgaagtctggcttcgttccccgccttccttggccctatccacgtgctccgagctgacgangaggctagattactactgtcttgtcctattgaacgacgacctagacgtacttccgggtttcggacgggaggtactaacgcgtacggtacccgtacttaaacggtccaacggccccgaaaaggggccttaacccggcccccccgttcgggtaccctaacccgtttccggtaccgttttccccccggtcccccg

SEQ ID NO: 384512 - DNA, 556 bp, Homo sapiens
  misc_feature: GZ8MTXP02F5JXB.11.75.G09.1.454.CMB.2.raw
  modified_base (419)..(419): a, c, t, g, unknown or other
  modified_base (427)..(427): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctctggtatcaacacgtccaggaatcggacccccaaactcctcatctatgctgacaacatccgaccttcgacggggtccctgacccggttctcgtggctccgaagtctggctctccgccttccgttgcctatccacgtgggactcgaggctgacgntgacggtntgattactacgtgttctcgtcctatcgacgaacgtaccctacacgtaccgttccgggttttacggcgggtaacggactaaacggcgtacggaacccgttaccgtaaacgtccgacggaccccgtaacgg

SEQ ID NO: 384513 - DNA, 685 bp, Homo sapiens
  misc_feature: GZ8MTXP02IRZLR.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtcgtcggggccccagggcaggagggtcgccatctcctgcacgtcgggtccacctccaatacgtccggggtccgttagtggtatgctcgtggtactacaaacaacgtccaaggaactccggaccccctaaaactcctacactctatgctagaaccaaacactcccgtacctacgacgggtccctggtaccggttctcgtcggacctaccgagtcgtcggtccttcccgtcccgtcccttcccgttcggaccctaacgttcccgtaccggttcggggtccgttaccgggaacgggtccgttacggaaaccggtagttacggggaacggttccgttaagttaactttaaccgtaacgttcgttccgtttacgtaccgttacgtacggaccgtaaaccgtaacctacgtaacggttacccgtttaccggggtttcgggacgggtaacggtactaaacgccgttacgtacccgttacgtaacgtccgaccgtaccgaaccgg

SEQ ID NO: 384514 - DNA, 531 bp, Homo sapiens
  misc_feature: GZ8MTXP02GLUCY.11.75.G09.1.454.CMB.2.raw
  modified_base (233)..(233): a, c, t, g, unknown or other
  modified_base (328)..(328): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactggtccactcaatatcggggccgttanggtatgctctggtatcaacaacgtccaggaatcggcccccaaaatccctcatctatgctgaacaacaatcgaccttcgagggtccctgaccgttntctggcctccaagtctggtctcttcccgcctccttggccactcacgtcgggctcgagctgacatgaggctgattacactgtctcgtcctatgacgacgacctacagacgttccggtttcggacggtaggactaaggctaggaccctctaacggtcacgacccaacggcctcgccccctcggtcactcctcgtcccctaccccg

SEQ ID NO: 384515 - DNA, 570 bp, Homo sapiens
  misc_feature: GZ8MTXP02GJ9MO.11.75.G09.1.454.CMB.2.raw
  modified_base (387)..(387): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccgttatggtatgctctggtatcaacaacgtccaggaatcggacccccaaaatcctcatctatgctgacaacaatcgaccttcgacgggtccctgaccgttctcgtggcctcaagtctggctcttccgcctctgccatcacgtggctcgagctgacgntgagctgattacatgtctgtctatgacgacgactacgagtaccgttccggtttcggcgggtaaggtactaaagcgttacggaacccttaccgtaaagttccgacgaccccgaaaggggtcctcccggtccccccgttacggttaccctaccgttcccgttcccgtttacccccgtaacccccg

SEQ ID NO: 384516 - DNA, 507 bp, Homo sapiens
  misc_feature: GZ8MTXP02F0NGG.11.75.G09.1.454.CMB.2.raw
  modified_base (255)..(255): a, c, t, g, unknown or other
  modified_base (349)..(349): a, c, t, g, unknown or other
  modified_base (395)..(395): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccactccaatatcggggccgttanggtatgctctggtatcaacaacgtccaggaactcggcccccaaactcctcatctatgctgacaacatccgaccttcgagggtccctgaccgttntctgctcagtctgctctcgctctgcatcactggctcgagctgacgntgaggtctagtattactactgtctgtcctatgacgtacgacctagacgtacgttccgggtttcgcgggtaacggactaacgcgtcgaccgttacaacgtcacgccctaacgg

SEQ ID NO: 384517 - DNA, 577 bp, Homo sapiens
  misc_feature: GZ8MTXP02GROH7.11.75.G09.1.454.CMB.2.raw
  modified_base (268)..(268): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagcccgccctcagtgtctggggccccagggcaggagggtcgccatctcctgcactgggtccacctccaatagtcggggccgttatggtatgctntggtatcaaacaacgtccaggaactcggacccccaaaactcctcatctatgctagaacaacatcccgaccttcgacggggtcccctggacccggtttctcgtcggtcctccgaagttctcggccttccttcccgcccttcccttcggcccatcgacgtcgggcttcggagcgtagacgtatggaggtctgtacttactacgtgttctgtcctagtcgacgaacctacctacgacgtaccgttccgggtttacggcggtaacggacttaagccgtacgaaccgttaccgtaagccgaacgacccgaacgg

SEQ ID NO: 384518 - DNA, 677 bp, Homo sapiens
  misc_feature: GZ8MTXP02F991G.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtggggccccagggcaggagggtcgccatctcctgcacgtgggtcccacctccaatagtcggggccgttatggtatgctcgtggtatcaacacgtccaggaatcggcccccaaactcctcatctatgctgacaacatcgaccttcgacggggtccctgtaccggttctcgtggccctaccgaacgtcgtcggccttccttcccgtcccttcccgtttcggccctaatccgtacgtggggccttccggacggtcgttacggaccgtaagtggacggtcgttagtactttaaccttactgttccttcggttacccttagttcggacccgtaacggtaaccctaaccgtacggttacccgtttcccggggtttttaccgggaccggggtaacggggtaaaccgttaacggcgttaccggtaccgttacccgtaaacgtaccgaccgacccgaacggtcctccgtcccccgtacggtaccctaccgttccgttccgttccccgttcccccg

SEQ ID NO: 384519 - DNA, 550 bp, Homo sapiens
  misc_feature: GZ8MTXP02GD9RD.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacacgtccaggaactcggacccccaaactcctcatctatgctgaacaaacactcccgaccttcgacggggtcccctggacccggtttctctcggctccaagtctggctcttccgccttccttgccatcacgtcgggctcgaggctgacgatgaggctgattactactgtctgtcctatcgacgacgtacctacacggtaccttccgggtttacggcggtaacgggtacttaaacgcgttacggacccgttactaaacggtcacggtccccgaacgg

SEQ ID NO: 384520 - DNA, 549 bp, Homo sapiens
  misc_feature: GZ8MTXP02G5NZZ.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagaggtcgcatctcctgcactgggtccacctccaatagtcggggccgttatggtatgctctggtatcaacaacgtccaggaatcggacccccaaatcctcatctatgctagacaacatcccgaccttcgacgggtccctgtaccggttctcgtgctccagtctgctctccgctcctgcatcactgggctcggagctagacgtatggaggtctagacttactactgtctgtacctagtcgacgacgtaacctacgacgtaccgttccgggtttacggacgggtaacgggtaccttaaacggcgtacggtaacccgttacgtaaagtcccgaacgacccgtaaccgg

SEQ ID NO: 384521 - DNA, 582 bp, Homo sapiens
  misc_feature: GZ8MTXP02I144U.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctctggtatcaaacacgtccaggatcggacccccaaactcctcatctatgctgaacaacaatcgaccttcgacggggtccctgaccgttctctcggcctccagtctcggctccttccgcctccttcggcctatccacgtcgggctcgaggctgacgatgagctgacttactactgtcttgtcctagtcgacgacgaacctacacgtacgttccgggtttacgggcgggtaacgggacgtaaacgccgtacggtaacccgttccgtaaacgtcgaccgtacccgaaggtcctcccggccccccgttggtaccctacgttccgttccgttacccctacccc

SEQ ID NO: 384522 - DNA, 546 bp, Homo sapiens
  misc_feature: GZ8MTXP02FIHJV.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggcccacctccaatagtcggggccggttatggtatgctctggtatcaacaacgtccaggaactcggcccccaaactcctcatctatgctgacaacaatcccgaccttcgacggggtcccctggacccggttctcctggctccaagtctggctcttcccgccttcccttggcccatccacgtggggctcggaggctggacgatgaggctgattactactgtctgtccatcgacgacgacctacagtaccgttccgggtttcggacgggtacgggacttaaagccgtacgacccgttctaaagtccaacggcccaaacgg

SEQ ID NO: 384523 - DNA, 528 bp, Homo sapiens
  misc_feature: GZ8MTXP02JC3WJ.11.75.G09.1.454.CMB.2.raw
  modified_base (387)..(387): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctctggtatcaacaacgtccaggaatcggacccccaaatcctcatctatgctgacacatccgaccttcgacggggtccctgaccggttctcgtggctcagtctgctctccgctctgccatcacngggctcgagctgacgatgagctagattactcgtgtctgtcctagtcgacgtaccgactacgagtaccgttccgggtttcggccggaagggtaccttaacgccgtacgtacccgtacctaaagtccaacggaccctaaacgg

SEQ ID NO: 384524 - DNA, 544 bp, Homo sapiens
  misc_feature: GZ8MTXP02G4RJ0.11.75.G09.1.454.CMB.2.raw
  modified_base (299)..(299): a, c, t, g, unknown or other
  modified_base (390)..(390): a, c, t, g, unknown or other
  modified_base (510)..(510): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagaggtcgccatctcctgcactcgggtccacctccaatagtcggggccgttatggtatgctctggtatcaacacgtcaggatcggcccccaaactcctcatctatgctagacaanatcgacttcgacgggtcctgtacgttctcgtcgcctcgaagtctggcttccgttccgccttccgttcggcctatcacgtgggcctgagtcngacgagtgagtctgtacttactactgtctgttcctagtcgacgaccgtactacgacgtaccttccgggtttcggcggtaagggtactacgcgtacgccgtacttagcacgcccaaggtcnccgtcccgtcggtccacgtcctcgtccccgtccc

SEQ ID NO: 384525 - DNA, 597 bp, Homo sapiens
  misc_feature: GZ8MTXP02F4YD8.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcaggagggtcgccatctcctgcactcgggtccacctccaatagtccggggccgttagtggtatgctctggtactcaacacgtccaaggactcggacccccaaactcctcatctatcgctagaacaacaatcccgaccttcgacggggtccctgtaccggttctcgtcgctaccgtagtctggtctccttccgccttccgttcgcctatcgacgtcgggctcggacgcgtgaaccgtgtggaggtctagtactttactacttcggttctcggttacctagtaccgaacgtaacccgtaacctacgacggtaccggtttccggggtttacgggaccggtaacgggtacttaacgcgttacggaccgttacgttaacgcgaaccggccgtaaccgg

SEQ ID NO: 384526 - DNA, 537 bp, Homo sapiens
  misc_feature: GZ8MTXP02IXBB9.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccgttatggtatgctctggatcaacaacgtccaggaactggacccccaaactcctcatctatgctagacaacatcccaccttcgacggtccctgtacccgttctcgtgcctcgagtcagcttctcccgccttccgttagctactcacgtcggctcggagctgacagtggagtctagtacttacctgtgtctgtcctagtcgacgacgtacctagacgtaccgtttcgggtttacggcgggaacggtactaagccgtacgaccgttacgtaagtcgacgtacccgacgg

SEQ ID NO: 384527 - DNA, 298 bp, Homo sapiens
  misc_feature: GZ8MTXP02I3J4L.11.75.G09.1.454.CMB.2.raw
  modified_base (291)..(298): a, c, t, g, unknown or other
tcagcgagagataccacgaccggtgctcgatttagtatagacatcaggggtccctgaccggttctctggctccaagtctggctcttccgcctccttggccatcactgggctcgtaggctgacgatgaggctgattactactgtctgtcctatgacgacgacctacagactccggttttcggcggagggactaagctgaccgtcctaagtcagcccaaggctgccccctcggtcactctcgtcccaccctcctcgtatctctcgctgagcgggctggcaaaggcgcataggnnnnnnnn

SEQ ID NO: 384528 - DNA, 616 bp, Homo sapiens
  misc_feature: GZ8MTXP02JEPRN.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagcccgccctcagtgtctcggggccccagggcaggagggtcgccatctcctgcacgtcgggtccacctccaatacgtcggggccggttatggtatgcttctggtactacaacaacgtccaaggaactccggacccccaaactcccactactctatcgctagaccaaacactcccgaccttcgacggggtccctggtaccgttctcgtcgctccaagtctcgtccttcgtcccgtcccttccgtcggcctactcccgacgtcgggaccgttcggacggtctggaaccgtagtggacgggtctaggtactttacctacgtgttaccttcggtactagtacgacgaacgtacctacgtaggcccgtttcgggtttacgggacggtaacggtaacgtacgcgtaccggtaaccgtaccgtaacgtaccgacggtacccgtaacgg

SEQ ID NO: 384529 - DNA, 547 bp, Homo sapiens
  misc_feature: GZ8MTXP02FRKCF.11.75.G09.1.454.CMB.2.raw
  modified_base (235)..(235): a, c, t, g, unknown or other
  modified_base (339)..(339): a, c, t, g, unknown or other
tcagcgagagataccacgaccggtgctcgatttagtatagacatcaggggacaagaggcagcactcaggacaatctccaacattgcctggtctcctctcctcctcactctcctcgctcactgcacagggtcctgggcccagtctgcgctgacgcagccgccctcagtgtctggggccccagggcagagggtcgccatctcctgcactgggtccacctcaatatcggggccgttanggtatgctctggtatcaaacaacgtccaaggaatcggaccccccaaactccctcatctatgctgaacaacaatcgaccttcgacggggtccctgtacccggttntcgtggccctccaagtctggctccttccgcctctggccatccacgtgggctcgagctgacgatgagctgacttacactgtactgtacctatcgacacgaacctacgagtaccgttccggtttcggacggagggactaacggcttcgaccgtcctaagtcacgacccgaagcctcgccccctcggtcctactctccggttccctccccg

SEQ ID NO: 384530 - DNA, 606 bp, Homo sapiens
  misc_feature: GZ8MTXP02JYH57.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctcggggccccagggcagagggtcgccatctcctgcactgggtccacctccaatagtcggggccggttatggtatgctctggtatcaacaacgtccaggaactcggacccccaaactcctcatctatgctagaacaacaatcccgaccttcgacgggtccctgaccgttctcgtcgctaccagtctggtccttccgttcccgcccttccgttcggccctatcccgacgtcgggggtcctaccgggaggtccgttaggaacggtattgggacgggtcttaggtaacttttacgtacttcggttctcggttaccctagtcgaaccgaccgtaacctaacgacgtaccgtttcccgggtttcgggaccgggaacggtaactaacggcgtacggaacccgttctaaagtcacgacccgacg

SEQ ID NO: 384531 - DNA, 571 bp, Homo sapiens
  misc_feature: GZ8MTXP02G6WLP.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggcccccagggcagagggtcgccatctcctgcactgggtccacctccaatatcggggccggttatggtatgctctggtatcaacaacgtccaggaatcggacccccaaactcctcatctatgctgaacaacaatcgaccttcgacggggtccctgaccgttctctggcctccagtctggctctcgcctcttgccatcacgtgggctcgagctgacgatgagctgattactactgtcttgtcctatcgacgacgacctacacgtaccgttccgggtttacggcggtaagggactaacggtccgtacggtacccgtacctaaaggtccacggaccccaaagggtccctccggtccccccgtacggttcccaccttccgttaccgtttccccctacccccg

SEQ ID NO: 384532 - DNA, 498 bp, Homo sapiens
  misc_feature: GZ8MTXP02FL03A.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccgttatggtatgctctggtatcaacaacgtccaggaatcggacccccaaactcctcatctatgctgacaacatcccgaccttcaggggtccctgaccggttctctgctccaagtctggctctccgcctcctgcatcactggctcgagctgacgatgagctgattactactgtctgtcctatgacgacgactacagtactccggtttcggcggtacggactaagcgtgaccgtctagtcacgccaacgg

SEQ ID NO: 384533 - DNA, 288 bp, Homo sapiens
  misc_feature: GZ8MTXP02GUDGJ.11.75.G09.1.454.CMB.2.raw
  modified_base (287)..(288): a, c, t, g, unknown or other
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgcccctcggtcactctgttcccaccctcctcgtatctctcgctgagcgggctggcaaggcgcatagnn

SEQ ID NO: 384534 - DNA, 573 bp, Homo sapiens
  misc_feature: GZ8MTXP02JAAEB.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtcgtcggggccccagggcaggagggtcgccatctcctgcacgtgggtcccacctccaatagtcggggccgttatggtatgctctggtatcaacacgtccaggaactcggacccccaaactcctacatctatgctagacaacactcccgaccttcgacggggtccctggtacccgttctcgtcgctccagtctcgctcctccgccttcctgcctatccagttcgggctcgaggctggacgatggacggtctagtactttacgtactgttctcgtcctagtcgaacgtaccgtaacctacacggtccgtttaccggggtttcggacgggaacgggtactaacgtcgtacgaacccgttaccgtaacgtccgaacggacccgtaacgg

SEQ ID NO: 384535 - DNA, 290 bp, Homo sapiens
  misc_feature: GZ8MTXP02FH3QX.11.75.G09.1.454.CMB.2.raw
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcacgccaaggctccgcccctcggtcactctcgttccccaccctcctcgtatctctcgctgaggcggctggcaaggcgcatag

SEQ ID NO: 384536 - DNA, 541 bp, Homo sapiens
  misc_feature: GZ8MTXP02IAQOT.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcaggaggtcgccatctcctgcactgggtccacctccaatatcggggccgttatggtatgctctggtatcaacaacgtccaggaatcggacccccaaactcctcatctatgctgacaacatcgacctttcgacggggtccctgaccggttctctggccctaccaagtctggcttccttcccgccttcctttggccctatccacgtgggctccgagctgacgtagtgaggctggtattactatgtcttgtcctatgacgacactacacgtacgttccgggtttggcggaggtactaaggctgaccgtactaagtcacgccctaaggcctcgccccctggtcactcctcgtttccccaccc

SEQ ID NO: 384537 - DNA, 611 bp, Homo sapiens
  misc_feature: GZ8MTXP02JUOMB.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctctggtatcaacacgtccaggaatcggacccccaaatccctacactactatgctagaacaaactactaccccgtaccttacggaccgggttcctacggtaccggttctcgtcggtcctaccgtagttcgtcggtccttccgttcccgccctttcgttccggacctacgtccctacggtcggtccgtacgggacggtcgtacggaacgtgtaggacggtctagtacttactacgtcgttactcgtactagtcgaacgaccgtaacctacgacgtaccggtttccgggtttcgggacggacggtaacctaagtcgtacggtacccgtacgtaacgccgaccaccggacg

SEQ ID NO: 384538 - DNA, 540 bp, Homo sapiens
  misc_feature: GZ8MTXP02JWK69.11.75.G09.1.454.CMB.2.raw
  modified_base (405)..(405): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagaggtcgccatctcctgcactgggtccacctccaatagtcggggccgttatggtatgctctggtatcaacaacgtccaggatcggcccccaaactcctcatctatgctagacaacaatcccgaccttcgacggggtccctgaccggttctctggctccagtctggctctccgctctgccatcactggctcgagctgacgntggagtctgtattactactgtctgtcctatcgacgacgtacctacagtaccgttccgggtttcggacgggtacggggtaaccttaaggcgttacggaacccgttaccgtaaagtcccgaacggcccgtaaacggg

SEQ ID NO: 384539 - DNA, 593 bp, Homo sapiens
  misc_feature: GZ8MTXP02IYSUC.11.75.G09.1.454.CMB.2.raw
  modified_base (294)..(294): a, c, t, g, unknown or other
  modified_base (403)..(403): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcaggagggtcgccatctcctgcactgggtccacctccaatagtcggggccggttatggtatgctctggtatcaacacgtccaggaatcggacccccaaactcctcatctangctgacaacatcgacctttcgacgggtccctgaccgtctcgtgccctcagtctgctctccgctcctgcatcagtgggctcgagctgacgatgagtctgacttactagtntcttcgttactatgaccgacgtacctaacgacgtaccgtttccgggtttacggcgggtaacgggtactaaaaggtccgtcgtaaacccgttaccgtaaaaggtcccaacggtaccccgaaagggccctaacccggtcccccccgtgggttacccctaccgtttcccgttccgtttacccccgtacccccg

SEQ ID NO: 384540 - DNA, 859 bp, Homo sapiens
  misc_feature: GZ8MTXP02HM5RX.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagcccgccctcagtgtcgtcggggccccagggcaggagggtcgccatcctcctgcactgggtccacctccaatagtcggggtccggttatggtatgctctggtatcaacaacgtccaggactcggccccaaactcctcatctatgctagaacaaacaactccgtaaccttcgaacggggttccccgtcggtacccggtttctcgtggtcccctaccgtaaacgtcgtcggtcttcccttcccgtcccttcccgttcggtccctaactcccgtaacgtcggggtcccgtacgtacgggaccgttcggaacccggtaggtacgggtaacggggtccgttacggggttaaacgttttaacccttaaaccgttcgggtttaccgtttccggtttacccgttaacggtttaccggaaaccccgggtaaaccccggtaaaccccgttaaacccgtaaccggggttaaccccggttttacccccgggggtttttaccgggggacccgggggttaaacgggggtaaacccgggttaaaacgggttacccgttacccgggttaacccccgggtttaaaccccggttaaaccgggtttaacccgtaaccggaacccccggtaaaccgggtacccgttccccggttcccccccggtacccggttacccggtaaccctttccccgttaccccggtttacccccctttaacccccccg

SEQ ID NO: 384541 - DNA, 586 bp, Homo sapiens
  misc_feature: GZ8MTXP02JLNS4.11.75.G09.1.454.CMB.2.raw
  modified_base (246)..(246): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctntggtatcaacacgtcaggaactcggacccccaaactcctcatctatgctgacaacatcgaccttcgacgggtcctcgaccggttctcgtcgcctaccaagtctcggcttccttccgcctccttcggccctatccgacgtgggcctcggacgctaggacgatgaggtctgtacttactactgtctgttcctatcgacgacgacctacgacgtccgttcgggtttcggcgggaacgggtactacgtccgtacgtacccgtacgtaaacgtcgaaccgacccgtaacgccgtcccgtcccccgttcggtacctaccgtccgttcccgttcccccttacccccg

SEQ ID NO: 384542 - DNA, 542 bp, Homo sapiens
  misc_feature: GZ8MTXP02ISDYZ.11.75.G09.1.454.CMB.2.raw
  modified_base (402)..(402): a, c, t, g, unknown or other
  modified_base (433)..(433): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctgggccccagggcagagggtcgccatctcctgcactggtccacctccaatatcggggccggttatggtatgctctggtatcaacacgtccaggaatcggacccccaaactcctcatctatgctgacaaacatccgaccttcacgggtccctgtaccgttctctggctccagtctgctcctccgctccttgccatcatcggctgagctgacgngtgagtctagattactacgtgtctgttcctntacgacgacgtacctacgtacgtaccgtttcccgggtttcgggacgggtaacggtacctaaacggtctacggtaccgttacccgtaagtacctaccggacccgtaacgg

SEQ ID NO: 384543 - DNA, 518 bp, Homo sapiens
  misc_feature: GZ8MTXP02JLS2O.11.75.G09.1.454.CMB.2.raw
  modified_base (336)..(336): a, c, t, g, unknown or other
  modified_base (381)..(381): a, c, t, g, unknown or other
  modified_base (389)..(389): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatcggacccccaaactcctcatctatgctgaacaacaatcgacctttcgacggggtccctgaccgttcnctggcctccagtctgctctccgcctccttgccatcagtggctcgngctgacgntgagctgtattactactgtctgtcctatgacgacgtacctacagtacgttccggtttcggcggtaggactagctgaccgtcagtcacgcccagcctcgtcccctcggtcacctcgtcgttccctacccg

SEQ ID NO: 384544 - DNA, 292 bp, Homo sapiens
  misc_feature: GZ8MTXP02IVU4H.11.75.G09.1.454.CMB.2.raw
  modified_base (286)..(292): a, c, t, g, unknown or other
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctggtcactctgttcccaccctctcgtatctctcgctgagcgggctggcaaggcgcatagnnnnnnn

SEQ ID NO: 384545 - DNA, 299 bp, Homo sapiens
  misc_feature: GZ8MTXP02IBHDM.11.75.G09.1.454.CMB.2.raw
  modified_base (288)..(299): a, c, t, g, unknown or other
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagtacttccggttttcggcggagggactaagctgaccgtctaagtcagcccaaggctcgcccctcggtcactctcgttcccaccctcctgtatctctcgctgagcgggctggcaagcgcatagnnnnnnnnnnnn

SEQ ID NO: 384546 - DNA, 543 bp, Homo sapiens
  misc_feature: GZ8MTXP02GJ8RB.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctctggtatcaacacgtccaggaatcggacccccaaactcctcatctatgctgacaaacatcccgaccttcgacggggtccctggtacccgttctctggctccaagtctggtctctcccgcctccgttggccatcacgtgggctcggagcctagacgtatggacggcttgactttacgactggtctgtcctatgacgacgacctacagtaccgttccggtttcggcggtaacgggtactaagccgtaggacccgtactaacgtccaacggtcccaaacgg

SEQ ID NO: 384547 - DNA, 610 bp, Homo sapiens
  misc_feature: GZ8MTXP02IE1HI.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctcaatagtcggggccgttatggtatgctctggtatcaacacgtccaggaactcggaccccccaaactcctacatctatcgctacgaacaacactcccgtaccttcgacgggtcctacggtacccgttctcgtcgtctaccgtagtcctacgtaccttcccgttcccgtccttcccgtttcggtacctactccgtacggtcgggtctcggaggtctgacgtacgtaggacggtcttagtacttacttcgtgttcttgtacccttagacgtaccgacccgtaacctacgcggttacccgtttccggggttacggcgggaaggttacctaacggccgtaccggtaccttaccgtagtccgaccgaccgtaacccgg

SEQ ID NO: 384548 - DNA, 547 bp, Homo sapiens
  misc_feature: GZ8MTXP02HC0X8.11.75.G09.1.454.CMB.2.raw
  modified_base (415)..(415): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctctggtatcaacaacgtccaggaatcggcccccaaatcctcatctatgctgacaacatcccgaccttcgacggggtccctgaccggttctcgtggctccgagtctggctcttcccgctcccgttgccatcacgtgggctcgagctgaacgntgaggtctgattacactgtctgtcctagtcgacgaccgtacctacgacgtaccgttccgggtttcggacgggtaacggtacttaaagccgttacggacccgttacctaaagtccgaacgccccgtaaacggg

SEQ ID NO: 384549 - DNA, 594 bp, Homo sapiens
  misc_feature: GZ8MTXP02JZTPF.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctcgtggtatcaacaacgtccaaggaactcggacccccaaatcctcatctatgctagacaacatcgaccttcgacggggttccctggtacccggttctcgtcggaccctacgaagttcgtggtccttccttcccgcccttccgttcggcctattccgacgttgggcctcgacggtctgaacgatggagctgtaacttactactgtctcgtacctatcgacgacgtacctacgacgtacgttccgggtttacggacggtacgggtactaaggctacgaccgtacctaagtcacgacccgaaggccctccggcccccgttaggtccaccgttccgttcccgttccccgtcccc

SEQ ID NO: 384550 - DNA, 533 bp, Homo sapiens
  misc_feature: GZ8MTXP02IJF2P.11.75.G09.1.454.CMB.2.raw
  modified_base (415)..(415): a, c, t, g, unknown or other
  modified_base (420)..(420): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctgggccccagggcagagggtcgccatctcctgcactgggtccacctccaatagtcggggccgttatggtatgctctggtatcaacaacgtccaggaatcggacccccaaaactcctacatctatgctagacaaacatccgaccttcgacggggtccctgtaccggttctcgtggctaccaagtcctggccttctcccgcctccttgccatcacgtggctcgagcngacgntgagctgacttacgactgtctgtcctatcgacgacgtactacagtaccgttaccgggtttcggacgggaggacttaagcgttacgaccgttctaaagcgaacgacccgtaagg

SEQ ID NO: 384551 - DNA, 684 bp, Homo sapiens
  misc_feature: GZ8MTXP02IJQYS.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtcgtcggggccccagggcaggagggtcgccatctcctgcacgtgggtcccacctccaatacgtcggggccgttatggtatgctctggtatacaaacaacgtccaaggaactccggacccccaaaactcctacattctaatcgactagaacaaacatcccgaccttcgacggggtccctggtacccggttctcgtcggctaccgaagttccgtcggtccttcccttcccgccttcccttggccattccacgtcggggtctacgggacggtctacggaacgtagttggacgggttacttaggttaaactttaaccgttcgttacgggtttccttacggttacccttaaagtcgggaaacccgtaaaccggtaaccctaacgtaacgggttaacccgtttcccgggggtttaacggggacgggtacggggtaaaacttaccggtaacgttcggaaaccccgttacctaaaggtacccaaccggtaacccgtaaacggg

SEQ ID NO: 384552 - DNA, 634 bp, Homo sapiens
  misc_feature: GZ8MTXP02H9HZJ.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcacgccgccctcagtgtcgtcggggccccagggcaggagggtcgccatctcctgctacgtcgggtcccacctcaatacgtcggggccgttagtggtatgtctcgtggtactacaaaccgaacgtaccgaaggaactcccggacccccaaaactcctactatctatgctagaacaaacactcccgacttcgacggtcctcgtaccgttctcgtcggtctaccgtagtctcggtccttcccttcccgtcctccgttcgcctacgtccgtacggttcgggccgtacggacggtcgtaggaccgtagtcggaggtctagtactttacgtacgtcgttcgtcgtacttagtacgtaaccgtaacgtaccgtacgtacgttaccggtttccgggtttacggggacggtaacggtactaacggaaccgtacgtaccgttacgtaacgtccgaccgtacccgtaccgg

SEQ ID NO: 384553 - DNA, 576 bp, Homo sapiens
  misc_feature: GZ8MTXP02ICJAK.11.75.G09.1.454.CMB.2.raw
  modified_base (285)..(285): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggcggttatggtatgctctggtatcaacaacgtccaggaatcggaccccaaatcctnatctatgctgaacaacaatcgaccttcgacggggtccctgaccggttctcgtggccctccaagtctgtcttccttccgcctcgttcgccatcacgtggcctcgagctgacgatgaggctcattactactgtctgtcctagtcgacgtacgactacgacgtacgttcggtttcggacggagggtactaacgcgtacggtaccgtactaacgtcaaccgtacccgaacggtcccgtaacccgtcccccgttccggtacctaccgtttcccgttcccggtttccccgtcccccg

SEQ ID NO: 384554 - DNA, 730 bp, Homo sapiens
  misc_feature: GZ8MTXP02I1IN0.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctcggggccccagggcaggagggtcgccatctcctgcacgtgggtccacctccaatgtcggggcgttatggtatgctctggtatcaacacgtcagatcgaccccaatcctcatctatgctagacaaacactcccgaccttcgacggggtccctggtacccggttctcgtcggacctaccgtaacgttccgtcggtccttcccgtttaccccgtccctttcccgttacgggacccctaactttcccgtaacggttcgggggtccttcggggaacgggtcccgttaggaaaccggtaacgttgggaaacgggttccgtttaggttaacttttaaaccctaccgttggttcctttacggttacccttaagttaccgggaaacccgtaaaccggtaaacccttaacgaaaccggggtttacccggttttaccccgggggttttcggggaccggggttaaacggggtaaccctttaaagggtcccgttaacggtaaccccggtttaacccgtaaaggttcccgaacgggtacccccgtaaacggg

SEQ ID NO: 384555 - DNA, 579 bp, Homo sapiens
  misc_feature: GZ8MTXP02IVB7H.11.75.G09.1.454.CMB.2.raw
  modified_base (356)..(356): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccggttatggtatgctctggtatcaacacgtcaggatcgaccccaaactcctcatctatgctagaacaacaatcgaccttcgacgggtcctgaccgttctcgtggccctcgatctgtctccttccncctcttcgccactcacgtggctcgagctgacgatggacgctagtacttactactcgtctcgttacctagtcgaacgacgacctacgacgttaccgtttccgggtttacgggacggtacggtaactaacggtctacggtaccgttacctaaaggtccaacggacccgaaggccctcccggtcccccgtcggttaccaccgtttcgtacccgttacccctacccc

SEQ ID NO: 384556 - DNA, 607 bp, Homo sapiens
  misc_feature: GZ8MTXP02F1WA2.11.75.G09.1.454.CMB.2.raw
  modified_base (332)..(332): a, c, t, g, unknown or other
  modified_base (392)..(392): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccactccaatagtcggggccgttatggtatgctctggtatcaacacgtccaggaatcggacccccaaatcctcatctatgctagacaacaatcgaccttcgacgggtccctgtaccggttntcgtggcctccaagtctggtctcttccgcctccttggccatcacgtggctcgagctgacngtgagctgtaattacgacttgtctcgtactagtcgtacgaccgtaacctacgtaggtaccgttccggggttttacggacggtaacggggtaacctaaagggccttacggaacccgttacccgttaaaaggtccgaacgggaccccctaaaggggtcccttccggccccccgtttcggtacccaccctttccgttacccgttaccccctacccccg

SEQ ID NO: 384557 - DNA, 547 bp, Homo sapiens
  misc_feature: GZ8MTXP02I93JO.11.75.G09.1.454.CMB.2.raw
  modified_base (379)..(379): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctctggtatcaacacgtccaggactcggacccccaaatcctcatctatgctgacaacatcgaccttcgacgggtccctgaccgttctcgtgcctcagtctgctctcgcctctgcatcacgtggctcgagctgacgngtgaggtctgtacttactatgtcttgtcctagtcgaccgacgtacctacgacgtccgttcgggtttcggaggtacggactaagcgtacgacccgtctaagtcacgacccgtaaggccctaaccggtcccccgtacggtcctaccgtccgtccgtttaccccctacccg

SEQ ID NO: 384558 - DNA, 568 bp, Homo sapiens
  misc_feature: GZ8MTXP02JOBWH.11.75.G09.1.454.CMB.2.raw
  modified_base (355)..(355): a, c, t, g, unknown or other
  modified_base (390)..(390): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccgttatggtatgctctggtatcaacacgtccaggaatcggcccccaaactcctcatctatgctgacaacatcgaccttcgacggggtcctggaccgttctcgtggccctcagtctgctcttccnccttcctggcctatcacgtgggctcgagctgacgngtgagtctgtacttactactgtctcgtctagtcgacgtaccgactacgtacgtacgttccgggtttcggacgggtacgggacgtaagtccgtacgacccggttacctaacgtcgaccgaccccgaaggtcctccggtcccccgtcggtcctaccgttccgtccgttcccctacccccg

SEQ ID NO: 384559 - DNA, 543 bp, Homo sapiens
  misc_feature: GZ8MTXP02J16W3.11.75.G09.1.454.CMB.2.raw
  modified_base (421)..(421): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggccccagtctgcgctgacgcagccgccctcagtgtctggggccccagggcagagggtcgccatctcctgcactgggtccacctccaatagtcggggccgttatggtatgctctggtatcaacacgtccaggaactcggacccccaaatcctcatctatcgctgacacaactcccgaaccttcgacggggtcccctggtaccgttctcgtggcctcagtctggctctccgcctcgtgccagtcacgtcggctcgagcctagacgtntggacgtctggactttactacttggtacttgtcctatcgaacgaccgacctacgagtacccgttcgggtttacggcggacgggaactacggctcgaccgttctacgtccaacggcccaacgg

SEQ ID NO: 384560 - DNA, 557 bp, Homo sapiens
  misc_feature: GZ8MTXP02HI2JI.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtggggccccagggcaggagggtcgccatctcctgcactgggtccactcaatagtcgggccgttatggtatgctctggtatcaacacgtccaggaactcggacccccaaactcctcatctatgctgaacaacaatcgaccttcgacggggtccctggtaccgttctcgtggcctcagtctggctcttccgccttctgccatcacgtggctcgagctgacgatgaggtctgtattactatgttctgttacctagtcgacgacgtacctacgacgttaccgttccggggtttcggacggtagggactaaggcgtacggacccttcgtaaagtccacgtacccaaggcctaacggccccctggtaccacgtccgttccgttcccctaccc

SEQ ID NO: 384561 - DNA, 598 bp, Homo sapiens
  misc_feature: GZ8MTXP02ITR6Z.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggcccccagggcagagggtcgccatctcctgcactgggtccacctccaatatcggggccgttatggtatgctctggtatcaacacgtccaggatcggacccccaaatcctcatctatgctgacaacatcgaccttcgacggggtcctgaccgttctcgtggccctccagtctggcttccttccgcctccttggcctatccacgtgggctcgagctgacgatgaggctgacttactactgttctgttcctagtgaaccgacgaccctacgacggtaccgtttcccggggtttcggacgggtaacgggtactaaacggtccgttacggtaacccgttccgtaaaacgtccaccggacccccgaaagggtccctaaccggccccccgttgggtaccctaccttccgttcccgtttcccccgtcccccg

SEQ ID NO: 384562 - DNA, 721 bp, Homo sapiens
  misc_feature: GZ8MTXP02HBXR3.11.75.G09.1.454.CMB.2.raw
tcagcgagagataccacgaccggtgctcgatttagtatagacatcagggggacaagaggcagcactcaggacaatctccaacatggcctggtctcctctcctcctcactctcctcgctcactgcacagggtcctgggcccagtctgcgctgacgcagccgccctcagtgtcgtggggccccagggcaggagggtcgccatctcctgcactgggtccacctccaatagtcggggccggttatggtatgctctgtatcaacacgtcaggactcggaccccaaactccacatctatgctgacaacaatccgtaccttcgacggggtccctcggtaccgttctcgtcggccctccaacgttctcggtccttccgttcccgtccttaccgttcgggaccctaacgttcccgaacgttcgggggtacccgttacggaacgggtcgttaacggaaccggagttacggaaggtcctacgtacttaacctacgttcgttacgtcgttacctacgttacgaaccggtacgtaaccgttaacgacgttaccggtttccgggggtttaacgggccgggttaaacgggggtaacttaacggtacccgttacgggtaccccgttaaccgttaaacggtacccgaccgaacccgtaacggggtccccttcccggtaaccccccggttcggtacccctaccgttcccggtttccccggttacccccggtttcccccg

SEQ ID NO: 384563 - DNA, 706 bp, Homo sapiens
  misc_feature: GZ8MTXP02FMEYV.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagcccgccctcagtgtcgtcggggccccagggcaggagggtcgccatcctcctgcacgtcgggtcccactccaatagtcggggccgttatggtatgctcgtggtatcaacacgtcaggaactccggacccccaaactcctacactctatgtctagaacaaactaactccccgtaccttacgacggggtccctcggtacccggttctcgtcggtcctaccgtaacgtccgtcgggtccttcccgttcccgcccttcccgttcggaccctacgtcccgtacggtcggggtccgtaccggacggttacgtcggaaccgtagtcggtaacgggtccttaggttaacctttactaccgtttcgttccgttacggttaccttaacgtacgtaacccggtaacccggtaaaccctaaccgtacggttaacccgggttttcccggggttttacggggaccgggggtaaacgggtaaccttaacggtcccgtacggtaacccgtaaccgttacgtaccgaaccggaccccgtaaaccggg

SEQ ID NO: 384564 - DNA, 668 bp, Homo sapiens
  misc_feature: GZ8MTXP02JNK0D.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcacgcccgccctcagtgtccgtcgggggccccaggggcaggacgggtccgccatcctcctgcacgtcgggtcccacctccaatacgtccggggtccgttagtggtatgctctggtatcaaacaacgtaccaggtaactccggacccccaaactcctacatctatgctagaacaacactcccgtaccttacgacgggtccctacggtcccggttctccgtggtcctaccgtaagttccgtacggtccttccgttccccgtcccttccttcggcctactccgtacgtcggggcttccggaacggtcgtacggaacggtagttgggaacgtcttaggtaactttaccgttacgtgttcctcggttccttaagtacgaacggtacccgtaacctaacggaaccggttacccggtttaccggggtttaccgggacggtacgggtaacctaacggtcgtaaccggtacccgtacgtaacgtccgaaccgacccgtaacgg

SEQ ID NO: 384565 - DNA, 646 bp, Homo sapiens
  misc_feature: GZ8MTXP02F053F.11.75.G09.1.454.CMB.2.raw
  modified_base (273)..(273): a, c, t, g, unknown or other
  modified_base (318)..(318): a, c, t, g, unknown or other
  modified_base (474)..(474): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagcccgccctcagtgtcgtcggggccccagggcaggacgggtcgccatctcctgcacgtggtcccactccaatagtcggggccggttatggtatgctntggtatcaacacgtcaggaactccggaccccaactcctcatctangtctacgaccaaactacgtcccgtaccgttcgacgggtcccgtcgtacccgttctcgtcgcctaccgtacgtcgtcggtccttcccgtttcccgccgttcccgttcggaccctacgtccgtacggtccgggctacgggtcgacgttcggaacggtntacgggacggtcttagtaactttacgtacgtcggttccctgttcctaagtcgaaaccgtaccgtaaccgtacggtaacgttcccggtttacccggggtttacggacggggtaaacggtcctaaagtccgttacggtacccgtttacgacgtaaccgaccgacccgtacccgg

SEQ ID NO: 384566 - DNA, 570 bp, Homo sapiens
  misc_feature: GZ8MTXP02J2KLI.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccgttatggtatgctctggtatcaacaacgtccaagggaatcggacccccaaaatccctacatctatgctagacaaacaatcccgaccttcgacggggtccctgacccggttctcgtggctccagtctcggctctccgtcctccttgccatcacgtggctcgagctgacgatgaggtctgattactactgttctagtcctagtgaccgacgtaacctacgtacggaccgtttccgggttttacgggacggtaacggggtacctaaacggtccgtacggtaacccgtaccgttaaaacgtccgaacgaccccgaaaccggg

SEQ ID NO: 384567 - DNA, 696 bp, Homo sapiens
  misc_feature: GZ8MTXP02JEZHR.11.75.G09.1.454.CMB.2.raw
  modified_base (332)..(332): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagcccgccctcagtgtcgtcggggccccagggcaggagggtcgccatcctcctgcacgtcgggtccacctccaatagtcggggtccgttatggtatgctcgtggtactcaacaacgtccaggtaactccggaccccaaactcctcactctatgctanaacaactatccgacctcgacggtcctgtaccggttctcgtcgctaccgtagtccgtacggtccttccgttcccgtcccgttcccgttcggaccctacgttcccgtacggttccggggccttaccgggaacgggtccttaggaccggtacgtttagggaacggtccttaaggttaactttaaccgtaaccttaggtcctttacgtaccgttaacgtacgaaccggtaaacctaaccgtaccgtaaccggtaccggtttacccggggtttacggggaaccgggaaacgggttacccttaaaacggcccgttcgggttaaaaccccttccgttaaaacggtcctaacccggtaccgtaaacccgggg

SEQ ID NO: 384568 - DNA, 623 bp, Homo sapiens
  misc_feature: GZ8MTXP02JEAF4.11.75.G09.1.454.CMB.2.raw
  modified_base (317)..(317): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtcgtcggggccccagggcaggagggtcgccatctcctgcacgtcgggtccacctcaatgcggggtccgttatggtatgctctggtatacaacacgtccaggaactcggacccccaactcctcatctangctagacaaacatccccgtactcgacgggtccctaggtaccgttctcgtcggcctaccgagtccgtggtccttcccgttcccgccctttccgttcggacctcgttaccgacgtcggggtcttacggagccgtaggaccggtatcgggaacgtcgttagtactttacctacgtcggtacttcgttcctagtacgtaaccgaacgtaccttacgacggttaacccggttcccggggtttacgggacggggtaaacggtactaacggtccgtacgggtaccctacggtaactccgacgaccgtaacggg

SEQ ID NO: 384569 - DNA, 613 bp, Homo sapiens
  misc_feature: GZ8MTXP02JPY2E.11.75.G09.1.454.CMB.2.raw
  modified_base (254)..(254): a, c, t, g, unknown or other
  modified_base (397)..(397): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcaggagggtcgccatctcctgcactgggtccacctccaatagtcggggccggttatggtatgctctggtancaacacgtcaggactcggaccccaactcctcatctatgctgaacaacactcgtaccttcgacgggtcctgtaccgttctcgtggccctccagtctggtctccttccgcccttaccgttcggcctactcgtacgtcgggctcgnggctgacgatggagtcgtagtacttacgtactgttactcgtacctagtcgaccgaccggtacctaacgtacgttaccggtttccgggtttcgggacggggtacgggtaactaacggtccgtacggacccgttacgtaaacgtccgaccgtacccgaaggtccctccggtcccccgttcggtccctaccgttcccgttcccgtacccccttaccccg

SEQ ID NO: 384570 - DNA, 602 bp, Homo sapiens
  misc_feature: GZ8MTXP02IMUQT.11.75.G09.1.454.CMB.2.raw
  modified_base (325)..(325): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgcctcagtgtcgtggggccccagggcaggagggtcgccatctcctgcactgggtccacctcaatagtcggggccgttatggtatgctctggtatacaacacgtcaggaatcgaccccaaactctcatctatgctagaacaacaatcgaccttcgacggggttacccngtaccggttctacgtggaccctccaagtctggtccttccgttcccgtccgttccgttcggccctactccgagtcggggctcgagctgacagtcgagtctatattactactgtacttgtacctagtcgacgactaaccgtcacgtacgttcgggtttacggacgggtaagggtactaacggtctacggtaacccgtacgtaaaacgtcgaccggtaccgaacgtcccgtcccgtccccgtacggtcctacctttccgttacccggtacccttcccccg

SEQ ID NO: 384571 - DNA, 672 bp, Homo sapiens
  misc_feature: GZ8MTXP02GCKXA.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggcccccagggcaggagggtcgccatctcctgcacgtgggtccacctccaatagtcggggccgttatggtatgctctggtatcaacacgtccaggatcggcccccaaactcctcatctatcgctgaacaacaatccgtacctttcgacggggtccctggtacccgttctcgtggcccctccaagtcgtcggtctccttcccgcctcccgttggcctatccacgttcggggctcgaggtctggaccgtagtggaggtccttaggtaactttaaccgtacttcgttccgttcgttacccgttaagttacggaaccggtaacccgtaccccgttaacgtaccggttacccggtttccgggggttttaccgggaccggggtaaggggtaaccgtaacggccgttaccggtacccgttaccgtaaacggcctacgaccccgtaacggtccgtaaccgtcccccggtacgtacctaccgtttccgtccggtttccccctcccccg

SEQ ID NO: 384572 - DNA, 595 bp, Homo sapiens
  misc_feature: GZ8MTXP02GG7E8.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagcccgccctcagtgtctcggggcccccagggcaggagggtcgccatctcctgcacgtcggtccacctccaatacgtcggggccgttatggtatgctcgtaggtatacaaacacgtccaaggaactccggaccccctaaactcctacatctatcgctagaacaaacactcccgtaccttcgacgggtccctagaccgttctcgtgcctacgagtctcgtccttcctcccgcccttccgtcgcctactccgacgtcgggtctacgggcgctcgaacgtagtggacggtcttaggtaactttacgtacttgtcttcgtaccttagacgaccgtaccgaccttacgacggttaccgtttccgggttacgggacggacgtaactaacgcgtccgaaccgtttacacgtaccacgacccgtaacgg

SEQ ID NO: 384573 - DNA, 721 bp, Homo sapiens
  misc_feature: GZ8MTXP02GIIUQ.11.75.G09.1.454.CMB.2.raw
  modified_base (212)..(212): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagcccgcctcagtgtctgggccccagggcagcgggtcnccatctctgcacgtgggtcccacctccaagtagtcggggccgttatggtatgctcgtggtatcaaacgacgtcagggaactccggaccccctaaaacgtcctactactctatcgactagaaccaaactaacgtccccgtaaccccgtttcggaccggggttccccgttacggtaacccggtttcctccgttcgggacccttaccgtaaacgttccgtacgggtcctttcccgttccccgtcccgttcccgttcgggacccctagtacccgtaccggtcggggtccgttaccggaacggtccgttaggaaacccggtatacgggtaacgggtcctttaagggttaacgtttaccttaaccggttgttcgttacggttccttaaagttccgaaaccgtaaccggtaccttaacgacggttacccggtttaccgggtttacgggacggtaacgggtaacctaaggccgtaccggtaaccgttaccgttaacgtccgaaccgaccgtaaccgg

SEQ ID NO: 384574 - DNA, 545 bp, Homo sapiens
  misc_feature: GZ8MTXP02H75MZ.11.75.G09.1.454.CMB.2.raw
  modified_base (389)..(389): a, c, t, g, unknown or other
  modified_base (398)..(398): a, c, t, g, unknown or other
  modified_base (411)..(411): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctcggggccccagggcaggaggtcgccatctcctgcactcgggtccacctccaatacgtcggggcccgttagtggtatcgtctctggtatcaacgaacgtccgaaggaactcggaccccccaaaacgtcctacatctatgctgaacaacatcccgacttcgcggtcctcgtaccgttctctcgctccagtctgctctccnctctcgcancacgtggctacgngctagacgtgtgagcttgacttaactcgttcgtcttcgtctagtacgaccgacctactacgtacgtacccgttcgggttcggacgtacggaactacgcgtcgacccgttacgtaacgtccgacgaccgtaccgg

SEQ ID NO: 384575 - DNA, 699 bp, Homo sapiens
  misc_feature: GZ8MTXP02FM7HY.11.75.G09.1.454.CMB.2.raw
  modified_base (187)..(187): a, c, t, g, unknown or other
  modified_base (222)..(222): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacgagggtcctgggcccagtctgcgctgaccgcacgcccgcctnaggtcgtcgtccggggcccagggcaggacggtccncctatcctccgtgcctacggtccggaccctacctacctaagtcggtccggggtcgttagtggtatcgtctcgtagtactaccgaacgaccgtacgaggtaaccgtacccggaccccctaaactcctactacttactacgtcgtacctaacgaaacctaaacctaacgttccccccgtaccgtttacggtaccggggttcccttacggtacccggtttctccggtcgtaccttaccgtacgttccgttacggtccctttccgttcccgtccgttcccgttcggacctacgtcgacggtcggtacgtacgggtcgtacgtacggtaacgtgtacggcggtacttacgttacgttaactcgttacggtccttacgtcttagacgtacgacgtacgtacgtacgttaccggttcgggttacgggacggtaacggtactaacgtcgtaccgtacccgttactacgcgtaccgaccgttaccg

SEQ ID NO: 384576 - DNA, 610 bp, Homo sapiens
  misc_feature: GZ8MTXP02G7SWS.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcacgccgccctcagtgtcgtcggggccccagggcaggagggtcgccatctcctgcacgtgggtccacctccaatacgtcggggccgttatggtatgctctggtatcaacacgtcaggaactcggacccccaaaactcctacactctatcgctacgaacaaacactcccgaccttcgacgggtccctggtaccgttctcgtggctaccgagtcgtcggccttccttccgccttccgttcgccagtccacgtcgggcctcggacgctaggaccgatcggaggtctaggtacttaactacgttggtcttcgttaccctagtacgaacgaaccgtaacctaacgtacggtaccgtttccggggtttacgggacgggtaacggtactaaacggtccgtacgtacccggtacttaaacggccgtaaccggaccctaaccggg

SEQ ID NO: 384577 - DNA, 619 bp, Homo sapiens
  misc_feature: GZ8MTXP02JTGXX.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtggggccccagggcaggagggtcgccatctcctgcactcgggtccacctccaatagtcggggccgttatggtatgctctggtatcaacacgtcaggatcggacccccaaatcctcatctatgctagacaacatcgaccttcgacggggtccctggtaccggtttctcgtggccctaccagttcgtcggtccttccgttcccgccttccgttcggcctatccacgtcgggctcggacggctgacgagtggagtctgtaactttactacgtgttacctcgttacctagtcggaaccgaccgtaacctaacgacggttacccggtttccggggtttcgggacgggtaagggtactaacggccgtacggtacccgtccgtaaagtccgaccgacccgaaggcctcccggcccccgtcggtcctaccgttccttccggttaccccctaccccg

SEQ ID NO: 384578 - DNA, 673 bp, Homo sapiens
  misc_feature: GZ8MTXP02HJMVM.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtcgtcggggccccaggggcaggagggtcgccatctctgcacgtcgggtccacctcaatagtcggggccgttatggtatgtctcgtggtatcaacacgtcgagaatccggaccccaaatcctcatcctatgctagacaacatcccgactcgacgggtcctgtaccgttctcgtcgctcgagtcgtcgtcctccgtccctcctccgtttacgccctatcccgtacgtcggggtcccgtacggacggtcgtacggtaaccgtagttgggaacggtccgttaaggtaacttttaaccgttaacggttcgttaccgttcgtttccgttaacggtaacggtaaaccgaacccggttaaacctaccggtaacggttaacccgtttcccgggggtttacggggaccgggggtaaacggggtaaccgttaaacggcccgttaacggtaaccccggttacttaaaccggaccgtaaccggacccggtaaccggg

SEQ ID NO: 384579 - DNA, 687 bp, Homo sapiens
  misc_feature: GZ8MTXP02JHP0Y.11.75.G09.1.454.CMB.2.raw
  modified_base (271)..(271): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagcccgccctcagtgtcgtcgggggccccagggcaggagggtcgccatctcctgcactgggtccacctcaatagtcggggccgttatggtatgctntggtatacaacaacgtcgaggaactcggacccccaaactcctacactcgtatcgctagaacaaactaactccccgtaccttcgacgggtccctggtacccggttctccgtcggtacctaccgtaacgtccgtcggtcccttcccttcccggcccctttaccgttccggaccctaacgttcccgaacggttcgggggaccttccgggaagggtcccttagggaaccgtaaggttcgggaacggtcttagggtaaactttaccgtacttcggttccttcggttacctacgtacggaaaccggaccctacctaaacgacggttaaccgtttcccgggtttaacggaacgggtaacgggtaccctaaaggtccgtaacggtacccggtactaaaccggtccaccgggaccctaaaccggg

SEQ ID NO: 384580 - DNA, 600 bp, Homo sapiens
  misc_feature: GZ8MTXP02GT8DL.11.75.G09.1.454.CMB.2.raw
  modified_base (394)..(394): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagcccgccctcagtgtcgtcggggccccagggcaggagggtcgccatctcctgcactcgggtccacctcaatacgtcggggccgttatggtatgctctggtatcaaacacgtccaggaactcggacccccaaactcctcatctatgctgacaaacatcccgacctcgaggggtccctcgaccgttctcgtgctccagtctggctctccgcctcctgcctntcacgtcgggctcgagctgacgagtgacggtctagtacttacgtacttgtaccgttcgttcccttagtacgaacccgtaccgtaacccgtacgtaacggttacccgtttccgggggttttaccggggacgggtaacggggtaaccttaacggtccgtacgtaaccccgttaccgaaacggttccgaaaccggtccccgtaaacggg

SEQ ID NO: 384581 - DNA, 736 bp, Homo sapiens
  misc_feature: GZ8MTXP02FVVF9.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtggggccccagggcagagggtcgccatctcctgcacgtgggtccacctccaatagtcggggccgttatggtatgctctggtatcaacaacgtccaggaatcggacccccaaactcctcatctatgctgaacaacaatcgaccttcgacggggtccctgtaccggttctcgtggtccctaccgaagttcgtcggtccttccgtttcccgtcccttccgtttacgggccctaactccgtacgtcggggccttacggacggtcctaggacgaacgttggaacggtcgttagtaactttaccgtaacgttgttaccgttcgttacccttagttacggaacccgtaaccggtaaccttaacccgaggttacccgtttcccggggttttacggggaccgggtaaacggggtaacgttaaaacggcccgttacggtaacccggtttacccgttaaaacggttcccgaaaccggtaccccgtaaaacggggtcccctaacccggggtcccccccgtttcggggtacccctaacccgtttcccgtttaccccggtttccccccggttccccccg

SEQ ID NO: 384582 - DNA, 683 bp, Homo sapiens
  misc_feature: GZ8MTXP02IJCZP.11.75.G09.1.454.CMB.2.raw
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtcccacctcaatatcgggcgttatggtatgctctggtatcaacaacgtccaaggaactcggacccccaaaactcctacactctacttgctagacaaacaatcccgaccttcgacggggtccctgtacccggttctcgtcgcctaccgaacgttcgtggtccttccgtttcccgcccttcccgtttacggcccctaacgttccgaccggttccggggtccttaccgggaacgggtccttaggaaccggtaagtacgggtaacggggtccttagggtaactttaaccgtaccgtttcgttaccgttggttacccttagttacgggaaaccgaccggtaaccctaacgacggttacccggttacccggggttttccggggacgggtaaacggggtacccttaaaggccgttaccggtacccgttaccgtaaaagtccgaacggaccccgtaacggg

SEQ ID NO: 384583 - DNA, 594 bp, Homo sapiens
  misc_feature: GZ8MTXP02HO2ZK.11.75.G09.1.454.CMB.2.raw
  modified_base (214)..(214): a, c, t, g, unknown or other
  modified_base (448)..(448): a, c, t, g, unknown or other
  modified_base (451)..(451): a, c, t, g, unknown or other
  modified_base (503)..(503): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagcccgccctcagtgtctcggggccccagggcagaggtcnccatctcctgcactgggtccacctcaatagtcggggccgttatggtatgctgtgtatcaacgacgtccaggaactcggaccccctaaactcctacatctatcgctacgtacaactaactcccgtaccttcgacggggtccctcggtaccggttctcgtgcctaccgaagtccgtcggccttccgttcccgtccttcccgttcgccatccgacgtcggctcgagctggacagtgngtntagacgtttactcgtggttctgtccctagtacgaccgaaccgtaccgtaacncggtacccgttccggggtttacggaccggggtaggttaccctaaggtccgtaggtaccccgtacgttaacgccgtaaccggccctaacggg

SEQ ID NO: 384584 - DNA, 677 bp, Homo sapiens
  misc_feature: GZ8MTXP02JHVH5.11.75.G09.1.454.CMB.2.raw
  modified_base (186)..(186): a, c, t, g, unknown or other
  modified_base (514)..(514): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagcccgccctnagtgtcgtcggggccccagggcaggacgggtcgccatctcctgcacgtcgggtcccacctccaatacggtccggggtaccgttagtggtatgctctggtataccaacgaacgtcaggaactccgaccccctaactcctacatcctatcgctagaaccaaacaacgtacccgtaccgttaccggtaccggggttccccgttacggtacccggtttcctccggtcgggtacctaccgtaacgttccgtcggtccttcccgttcccccgtcccttcccgttcgggaccctaacgttcccgaacggttccggggaccttacgggaccgggtnttacggaaacggttaccgtagggaacgggttcctaggttaactttacgtacttcggtcgttctactagtacgaaccgtacgacctacgacgtcccggttcggttcgggacggtacgtacgtaacgccgtacgtaccgtaccgtaagccgtaccggactaccgg

SEQ ID NO: 384585 - DNA, 669 bp, Homo sapiens
  misc_feature: GZ8MTXP02IIMCP.11.75.G09.1.454.CMB.2.raw
  modified_base (212)..(212): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgcctcagtgtctgggccccagggcaggaggtcncatctcctgcactggtccacctcaatagtcggggccgttatggtatgctcgtggtactacaaccaacgtccgaaggaactcggaccccctaaatcctcatctatcgctacgacaaactatcccgtaccttcgacggggtccctggtaccgttctcgtggtcctccgaagttcctggtccttccgtcccgtcctccgttcggacctagtccctacggtcgggggtctacgggacgtaccgtaggacgtacgttgggacgggttacttacggtaatttacccgtaacgttcggtttacgttcgtacccgtttaagtaccgggtaaacccgtaaaccggtaaccctacgtaaaccgggttacccgtttacccgggggttttacggggacgggtaaaccgggttactaaacggtccgttacggaacccgttacgtaaacgtccgaacgtacccgtaacggg

SEQ ID NO: 384586 - DNA, 649 bp, Homo sapiens
  misc_feature: GZ8MTXP02HMUB5.11.75.G09.1.454.CMB.2.raw
  modified_base (250)..(250): a, c, t, g, unknown or other
  modified_base (369)..(369): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtggggccccagggcaggagggtcgccatctcctgcacgtcgggtccacctccaatagtcggggccgttatggtatgctntggtatcaacaacgtcaaggatcggacccccaaactcctcatctatgctagaacaacaatcgaccttcgacgggtcctgaccgttctcgtcggcctaccagtctcggtcttccgttccncccttccgttcggacccacttccgacgtggggtcctcggaggctaggacgagtggacggtcgtagtactttactacgttgttccgtgtttacctagttcggaaccgtaccgtaacctaacgtacgttaccggtttccgggtttacgggacgggtacgggtaactacggtcgttaccggtaccgttaaccgtagtaccgaaccggtcccgtaaaggtcccgtaacccggtcccccgttacggttaccctccgtttccgttacccgtttaccccgtaccccg

SEQ ID NO: 384587 - DNA, 669 bp, Homo sapiens
  misc_feature: GZ8MTXP02I6BBR.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgtcgcccagtctgcgctgacgcacgccgccctcagtcgtcgtcggggccccagggcaggagggtcgccatcctcctgccacgtcgggtacccaccctccaatacggtccggggtccggttagtgggttatcggcttcgtggtaataccaaactaaccgtccgaaaggtaactaccggaaccccccaaaactcctctatacctatcgctagaacaacactaccaccttcgaccgggtcctacgaccgttctcgtacgtctactacgtctggtcctccttcccgtcctcgttcgccctatcgtcgtcggctcgggacgtcgtagacgagtggtacggcttagtaacttaacctagttcgtccgttcgtacccttaagtacgaaccggttaaaccaccgttaaccggtaccgtttaacccggtttaccggggttttcgggaacccggggtaggtaaacgtaaccgttcgtaacgttaccccgggttaacctaaaacggttccaaaccggtacccccgg

SEQ ID NO: 384588 - DNA, 614 bp, Homo sapiens
  misc_feature: GZ8MTXP02JE3Z2.11.75.G09.1.454.CMB.2.raw
  modified_base (323)..(323): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagcccgccctcagtgtcgtcgggggccccagggcaggagggtcgccatctcctgcacgtcgggtccacctccaagtacgtccggggtccggttatggtatgctcgtggtactacaacacgtccaggaactccggacccccaaatcccnctatcctatcgcctagaccaaactaactcccgtaccttcgacggggtccctgtaccggttctcgtcggctccgagtctcggccttccgttcccgccttccttcggcctacgttccgacgtcgggtcgtcggagtcctagacgagtcgaggtctgtacttacgtcgttcgtctcgttacctatacgacccgaacgaccttactaacggttacccggtttccgggtttacggggcggtaacgggtacctaacggcgtaccgaccgttactaacgccgtaaccgccctaacggg

SEQ ID NO: 384589 - DNA, 643 bp, Homo sapiens
  misc_feature: GZ8MTXP02ICH2N.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacacgggtcctgggcccagtctgcgctgacgcagccgccctcagtgtcgtcggggccccagggcaggacgggtcgccatctcctgcacgtcgggtccacctcaatacgtcggggccgttatggtatgtctcgttggtactacaaacgaacgtaccaaggtaactccggaacccccctaaactcctacacttctatcgctacgaacaaacaactccccgaccgtttccgacggggttccctacggtaccgttctccgtcggtcctaccgtacgtcgtcgtcttcccttcccgtcctcccgttcgcctactcccgtacggtcgggtctcgggacggtcgtcgaacgtagtggacggtcgtagtacttaccttacgtcgttacttcgtacgtagtacgaccgtaaccgtaacctacgtacggttaccggtttccgggtttacggacgggaacggtactacggccgtacgtacccgtacgtaacgtccgacgtaccgaaccgg

SEQ ID NO: 384590 - DNA, 708 bp, Homo sapiens
  misc_feature: GZ8MTXP02FH4NA.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcaggagggtcgccatctcctgcacgtcggggtcccacctcccaatacgtcggggccgttatggtatgctctggtactcaacacgtccaggactcggacccccaaactcctcatctatgctgacaacaactcccgaccttcgacggggtcccctcggtacccggttctccgtcgggccttaccgtaacgttcctcgggtcccttccgttccccgtccctttacccgtttcgggacccctaagttcccgtaacgtcgggggtcccttaacgggtacgggccttacggaaccggtagttacgggaacgggttcccttaggttaaaccttttaaaccgtaccgttggttaccttcgggttaccccttagtacggtaacccgaaccgtaaccctacgaccggttaacccgtttcccgggggtttacgggaacgggtaacggggtaaccttaaaggcccgttacgggaaccccgttacgtaaacgttccaaccggtaccccgtaaacggg

SEQ ID NO: 384591 - DNA, 686 bp, Homo sapiens
  misc_feature: GZ8MTXP02HVFYC.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcacgcccgccctcagtgtccgtcggggccccagggcaggaggtcgccatcctcctgccacgtcggtcccacctacaatcggtccggggccgttagtggtatcgctcgtggtactaccaaacgacgtccgaaggtaactccggaaccccctaaaacctcctacacttactagtcgtactacgaaaccaaactaactccccgtaccttaccgaccggggtcccctggtacccgttctccgtcggtccctaccgtacgtccgtcggtacctttccctcccgtcccttccgttacggcctacttaccgtacggtcgggtctaccggacggtccgtacggtaacggtcgttagggacgtcgttaggtaccttaaccgttacgtcgttactcgtaccttagaccggtaacgaccgtaacctaacgacggttaaccgttccgggtttacggacggggtacgtaacgtacgaaccgttacgaacccgttacgtaaacgtaccgaccgtaccgtaacccgg

SEQ ID NO: 384592 - DNA, 630 bp, Homo sapiens
  misc_feature: GZ8MTXP02IP5PZ.11.75.G09.1.454.CMB.2.raw
  modified_base (248)..(248): a, c, t, g, unknown or other
  modified_base (282)..(282): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcacgccgccctcagtgtcgtcggggccccaggggcaggagggtcgccatctctgcactcgggtccacctcaatagtcgggcgttatggtatgctntgtatcaacacgtcagatcgaccccaactctacnctctatcgctagacaacaagtccgtaccttacgacggggtcctcggaccgttctcgtcgccctaccaagtcctggtcttccttcccgccttccgttcggcctacgtccgacgtcgggtcgtccggagcgttacgacgtagtggaggtctagtaactttacactgttcttcggttaaccagtacgtaacgacgtaacctacgacgttaccggttccggttacgggacgggaagtacgtaaagtccggtaccggttaccgttacggtaaactcgaaacccggtaccgaacggtcccgtaaccggtcccccgtcggttacctaccttccgttcccgtttaaccccctcccg

SEQ ID NO: 384593 - DNA, 359 bp, Homo sapiens
  misc_feature: GZ8MTXP02FY6QO.11.75.G09.1.454.CMB.2.raw
  modified_base (275)..(275): a, c, t, g, unknown or other
  modified_base (292)..(359): a, c, t, g, unknown or other
tcagcgagagataccacgaccggtgctcgatttagtatagacatcagggggtccctgaccggttctctggctccaagtctggctcttccgcctccttggccatcactgggctcgtaggctgacgatgaggctgattactactgtctgtcctatgacgacgacctacagactccggttttcggcggagggactaagctgaccgtcctaagtcagcccaaggctgccccctcggtcactctgtcccaccctcctcgtatctctcgctgagtcggggntggcaaggcgcatacgnnnnnnnnnnnnnnnnnnnnnnnnnnnnnnnnnnnnnnnnnnnnnnnnnnnnnnnnnnnnnnnnnnnn

SEQ ID NO: 384594 - DNA, 524 bp, Homo sapiens
  misc_feature: GZ8MTXP02HEJ6Z.11.75.G09.1.454.CMB.2.raw
  modified_base (395)..(395): a, c, t, g, unknown or other
  modified_base (432)..(432): a, c, t, g, unknown or other
  modified_base (490)..(490): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccggttatggtatgctctggtatcaacaacgtccaggaatcggacccccaaactcctcatctatgctgaacaaacaatcgaccttcaggggtccctgaccgttctcgtggccctccaagtctggctcttccgcctcttcgccatcacgtggctcgagctgacgangagctgattactatgtctgtctatgacacgactacgngacttccggtttcggcggtagggactaagctacgacctacaagtcacgaccaaggccncgcccctcggtccacgtcctccgttcccgtcccc

SEQ ID NO: 384595 - DNA, 698 bp, Homo sapiens
  misc_feature: GZ8MTXP02G6BD5.11.75.G09.1.454.CMB.2.raw
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagcccgccctcagtgtcgtcggggccccagggcaggagggtcgccatcctcctgcctacgtcgggcccacctccaagtcgtcggggccgttagtggtatgctcgtaggtactacaaacctacgtaccgaaggaactccggaccccctaaacctcctacatctatcgactacgaaccaaacaactccccgtaccttcgtaccggggtccctcggtaccggttctccgtcgcctaccgtacgtcgtcggcccttccgttccccgcccttacccgttcggaccctgtacccgtcggtccggggtcctacggtacggtccgtaacggacgtagttcggggacgttcttacgtactttacacgtttcgtcttcgttaccttaggtacggaacctacccgtaacgttaacgacggttacccggtttccggggttacggggaccgggtaaaacggttaccgttaacggccgttaaccggttacccccggttaacgtaacggtaccccgaccgtaaacccggtaacccggg

SEQ ID NO: 384596 - DNA, 722 bp, Homo sapiens
  misc_feature: GZ8MTXP02JOR3H.11.75.G09.1.454.CMB.2.raw
  modified_base (187)..(187): a, c, t, g, unknown or other
  modified_base (486)..(486): a, c, t, g, unknown or other
  modified_base (509)..(509): a, c, t, g, unknown or other
  modified_base (535)..(535): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcacgcccgccctnagtgtcgtcggggccccagggcaggacgggtcgccatcctccgtgcacgtcgggtccaccctcaacgtacggtccggggtccgttagtggtatcgtacctgtaggtactacgaaaccgaaccggtccgaaagggtaaccgtcccggaaccccctaaacctcctactacttcttaactcggtacctacgaactaaaccgtactccccgtaccgttaccggtacgggtccccctacggtacccgttctcgtccgggccttacgacgtcgtcggccttccctccgccttccgtcgcactcgngtcggctaggacgtcacgtacgngtacgcggttactagtacgtttaccngttcttacccggttgttacccgtaagttccgggaaaaccgtacccgtaaaccgtttaccggtacccggtttacccgggttttccgggggttaccgggaaaccggggttaacggggtaacccttaacggtccgtaccgttaacccgttaacggtaaccgttcccgaaacggtacccgttaaacccggg

SEQ ID NO: 384597 - DNA, 753 bp, Homo sapiens
  misc_feature: GZ8MTXP02FOPK4.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagcccgccctcagtgtcgtcggggccccaggggcaggagggtcgccatctcctgcacgtcgggtccacctaccaatacgtcggggtccgttatggcatgcttcgtggtatacaacgaacgtcaaggtaaactccggaaccccctaaactcctacacttactatcgctagaaccaaactactaccgtacccttcggacggggttcccctacggtaccggttctcgtccggtaccctaccgagtccgtggtcccttcgttccccgtcccgttccgttacggaccctacgtaccgtacggtcgggtacgttcgggacgtccgtaggaaccgtagtaggaccggtcttaacgtacttttaccgtacttcgttccgttacggtaccgttaacgttccgaaccggtaaccctaacccgtaacggttaccggtacccgggttttaccggggttaccggggaccggggtaacgggtaacgttaaccggcccgttacggtaaaccccggttaccgtaaacgttacccgaacccgtaccgtaaccggtccgtaccccggtacccccgttcgggtacccttaccgttccgtttccccggtttaccccccg

SEQ ID NO: 384598 - DNA, 634 bp, Homo sapiens
  misc_feature: GZ8MTXP02I2UEB.11.75.G09.1.454.CMB.2.raw
  modified_base (593)..(593): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgcctcagtgtctggggccccagggcagagggtcgccatctcctgcactgggtccacctcaatagtcggggccgttatggtatgctctggtatcaacacgtccaggactcggacccccaaactcctacatctatgctgaacaacatccgaccttcgacgggtccctcggaccgtttctctcggcctaccgaagttctcgggtcttcccgttcccgtccgttccgttcggaccctacgtccgtacgtggggtcctcggaggtcctaggacgagttggagtccgtagtactttaacgtacttgttaccgttcggttaccttagttcgaacccggtacgtaaccctacgacggttaccgtttccggggtttacgggcggtaagggtacctaaggtcctacgtaccgttaccgtaaacgtcacggacccgtaaggtcccncccggtcccctggtccctacgtccttcccgtaccccgtccc

SEQ ID NO: 384599 - DNA, 758 bp, Homo sapiens
  misc_feature: GZ8MTXP02FJIVH.11.75.G09.1.454.CMB.2.raw
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcacgtgggtccacctccaatagtcggggccgttatggtatgctctggtataccaacaacgtcaggaactcggacccccaaactcctcatctatgctgacaacatcgtacctcgacggggtccctcggtaccgttctcgtggccctaccgtaagtctcggtccttccttcccggtcccttccgttcggtcctacgttacccgacggttcggggtccttaccgggcgggtcccgttacgggaaccgtaggttacgggacggtcgttacgtaacttttacctaacgtttcgttaccgttacgttacccgttaagtacggaaccccggtaaaccgtaacccgttaaccgtaaccgggttacccggtttaccccgggggtttttaccgggggaccgggggtaaacggggtaacgttaaaaccggtcggttacccggtaacccggttaacccgttaaacggtaccgtaaacccgggtaccccgtaaacggtccccgtcccgggtccccccttcggggtaaccctaccccgtttccgtcccggtttaccccccgttcccccg

SEQ ID NO: 384600 - DNA, 696 bp, Homo sapiens
  misc_feature: GZ8MTXP02FG4I3.11.75.G09.1.454.CMB.2.raw
  modified_base (186)..(186): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagcccgccctnagtgtcgtcggggccccagggcaggagggtccgccattcctcctgccacggttcggtcccacctccaaagttcggtccggggtcgttagtcggttatgtcctcgtaggtactacaaactaacggtccaggactccgaccccctaaatcctcatctatcgactacgaactaactaacgtcccgtaccgttccgaggggttcccctacggtacccggttctccgcgccctacgacgttcgtcgtccgttacccgttccgtcccgttcccgttcggacctacgtccgtacggtcggtacgtcgggtacgtcgtacggtaccgaggttacggacgggtacttacgttaaaccgtttaccttaccgttacggttccttaccggttaccgttacgtaccggttaaccgaaccgtaaacccgttactaaccgggtaccgtttccggggttacgggaccgggtaacggtacgaacgtcgttacggacccgtactacggtacgtaccgacccgtaccgg

SEQ ID NO: 384601 - DNA, 651 bp, Homo sapiens
  misc_feature: GZ8MTXP02F8GRN.11.75.G09.1.454.CMB.2.raw
  modified_base (221)..(221): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcacgcccgccctcagtcgtcgtcggggccccagggcaggagggtccncgatctcctgcacgtcgggtccacctcaagtacgtccggggtccggttagtggtatgtctctggtactacaaacacgtccaaggactccggaccccaactcctacactctatcgactgaaccaaactaactccccgtacccgtcgacggggtcccctcggtacccgttctcgtcgtactaccgtacgtcgtcgtcctcctcccgtacctccgttcgcctagtcacggtcgctcgagtctagataggcgaggtacctaggtacttttaccgacgtttcggtcttacggtccttaacgacgggtaaacccgaaccgtacccgtaaacgtacgggttaccccgtttaccgggggtttaccgggaccgggtaacgggtaaccttacggtcgttacccgtaccgttacgtacgtaccggaccgaccgtaaaccgg

SEQ ID NO: 384602 - DNA, 612 bp, Homo sapiens
  misc_feature: GZ8MTXP02GLHFW.11.75.G09.1.454.CMB.2.raw
  modified_base (371)..(371): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtcgtcggggccccagggccaggagggtccgccatctcctgcacgtcggtccacctcaatacgtccggggcgttagtggtatgctcgtggtatacaaacacgtccaggaactcggacccccaaactcctcatctatcgctagacaaacactcccgtaccttcgacgggtcctgtaccggttcncgtgcctacgagtcgtcgccttccttccgccttaccgttgcctagtcacgtcgggacttcggacgtccgtagacgtagtcgagggtcttagtacgtttaacctacgttggtcttacggttaccctagtaggaaccgtaaccggtacttaccgtagtacccgggtttacgggtttccgggacgggttaacgggacttaacggaacgttccgaccgttacttaacgccaccggtcaaaccggg

SEQ ID NO: 384603 - DNA, 689 bp, Homo sapiens
  misc_feature: GZ8MTXP02IL24V.11.75.G09.1.454.CMB.2.raw
  modified_base (196)..(196): a, c, t, g, unknown or other
  modified_base (273)..(273): a, c, t, g, unknown or other
  modified_base (596)..(596): a, c, t, g, unknown or other
  modified_base (632)..(632): a, c, t, g, unknown or other
  modified_base (669)..(669): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagcccgccctcagtgtccgtggggccccagggcagagggtcnccatctcctgcacgtcggtccacctcaatagtcggggccgttatggtatgctgtgtatacaactacgtacgaggacnccggaccccaaactcctactacttctatcgacgtacgaaacctaaacaacgtaccgtaccgttacccgggtacggggttacccccgttacggttacccggtttcgtccgtcgggtaccccctacccgtaacgtcgtaccggtcctttcccgtcccgtcccgttccgtccgggtaccctacgtaccgtacggtcgggtccgtacggacggtccgtaggaccgtagtcggaacggtcttacgttaacttactacgttcgttcctacggttacctaggtaccgtaccgtacgtaacctacggtacgttacggttccggttacgggnggtacggacgtaacgtccgtacgaccgtacgtaacncgtacgaacccgtcgtccgtaacccgcccttcgaccncgttctccgtaccccgtccc

SEQ ID NO: 384604 - DNA, 644 bp, Homo sapiens
  misc_feature: GZ8MTXP02GT8XX.11.75.G09.1.454.CMB.2.raw
  modified_base (186)..(186): a, c, t, g, unknown or other
  modified_base (216)..(216): a, c, t, g, unknown or other
tcagcgagagataccacgaccggtgctcgatttagtatagacatcagggggctctgcttcagctgtgggcacaagaggcagcactcaggacaatctccaacatggcctggtctcctctcctcctcactctcctcgctcactgcacgagggtcctgggcccagtctgcgctgacgcagcccgccctnagtgtcgtcgggccccagggcaggaggtcnccatcctcgtgcacgtcggccacctccaagtcggtcggggccggttatggtatcgactcgtggtaactccgaaacgacgtaccgaggtaacgtccggacccccctaaactccctctactccttagtcgaccgtagaaaccaaacgtaacgttcccccgtaccgttcggacggggttcccctacggtacccggttctccgtcgggcctaccgaagttcgtcggccttccgttcccgtccgttccgttcgacctatcccgacgttcgggctacggtacgcgtaggaccgtaggtacggacggtcctaggttacttaccggtactcgtcgttacgtactagtcgaacgtaccgtaacctagtacggtaccgtttcggttacgggacgtacggatacgtcgtaccgaccgtctacgacgtacgaaccgtacg

SEQ ID NO: 384605 - DNA, 640 bp, Homo sapiens
  misc_feature: GZ8MTXP02GF5P6.11.75.G09.1.454.CMB.2.raw
  modified_base (225)..(225): a, c, t, g, unknown or other
  modified_base (236)..(236): a, c, t, g, unknown or other
  modified_base (291)..(291): a, c, t, g, unknown or other
tcagcgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtcgtggggccccagggcagagggtcgccatctcctgcacgtgggtccactccaatancggggcgttanggtatgctctggtatacaacaacggtccaaggaatcggaccccccaaaatcccanaagtctaatgctagaacaaacaaatcgacccttgaacggggtcctcgtaccggttactcgtggcccctacgaacgtctcggtcttccttccgggccctccgtttggccctaatccgaacgtttcgggggaccttcgggagtccgtagaacgattgaacggtctagtaacttactacgtgtactcgtaacttacgtagaaccgtacgaactaaccgtagaacggtttcccggtttcggggagaaggggtaactaacgtacgtacgacccgtaacgtaaacgttacaccggaaccctaagggccctaacgccccccgttagtacctaacgtcttcggtacccccttacccg

SEQ ID NO: 384606 - DNA, 292 bp, Homo sapiens
  misc_feature: GZ8MTXP02HCPIX.11.75.G09.1.454.CMB.2.raw
  modified_base (288)..(292): a, c, t, g, unknown or other
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagacgtccggtttcggcggagggactaagctgaccgtcctaagtcagccaagctcgcccctggtcactctcgtcccaccctcctgtactctctcgctggagcgggctggacgaaggcgcaatgnnnnn

SEQ ID NO: 384607 - DNA, 756 bp, Homo sapiens
  misc_feature: GZ8MTXP02HC65N.11.75.G09.1.454.CMB.2.raw
  modified_base (221)..(221): a, c, t, g, unknown or other
tcagcgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgtgcccagtctgcgctgacgcacgcccgcctcagtcgtcgtcgggccccgagggcgaggacgggtcnccgatcctccgtgccacgtcgggtcccaccgtaccaagtacggtccggggtaccgttagtggttatcgtctcgtaggtactacaaaccgaccgtaccgaaggaacgtcccggaacccccaaaactcccgtactactctaagtcgactacgaaccaactaaccgtccgtaccgttcgacggggttccctcggtacccggttctcgtcggtcctaccgtacgtcgtaccgtccttccgttcccgacccgtttccgttcggaccttaccgtacgtaccgggtcggtaccgtacggacggtaccgtcggtaaaccgtggtcggtacggttaccgttaggttaaacctttacgttacccgttacgtttccgttacgtttaacccgttagtaaccggtaacccggtaaccgtaaaaccccggtttactacccgggggtttacccggtttccccgggggttttacgggaccggggttaacgtaacggttaaccgtaccggttaccggtacccgttaacgttaccgtacgaaacccggtcccg

SEQ ID NO: 384608 - DNA, 617 bp, Homo sapiens
  misc_feature: GZ8MTXP01CD6LT.41.55.E11.1.454.CMB.2.raw
  modified_base (271)..(271): a, c, t, g, unknown or other
  modified_base (295)..(295): a, c, t, g, unknown or other
  modified_base (327)..(327): a, c, t, g, unknown or other
  modified_base (352)..(352): a, c, t, g, unknown or other
  modified_base (503)..(503): a, c, t, g, unknown or other
  modified_base (521)..(521): a, c, t, g, unknown or other
tcagtctatactatcacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctggctcaccgtnagcagcaactacatgagtggtccncaggctcgagggaagggctgggagtgggtctnagtcatttatactggtgtatttcanactaactacgcagtacctccggtagaacggggccattccaccctagttcaccgagggaactaactttacccgaagggtaaactacggtttatacttaacgaaatacgaacgaaaccttggacgacggacgacgaacgaccgggtacccttnttaaccgttacgttcggngaaccggaagacgaaacggttccggacggtcgttaccgggttgttacggtttaattacgtttcgttagtacgttcgtcggggaacgtaacccgggg

SEQ ID NO: 384609 - DNA, 519 bp, Homo sapiens
  misc_feature: GZ8MTXP02IXKO8.41.55.E11.1.454.CMB.2.raw
  modified_base (486)..(486): a, c, t, g, unknown or other
tcagtctatactatcacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttggtccgcaggctccgaggggaaggggctggagtgggtctcacgtattaatagtgagtgggatagcacaagctacggcggactccggtgaagggccgattcacatctccagagacaacgcccaagaacacgctgtatctgacaaatcgaacagtctagagagaccgaggaacacggctgtgtattacgtgtgcaaagngaccggtgcgggagttcggggattgcattaacg

SEQ ID NO: 384610 - DNA, 585 bp, Homo sapiens
  misc_feature: GZ8MTXP02HULFD.41.55.E11.1.454.CMB.2.raw
  modified_base (253)..(253): a, c, t, g, unknown or other
  modified_base (258)..(258): a, c, t, g, unknown or other
  modified_base (447)..(447): a, c, t, g, unknown or other
tcagtctatactatcacgaccggtgctcgatttagcactcgcacgttgggtttggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcngcctntgggctcaccgtcagcagcaactacatgagttgggtccgccaggctccaggggaaggggctgggagtgggtctcagtctatttatactgggtgattttcactatacctacgcaagactccgttggaaaggggcccgattccaccatcctaccaggggactaattcccagggtaactacggtttatctanaaatgaaacaaccgtgagaggccgacgacacgggcctactattactgtcgacgagaacgaacgtcggcgcgtacgggtagttgggttaatttactttcggtttacgacgttttcggcgggggtccgtaaacccggggg

SEQ ID NO: 384611 - DNA, 386 bp, Homo sapiens
  misc_feature: GZ8MTXP01EXJ2M.3.9.A09.1.454.CMB.2.raw
  modified_base (215)..(215): a, c, t, g, unknown or other
  modified_base (306)..(306): a, c, t, g, unknown or other
  modified_base (365)..(365): a, c, t, g, unknown or other
  modified_base (376)..(376): a, c, t, g, unknown or other
  modified_base (381)..(386): a, c, t, g, unknown or other
tcagagacgcactccacgaccggtgctcgattagcgagacgcgcagggccagtcagactgttgtctccaactacttagcctggcaccaacagaggcctggccaggctcccaggctcctcatctatggtgcttccagcagggcccctggcatcccagacaggttcagtggcagtgggtctgggacagacttcactctcaccatcagcagactggancctgaagatgttgctgtgtattactgtcatcagtataataactctccgctcactttcggcggaggaccaaagtggagctcagacgaactgnggctgcaccatctgtctcacttccttcccgctatctgagtagtcgctctctgagcgggntggcaaggcgnatagnnnnnn

SEQ ID NO: 384612 - DNA, 404 bp, Homo sapiens
  misc_feature: GZ8MTXP01DJWH1.3.9.A09.1.454.CMB.2.raw
  modified_base (391)..(395): a, c, t, g, unknown or other
  modified_base (397)..(404): a, c, t, g, unknown or other
tcagagacgcactccacgaccggtgctcgattagcgagacgcgcagggccagtcagactgttgtctccaactacttagcctggcaccaacagaggcctggccaggctcccaggctcctcatctatggtgcttccagcagggcccctggcatcccagacaggttcagtggcagtgggtctgggacagacttcactctcaccatcagcagactggagcctgaagatgttgctgtgtattactgtcatcagtataataactctccgctctactttcggcggagggaccaaaggtggagctcgagacgtaactgtggctgcaccatctgtcttcattcccttcccgcactcagagagtgcgtctcgtgacggcggctgggccaaggcgacatagnnnnngnnnnnnnn

SEQ ID NO: 384613 - DNA, 383 bp, Homo sapiens
  misc_feature: GZ8MTXP02HAZEM.3.9.A09.1.454.CMB.2.raw
  modified_base (378)..(383): a, c, t, g, unknown or other
tcagagacgcactccacgaccggtgctcgattagcgagacgcgcagggccagtcagactgttgtctccaactacttagcctggcaccaacagaggcctggccaggctcccaggctcctcatctatggtgcttccagcagggcccctggcatcccagacaggttcagtggcagtgggtctgggacagacttcactctcaccatcagcagactggagcctgaagatgttgctgtgtattactgtcatcagtataataactctccgctcactttcggcggtagggaccaaagtggagctcagacgaactgtgctgcaccatctgtcttcatcttcccgccatctgagagtgctctctgagcgggctggcaaggcgcatagnnnnnn

SEQ ID NO: 384614 - DNA, 389 bp, Homo sapiens
  misc_feature: GZ8MTXP02IXN70.3.9.A09.1.454.CMB.2.raw
  modified_base (258)..(258): a, c, t, g, unknown or other
  modified_base (384)..(389): a, c, t, g, unknown or other
tcagagacgcactccacgaccggtgctcgattagcgagacgcgcagggccagtcagactgttgtctccaactacttagcctggcaccaacagaggcctggccaggctcccaggctcctcatctatggtgcttccagcagggcccctggcatcccagacaggttcagtggcagtggtctgggacagacttcactctcaccatcagcagactggagcctgaagatgttgctgtgtattactgtcatcagtataataactntccgctcactttcggcggagggaccaaagtggagctcagacaactgtggctgcaccatctgtcttcattccttcccgcatctgagagttgcgtctctgtagcgggcgtggccgaaggccgcatagnnnnnn

SEQ ID NO: 384615 - DNA, 388 bp, Homo sapiens
  misc_feature: GZ8MTXP02HXIIT.3.9.A09.1.454.CMB.2.raw
  modified_base (263)..(263): a, c, t, g, unknown or other
  modified_base (339)..(339): a, c, t, g, unknown or other
  modified_base (368)..(368): a, c, t, g, unknown or other
  modified_base (381)..(381): a, c, t, g, unknown or other
  modified_base (384)..(388): a, c, t, g, unknown or other
tcagagacgcactccacgaccggtgctcgattagcgagacgcgcagggccagtcagactgttgtctccaactacttagcctggcaccaacagaggcctggccaggctcccaggctcctcatctatggtgcttccagcagggcccctggcatcccagacaggttcagtggcagtgggtctgggacagacttcactctcaccatcagcagactggagcctgaagatgttgctgtgtatactgtcatcagtataataactctccgntcactttcggcggaagggaccaaaagtggaagctcagacgaaactgtggctgcaccatctgtcttcatcgttcccnccatctgagagtgcgtctctgagcggcgnggcgaagacgcanagnnnnn

SEQ ID NO: 384616 - DNA, 482 bp, Homo sapiens
  misc_feature: GZ8MTXP02FMOHI.3.9.A09.1.454.CMB.2.raw
  modified_base (402)..(402): a, c, t, g, unknown or other
  modified_base (455)..(455): a, c, t, g, unknown or other
  modified_base (466)..(466): a, c, t, g, unknown or other
  modified_base (468)..(468): a, c, t, g, unknown or other
  modified_base (471)..(482): a, c, t, g, unknown or other
tcagagacgcactccacgaccggtgctcgattagcgagacgcgcagggccagtcagactgttgtctccaactacttagcctggcaccaacagaggcctggccaggctcccagtctcctcatctatggtgcctccagcagggcccctggcatcccagacaggttcagtggcagtgggtctgggacagacttcactctcaccatcagcagactggagccgtagaattattgactagttagttacttagtgtacggtagtacttagttacgttacctaccgtacccgttcgttacgacgtttcgttccgaccgggtaacgggaaacggtaagggtaggaagtacgtaaaacgtaaaaccgtaagtgggtacgtcgtcgaaccactacttcgtccgttcttaactnttccccgttccactacttcgagaagtgccggtctcgtgacgcgggtcggtcgngaacgacgggnanagnnnnnnnnnnnn

SEQ ID NO: 384617 - DNA, 617 bp, Homo sapiens
  misc_feature: GZ8MTXP01CTPVX.10.33.C11.1.454.CMB.2.raw
  modified_base (201)..(201): a, c, t, g, unknown or other
  modified_base (225)..(225): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatcctccctgtatgcatctgtagganacagcgtcaccatcacttgccggnagtcagacattacaagtcttaaatggtatcagcaagaaaccagggaacgacccctaaactcctagatctacgatgacatacgaacttaggaaactaggggtacccagtaccaaggttcaggtggaggtgatcgtagggactaggtatttacgctcggcactccgcacgcctgcagcctagaagtatttgacgtaactattaatttactgttaacaaactagtaatacgaaaattcggtaccctcgtaccgtaccggtttccgggggaacggggggtaaccgaaacgggggttacggaacggtttaaaccgaaacggttaaaccgttggggttacggtaaccgtacggtaacccgtaaacccgtacttaccgttcggttccgttttaaccccg

SEQ ID NO: 384618 - DNA, 532 bp, Homo sapiens
  misc_feature: GZ8MTXP01D66NW.10.33.C11.1.454.CMB.2.raw
  modified_base (252)..(252): a, c, t, g, unknown or other
  modified_base (372)..(372): a, c, t, g, unknown or other
tcagcatagtagtgcacgaccggtgctcgatttagagtgagctcgttgggtttggggagtcagtcccaaccaggacacagcatggacatgagggtccctgctcagctcctggggctcctgctccctctggctctcgggtgtcagatgtgacatccagatgacccagtcctccatcctccctgtatgcatctgtaggagacagcgtcaccatcacttgccgggcagtcaggacatttacaagtcttaatgtancagcagaaaccagggaacggacccctaaactcctgatctacgatgacatacgaactttggaaacaggggtcccagtacaaggttccaggtggaggtggatcgtgggaactagtatttacnctcggcatccgcagcctgcagcctagagtatttgcgactatattactaggtcaaactagtatagtaaatcgtcccgtactcgtacgtttcgggcgggggtataacgtaagggttggacgttacgaaacgtaacttggttgctgcaacatcttgtcttctc

SEQ ID NO: 384619 - DNA, 603 bp, Homo sapiens
  misc_feature: GZ8MTXP01D8AZA.10.33.C11.1.454.CMB.2.raw
  modified_base (395)..(395): a, c, t, g, unknown or other
  modified_base (411)..(411): a, c, t, g, unknown or other
  modified_base (416)..(416): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtcctccatcctccctgtatgcatctgtaggagacagcgtcaccatcacgtgccgggcagtcaaggactatttaacaagttactttaaatggtatcagacaagaaaccgaggaacgacccctaaatcctagatctacgatgacagtacgaaacgttaggaaacgcggggtacccatacccgaaaggttcaggtggaggtagatcgtagggactaggttacttttacncgtcgctactcccganacgcncgacgacgactagtagtagttagtacgtatattacgttactacgtaactaaacgtaagtaagtaagtaacgtacgtccgtccgtacgtaccgggttcggggtaacggggtaacggttaaggtacgggttaacgtaacgtaacgttaacgttgttcgtcgtacgaactactacttcttcgttcgttcg

SEQ ID NO: 384620 - DNA, 640 bp, Homo sapiens
  misc_feature: GZ8MTXP01BIG3E.10.33.C11.1.454.CMB.2.raw
  modified_base (222)..(222): a, c, t, g, unknown or other
  modified_base (251)..(251): a, c, t, g, unknown or other
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggnagtcaggactattacaagtcttaaatgancagcagaaaccagggaacgcccctaaatccagactctacgatcgacagtacgaaacgtttaggaaaccgagggggttacccaagtacgtaaaggttccagggtgggaggtggatcgtgggaactaggttacttttactcgtcgggacacgtcccgacgacgccctgcacgaccgttagaagttagtttgacgactattattacgtggtaactaagtaagttaagtaagtaaaacgttccggtaccccgtacgttacgtaccgggttttaccgggggaccgggggtaaccgtaaggggtacggttaacggtttaaccaaacggtaaccgttggttacgggttcttacggaactacctaacgttctacgttccttcgttaacgtttccccg

SEQ ID NO: 384621 - DNA, 649 bp, Homo sapiens
  misc_feature: GZ8MTXP01BDTW0.10.33.C11.1.454.CMB.2.raw
  modified_base (226)..(226): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtcctccatcctcctgtatgcatctgtaggagacagcgtcaccatcacttggccgggnagtcaggactatttacaagtactttaaatggtatcagcaagaaaccagggaacgcccctaaactcctgatctacgatgcatcgaacgttaggaaacaggggtccagtaccaaggtcaggtggaggtagatcgtggggaacagttacttttactcgtcgggcactccgcacgccctgccagtcctaggtaacgtatttcggactaactacttaatttacgtagttaccaaacgtaggttaaatagtaaaattcggttaccccgtacgttaccgtaaccggttttcgggggaaccggggggtaacccgttaaaggggttacgggttaacggtttaaacccgaaaaaggttacccgttagggttcgggtaaccttacgggaaccgtaacccgtaacgtttcccttaacggtttcccgtttaacccg

SEQ ID NO: 384622 - DNA, 583 bp, Homo sapiens
  misc_feature: GZ8MTXP01BJAAB.10.33.C11.1.454.CMB.2.raw
  modified_base (226)..(226): a, c, t, g, unknown or other
  modified_base (316)..(316): a, c, t, g, unknown or other
  modified_base (351)..(351): a, c, t, g, unknown or other
  modified_base (367)..(367): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggngagtcaggacattacaagtcttaaatggtatcagcagaaaccagggaacgcccctaaatcctgatctacgatgcatcgaacttggaaacnggggtcccatccaaggttcagtggaggtggatcgngggacagtattttacncgtcggcatccgcacgcctgcagcctagaagtatttgcgactatagttactgtacaactagtaatagaaaatcgtacccgtcttaccgtacgtttcggggaacggggggtaaccgttaaaggggtcgggttaacggtttaacgaaaacggttaaaccgttggttacgggtaactcggaacctaacccgtaacttccgttcggtttccgtttaaccg

SEQ ID NO: 384623 - DNA, 662 bp, Homo sapiens
  misc_feature: GZ8MTXP01DNZAS.10.33.C11.1.454.CMB.2.raw
  modified_base (200)..(200): a, c, t, g, unknown or other
  modified_base (225)..(225): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctccctgtatgcatctgtagganacagcgtcaccatcacttgccgggnagtcaggacatttacaagtcttaaatggtatcagcaagaaaccaggaacgacccctaaatcctagatctaacgatgacatacgaaacgttaggaaaacgtacgggggtaccccaagtaccccgaaaagggtttcgaaggtggggaaggtagggaattcgtaggggaaacctaggttaactttttaccgcgttacgggctaacttcccggacaacggccctggcaacggcccttaggaaagttactttggaccgtaataattaatttacgttagtactaaacagttaataaggtaaaactcggtacccctacgttaccgtaacggtttccgggggaacggggggtaaccaaagggggttagaacgtttaaaccgaaaacgttaaccgttggttacgggcttaggaaccctaactacttcggttcgttaacctttcccg

SEQ ID NO: 384624 - DNA, 702 bp, Homo sapiens
  misc_feature: GZ8MTXP01ET4EM.10.33.C11.1.454.CMB.2.raw
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtcctccatcctccctgtatgcatctgtaggagacagcgtcaccatcacttggccgggcagtcaggacatttacaagttactttaaatggtatcagacaagaaaccagggaacgacccctaaactcctgatctacgatgacatacgtaacgttaggaaacgacggggtacccagtaccgtaaagggtttcgaggtagggagggtagggtagttcggtaggggaacctaaggttactttttaccgtcgtcgggactactccgccgacgtccgtcgacgacgtaccgtacgtaagtagtttacgtacgtaactaacttaactttaacgttacgttaacctaaacgtaagttaagtaagtaaaacgttaccgttacccgtaccgttaccgttaccggtttaccgggggtaaccggggggtaacccgggttaaagggggttacgggttaacggttaaaccgtaaaacggttaaccgttagggttacgggtaaccgtcggaaccgtaccgtaacttcgggggttaactttcgtttcccg

SEQ ID NO: 384625 - DNA, 664 bp, Homo sapiens
  misc_feature: GZ8MTXP01DZBJB.10.33.C11.1.454.CMB.2.raw
  modified_base (223)..(223): a, c, t, g, unknown or other
  modified_base (356)..(356): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctccctgtatgcatctgtagagacagcgtcaccatcacttgccggnagtcaggacattacaagtcttaaatggtatcagcaagaaaccagggaacgcccctaaatcctagatctacgatgcatacgaacttaggaaacacggggtcccagtaccaaggttcaggtggaggtaggatcgngggacagtactttacgcgtcggcactccgcacggcctgactaacgccttagaaagttagttttacgacgtaactaactttaacgtttaaccttggtaacctaaaacgtaagttaaacgttaaggtaaaaacttccggtaccccgtacgttaccgtaccgggttttaccgggggaacggggggtaacccgttaaaggggttcgggttaaacggtttaaaccgaaaaccgggttaaaccgttggggttaacggtcccgttagggaaccctaacccgtaacttacccggtttcggtttcccttttaacccg

SEQ ID NO: 384626 - DNA, 617 bp, Homo sapiens
  misc_feature: GZ8MTXP01DIEAL.10.33.C11.1.454.CMB.2.raw
  modified_base (389)..(389): a, c, t, g, unknown or other
  modified_base (423)..(423): a, c, t, g, unknown or other
  modified_base (454)..(454): a, c, t, g, unknown or other
  modified_base (591)..(591): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttggccgggcagtcaaggactatttacaagtactttaaatggtatcagacaagaaaccgagggaacgacccctaaaatcctagatctacgatgctatcgaaacttggaaaacgacggggtcccataccgaaggttcaggtggaggtggaatcgtagggactagttactttacncgtcggcatccgcagcctgcaagcctagtaagtntttgactaatacttattaactgtaaccaaanagttaatagtaaacgttcgtcccgtcgttaccgtaccggttttccgggggaacgggggtaaccttaaagggggttcggttaacggttaaaccgaaacggttaaccgtttgggttacggcgttacggaaccttaaccncgttaccttcggttccgtttaacccg

SEQ ID NO: 384627 - DNA, 557 bp, Homo sapiens
  misc_feature: GZ8MTXP01EQ94H.10.33.C11.1.454.CMB.2.raw
  modified_base (227)..(227): a, c, t, g, unknown or other
  modified_base (473)..(473): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttggccgggngagtcagactattacaagttctttaaatggtatcagacaagaaaccagggaacgcccctaaactcctgatctacgatgcatcgaacttaggaaacgacggggtacccagtaccgaaggttcaggtggaggtaggatcgtagggactagtattttactcgtcgggtcatccgacagcctgcacgcctagaagtatttgacgtactaattagttacttgtacaaacagtaatagtaaatcgtcccgtntacgtacggttcggggaacgggggtaacagggtaggttagtacaaacggacgttggttacggctgccactattctcgttcttcc

SEQ ID NO: 384628 - DNA, 510 bp, Homo sapiens
  misc_feature: GZ8MTXP01BHCUO.10.33.C11.1.454.CMB.2.raw
  modified_base (316)..(316): a, c, t, g, unknown or other
  modified_base (365)..(365): a, c, t, g, unknown or other
  modified_base (404)..(404): a, c, t, g, unknown or other
  modified_base (419)..(419): a, c, t, g, unknown or other
  modified_base (424)..(424): a, c, t, g, unknown or other
  modified_base (491)..(491): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctcctgtatgcatctgtaggagacagcgtcaccatcacttgccgggcagtcaggacatttacaagtcttaaatggtatcagcaagaaaccagggaacgcccctaaatcctagatctacgatgcatcgaacttggaaacnggggtcccatccaaggttcagtgaggtgatcgtgggacagtattttacnctcggcatccgcagcctgcagcctagaagtatttgcganatattactgtacaanagtangtaaatcgtaccgctcgacgtttcgggaacgggggtacaagggtgagttacaaacgacgttgttggntcgcacattcttcgttctc

SEQ ID NO: 384629 - DNA, 802 bp, Homo sapiens
  misc_feature: GZ8MTXP01DYF9I.10.33.C11.1.454.CMB.2.raw
tcagcatagtagtgcacgaccggtgctcgatttagagtgagctcgttgggtttgggggcaggagtcacgtcccaaccaggacacagcatggacatggacgggtccctgctcagctccgtggggctcctgctcctctggctcgtcgggtgtcagatgtgacatccagatcgacccagtcctccactccctcctgtatgcatctggtaggagacagcgtacaccatcacgttcggccgggagagtcgaggactatttaacaagttactttaaagtggtatcgagacaacgaaaccgagggaaccgtacccctaaactcctagataccgtaacgatacgactaacgttaacggtaaacgtttacggaaaaccggtacgggggtacccccaagttaccccggtaaaacgggtttcgaagggggttacgggaaggggttaacgggtaacttccgggggtaggggaaacttaaggtttacttttttaacccgccggtacgggacctacgttacccggactacgtccgtacgaccgaacggtaccgttaaggtaaacggtttatttacgggaccgtaaacgttaatttaacgtttaacgttaacggttaaccaaaacgttaaggttaaataaacggttaaaacgtttcccggtaaccccgttaccgttacccgttaccggggtttaccgggggaaccggggggtaaacccgttaagggggttacggttaaacgttaaaccggtaaaacggttaacgttcggttacgggtcgttacgccgtaacctacgttccttcgtttccgttaaccg

SEQ ID NO: 384630 - DNA, 628 bp, Homo sapiens
  misc_feature: GZ8MTXP01DEX3A.10.33.C11.1.454.CMB.2.raw
  modified_base (226)..(226): a, c, t, g, unknown or other
  modified_base (381)..(381): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatccctcctgtatgcatctgtaggagacagcgtcacatcacttggccgggnagtcagacattacaagtctttaaatggtatcagacaagaaaccgagggaacgacccctaaatcctgactctacgatgacatacgaacgttaggaaacacggggtacccagtaccgaaggttcaggtggaggtgatcgtgggaactagtatttacncgtcggcatcgcagcctgcagcctagaacgtatttcgacgtactaattaattacgtagtacaaacgtagttaataaggtaaacttccgtcccgtacttaccgtaccgggtttcgggggaacccggggggtaacttaaagggggttacgggttaaacgtttaaaccggaaaacggttaaccggttgggttaacggtcccgtaaggtcccgtaacctaacgttccgtttaacggttcccgtttaacccg

SEQ ID NO: 384631 - DNA, 573 bp, Homo sapiens
  misc_feature: GZ8MTXP01EE93L.10.33.C11.1.454.CMB.2.raw
  modified_base (226)..(226): a, c, t, g, unknown or other
  modified_base (329)..(329): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatcctcctgtatgcatctgtaggagacagcgtcaccatcacttggccgggnagtcaggactatttaacaagttactttaaatggtatcagacaagaaaccagggaacgtaccccaaatcctagatctacgatgctatacgtaacttaggaaacnggggtacccaataccgaaggtttcaggtgggaggtcgaatcgtagggaactaggttacttttacgctacgggacactcccgacacgcctgctaacgccgtagtaagtatttcgacgtaactattacgttactagtacaaatagtaatagtaaatcgtccgtctacgtacgttcggggaacggggaacttaggggtcgttagttacaaacgttacgttgttaggtcctgccacattctgttctcc

SEQ ID NO: 384632 - DNA, 650 bp, Homo sapiens
  misc_feature: GZ8MTXP01DKGUP.10.33.C11.1.454.CMB.2.raw
  modified_base (201)..(201): a, c, t, g, unknown or other
  modified_base (227)..(227): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatcctccctgtatgcatctgtagganacagcgtcaccatcacttggccgggnagtcaggactattacaagttacttaaatggtatcagacaagaaaccgagggaacgacccctaaactcctagactctaacgatcgactaagtacgaaacgttacggaaaaccgtacgggggttaccccaagttaccccgtaaagggttcaagggtgggaagggtaggtaagtcggtagggacctaagttacttttacgcgttcgggactacgtccgcgacgcctgacgacgtcctagaacgtatttgacgtaactattaacttactagtacaactaagtaagtaacgtaaaactccgtacccgtcgtaccgttaccgggttccggggaacgggggtaaccgaaagggtaggttaacgtaaccgtaaacgttaacgttggttacgggctacggaaccgtaacctattccgttcgttcgtttaacc

SEQ ID NO: 384633 - DNA, 684 bp, Homo sapiens
  misc_feature: GZ8MTXP01CIA8B.10.33.C11.1.454.CMB.2.raw
  modified_base (229)..(229): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtcctccatccctccctgtatgcatctgtaggagacagcgtcaccatcacgttggccgggngagtcaggactatttacaagttcttaaagtggtatcagacaagaaaccgagggaacgtacccctaaactcctagatctacgatgactagtacgaacgttacggaaacgtacgggggtaccccaagtacccgtaaagggttcgaagggttagggagggttaacgggattcggtaggggtaacctagggttacttttaccgtcgtacgggactacgtcccgacgacggtccctgaccgtacgtccgtaggtaacgttagtttcgaccgtaactaatttacttacgtagttaccaaacgtagttaactaacgaaacgttccgtacccgtcgttaccgttaccgggtttcgggggaaccgggggtaacttagggggtacggttaacggtttaacgaaacggttaacgttggttacgggtcctacggtaacctaccgtagttccgtcgttcctttaaccg

SEQ ID NO: 384634 - DNA, 574 bp, Homo sapiens
  misc_feature: GZ8MTXP01D5QUK.10.33.C11.1.454.CMB.2.raw
  modified_base (224)..(224): a, c, t, g, unknown or other
  modified_base (387)..(387): a, c, t, g, unknown or other
  modified_base (557)..(557): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatcctcctgtatgcatctgtagagacagcgtcaccatcacttggccggngagtcagactattacagtacttaaatggatcagacaagaaaccgaggaacgacccctaaatcctagatctacgatgacagtacgaacgttaggaaacgtacggggtacccagtaccgaaggttcgaggtggaggtagatcggtaggaactagttacttttacncgtcggcactcgcacgcctgcacgtacctagtaagtacgtttcgactaactattacttactagtacaactagtaataagaaattcgtaccctgtacgtacggttcggggaacggggtaacgaagggtacggttagttaacgaacgttacgttggttacgtctacgcactnttcgtcgttcgttaacc

SEQ ID NO: 384635 - DNA, 692 bp, Homo sapiens
  misc_feature: GZ8MTXP01AEGN5.10.33.C11.1.454.CMB.2.raw
  modified_base (228)..(228): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatccacttggccgggngagtcaggactatttacaagttctttaaatggtatcagacaagaaaccgagggaacgacccctaaactcctagactctacgatgactataccgtaaacgttcgggaaaaccgcgggggtaccccaagtacccgtaaagggtttcgagggtgggtaggtagggtagtcggtaggggaactagggttacttttaccgcgttcgggactacgtcccgacacgtcctgacgtacggtcctaaggtaagttacgttttcgaaccgtaactaattaacgtttaacgtacgttacaaacgtaagttaagtaacgtaaaacgttccgtcccgtcttaccggtaccggtttcggggggaaccgggggtaaccgttaaggggtacggttaaacggttaaccggaaaaccggttggttacggttcgggtaacctcggtaaccctaaccgtagttcctttcggttcctttaacccg

SEQ ID NO: 384636 - DNA, 627 bp, Homo sapiens
  misc_feature: GZ8MTXP01D07C1.10.33.C11.1.454.CMB.2.raw
  modified_base (228)..(228): a, c, t, g, unknown or other
  modified_base (324)..(324): a, c, t, g, unknown or other
  modified_base (373)..(373): a, c, t, g, unknown or other
  modified_base (408)..(408): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgaccccagtctccatcctccctgtatgcatctgtaggagacagcgtcaccatcacttggccgggngagtcaggacatttacaagtctttaaatggtatcagcaagaaaccagggaacgcccctaaaactcctagatctacgatgcatcgaacttggaaacnggggtcccatccaaggttcagtggaggtgatcgtgggacagtatttacncgtcggcagtccgcagcctgcaagcctagtaagtntttagacgtaactattactttaactgtaacaaacgtagtaatagtaaaacttcggtcccgtctaccgtaccggttttccgggggaaccggggggtaacccgttaaagggggttacgggttaaacgtttaacccgaaaacggttaacccggttggttaacgggtccgttacggaacccgttaacccgtacgtttcctttcggtttcccgtttttaacccg

SEQ ID NO: 384637 - DNA, 662 bp, Homo sapiens
  misc_feature: GZ8MTXP01DZXTJ.10.33.C11.1.454.CMB.2.raw
  modified_base (205)..(205): a, c, t, g, unknown or other
  modified_base (232)..(232): a, c, t, g, unknown or other
  modified_base (328)..(328): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatcgaccccagtcctccatccctccctgtatgcatctggtagganacagctcaccatcacgttcggccgggnagtcaggactattaacaagttactttaaagtggtatcaagacaacgaaaccgagggaaaccgtaccccctaaaactcccgtagactaccgtaacgntcgactaacgtacggtaaaccgttagggaaaaccgtacggggtacccctaagtaccccgtaagggtttacgaaggggtagggtacggtaagggacgttcgggaacgggtactaaggtttacttttaccgcgtcggactacgtccgcacgctgcgtacgacgtagaagttattcgactactaattacttacgttagtaaccaagtaagtaacgtaagtaaacttcgtacccgtcgtaccgtacgggttccgggggaacgggggtaacgaggggtacggttaacgttaacgaaccgttagttgttacgcgtcaaccgtctacttcttcgttcttcc

SEQ ID NO: 384638 - DNA, 685 bp, Homo sapiens
  misc_feature: GZ8MTXP01EFA0L.10.33.C11.1.454.CMB.2.raw
  modified_base (198)..(198): a, c, t, g, unknown or other
  modified_base (224)..(224): a, c, t, g, unknown or other
  modified_base (330)..(330): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctcctgtatgcatctgtaganacagcgtcaccatcacttggccgggnagtcaggactatttaacaagttactttaaatggtatcagacaagaaaccgagggaacgacccctaaactcctagatctacgatcgacatacgaagttaggaaacgnggggtcccaagtaccgaaggttcagggtggaggtgatcgtaggggaactaggttacttttacgcgtcggtacacgtccgcgacgcctcgacaacggtccttaaggtaaggttacttttacggaccgtaaacttaagtttaacgtttaactacggtaaacctaaacgtaagttaaacgtaaagtaaaacgtttcccggtaccccggttacgtacccggttaaccgggtttccggggggaacggggggtaaaccttaaaggggggttacggttaaacgtttaaacgggaaaacccggttaacgttgggttacgggtcttacgccgtaaccctattccgttcgttaaccgttttcccg

SEQ ID NO: 384639 - DNA, 662 bp, Homo sapiens
  misc_feature: GZ8MTXP01AOZN4.10.33.C11.1.454.CMB.2.raw
  modified_base (224)..(224): a, c, t, g, unknown or other
tcagcatagtagtgcacgaccggtgctcgatttagagtgagctcgttgggtttggggcaggagtcagtcccaaccaggacacagcatggacatgagggtccctgctcagctcctgggctcctgctcctctggctctcgggtgtcagatgtgacatccagatgacccagtctccatcctcctgtatgcatctgtaggagacagcgtcaccatcacgttgccgggnagtcaggacatttacaagttctttaaatggtatcagacaagaaaccgagggaacgacccctaaagtcctagatcgtacgatcgacatacgaacttaggaaacgtcggggtacccagtaccgaaggttacaggtggaggtaggactcgtaggggactagtacttttacgcgtcggacactccgacgacgcctagacgtaacgtcctagtaacgttagtttacggacgttaactagtttaacgttaacgtacggttaaccaaacgtaaagttaataaggtaaaacgttccggtacccgtaccgttaccgttaaccgggtttccgggggaacggggggtaacccgttaaaggggttacgggttaacgttaaccgaaacggttaaccgttggttcggtaacgtacggaacctaacctacgttaccgtcgttccgtttaaccg

SEQ ID NO: 384640 - DNA, 692 bp, Homo sapiens
  misc_feature: GZ8MTXP01CLBCV.10.33.C11.1.454.CMB.2.raw
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacgttggccgggcagtcaggactatttacaagtctttaaatgtatcagcaagaaaccgagggaacgacccctaaactcctagatctacgatgacatacgaacgttaggaaacgtacggggtacccagtaccgtaaggttcgaaggtgggaggtgtagtcgtagggtactaggttacttttaccgtcgtcggtactacgtccgactacgtcctggccgagtcccgtagtaaacgttacgttttgacggtaactaacttacggtttacttacggttaacctaaacgtaggttaaattaacggaaaactttccggtaccccgtacgttaccggttaaccgggttttccgggggaacccggggggtaaccgttaaacgggggttacgggttaaacggtttaaaccgtaaacggttaaccggttggttcgggtaaccgtcggtaacccgtacctacgtttccgttcgttccgttttaaccccg

SEQ ID NO: 384641 - DNA, 747 bp, Homo sapiens
  misc_feature: GZ8MTXP01B0YQX.10.33.C11.1.454.CMB.2.raw
  modified_base (230)..(230): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatcgacccagtcctccatcctccctgtatgcatctgtaggagacagcgtcaccatcacgttggccgggngagtcaggactatttaacaagttactttaaagtggtatcagacaaggaaaccgaggggaacgacccctaaactcctagactctacgatcgactaacgttaccgtaaacgtttacggaaaaccgtacgggggtaccccaagtacccgtaaaggggtttcgagggttaggggagggtacgggtaacgttcgggtaggggaaccttaaggttacttttttaccgtccggttaccgggtcctaacgttcccggaccgtacggtcccgttacgggacctaccgggtacccgtttagggtaaacgtttacgtttacggaccgttaaacttaagtttaactttaacgttacgttaaccgaaacttaggtaacttaagtaaacgttccgtacccgtcgttaccgttaaccgggtttcgggggaaccgggggtaacgttaagggggtcggttaacgttaaccgaaacggttacgttcgggttcgaaccgttcggaactacctagttcttaacgtttcctttaaccg

SEQ ID NO: 384642 - DNA, 842 bp, Homo sapiens
  misc_feature: GZ8MTXP01BH7R9.10.33.C11.1.454.CMB.2.raw
  modified_base (140)..(140): a, c, t, g, unknown or other
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtntcagatgtgacatccagatcgacccagtcctccactccctccctgtatgctatcgtggtaaggagacgacgccgtacacctactccgtacgttcggccgggcgaacgtacgaggtaacttaaactttaacgtaagtttaacttttaaagttggtatacgaagaccgtaaacggaaaacccggaacggggtaaaccccgtaaccccccttaaacgttcccgtaacgtacttaccgtaacgagtacgaaccgtaacgtaaccggtaaacgttacgggaaaaccggtaccgggggtacctaagtaacggtaacgggttccgtaaggggtagggaggtaggtacgttacgggtagggtaacgtagtttattttaccgccgtcgacctacgtccgacacgtccgtacgaccgtacgtccgttaaggtaagtttacgtttacggaaccttaacctaatttaacgtttacgtacggtaaacgttaaacggttaagttaacgttaaaacgtaaaccgttcccggttaccccggtaaccgtttcggttaaacccgggggttttccggggggaaaccgggggttaaccgtaaagggggtttaccggttaaaggtttaacccgaaaaggtttaaccgggtggttacgggttcgttaccggtaacctaaaccgttgtttacccgttcgtttacccttcttaacgttttcccccg

SEQ ID NO: 384643 - DNA, 611 bp, Homo sapiens
  misc_feature: GZ8MTXP01BVT6A.10.33.C11.1.454.CMB.2.raw
  modified_base (225)..(225): a, c, t, g, unknown or other
  modified_base (255)..(255): a, c, t, g, unknown or other
  modified_base (284)..(284): a, c, t, g, unknown or other
  modified_base (312)..(312): a, c, t, g, unknown or other
  modified_base (368)..(368): a, c, t, g, unknown or other
  modified_base (574)..(574): a, c, t, g, unknown or other
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctcctgtatgcatctgtaggagacagcgtacacctatccacttggccgggnagtcaggactattacaagtcttaaatgtancagcagaaacgaggaacgcccctaaatcngatactagatgcatcgaacttggaaacngggtaccagtcgaaggttcaggtggaggtggatcggtagggaactaggtatttacncgtacgggctacgtcccgcacgtccgtgacgcgtacgtaaggtagttattttacgacgtactaagttaacttacgttcggggtaactaacgtagttaaacgtaagtaaaacttcggtcccgtacgttccgtaacggtttccgggggacgggggtaacccgtaaaggggtcggttaacgggtaacgaaaccgtagttggttagggcncggtaaccactaacgtctgttccttgaactttccccg

SEQ ID NO: 384644 - DNA, 693 bp, Homo sapiens
  misc_feature: GZ8MTXP01CZOTH.10.33.C11.1.454.CMB.2.raw
  modified_base (225)..(225): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaaccatcacttgccggngagtcaagactattacaagtctttaaatggtatcagacaagaaaccagggaacgacccctaaaatcctgaatctaacgatcgcaacgttcgaaaccgttaggaaacgtacggggtacccaagtacccaaagggttcaggttaggaggtagaattccgtagggaacctaaaggttattttaccgcgtcgggtacacttccgacaacgggtccctacgacgtaacgtacgtacgtaagttaacgtttacgtacgtaacgtaactttaacgtttaacgttaacgttaactaaacgtaaagttaaagtaaacgtaaacgttaaccgtacccgtaccgttaccggttaccggttaccggggtaaccgggggtaaccgggttaaacgggttaacggttaaacggttaaacgtaaacgttaacgttacgttacggtaacgtacgtaaccgtactacttacgttcgttcgttaacg

SEQ ID NO: 384645 - DNA, 681 bp, Homo sapiens
  misc_feature: GZ8MTXP01BVLZO.10.33.C11.1.454.CMB.2.raw
  modified_base (202)..(202): a, c, t, g, unknown or other
  modified_base (422)..(422): a, c, t, g, unknown or other
tcagcatagtagtgcacgaccggtgctcgatttagagtgagctcgttgggtttgggggcaggagtcagtcccaaccaggacacagcatggacatgagggtcccctgctcagctcctggggctcctgctcctctggctctcgggtgtcagatgtgacatccagatgacccagtcctccatcctcctgtatgcatctgtagganacagcgtcaccatcacgttggccgggcagtcagtactattacaagttacttaaagtgtatcagacaacgaaaccgagggaaccgacccctaaactcctagatctacgatcgacagtaccgtaaacgttacggaaaccgtcggggtacccaagttaccgtaacgggttcaaggggtagggtaagggtggacttcggtagggaactacgtttacttttaccncgtcggactaccgtccgacacggtacctcgacgtacgtaccgttaggtaacgttgtttacgacgtaactagttacgttaactagtaaccaaacgtaagtaataacgtaaacgtcccgtacccgtccgtaccggtacgggttacccgggggaacgggggttaaaccgttacggggtacggttaacgtaacggtaaaccgggttacgttcgggttacggtcgtacgtaaccccactacgttccgttcgttaacccgttccc

SEQ ID NO: 384646 - DNA, 673 bp, Homo sapiens
  misc_feature: GZ8MTXP01A6GJ1.10.33.C11.1.454.CMB.2.raw
  modified_base (233)..(233): a, c, t, g, unknown or other
  modified_base (322)..(322): a, c, t, g, unknown or other
  modified_base (455)..(455): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctcgtcgggtgtcagatgtgacatccagatcgacccagtcctccatccctccctgtatgcatctgtaggagacagcgtccaccatcacgtcggccgggngagtcaggacttatttaacaagttactttaaagtgtatcagacaagaaaccgagggaaccgtacccctaaactcctagactcgtaacgngttcgactaagttaccggtaaacgttacgggaaaccgtcggggtaccctagttaccccgtaaggttcgaggtagggtaggtaggacgttcggagggtacctagtttactttaccgcgtcgactacgtccgacncgtccgtgactacggtccgtagtaagttacgtttcgaactaacttaacttacttaacgtacgtaactaaacgtaagtaacgtaacgtaaacgttccgtcccgtacgttaccggttaccgggttcgggggaaccggggtaaaccgttaggggtacgttacgtaaccgaaacgttacggttggttacgctcgctacgtacttcgttcgttcgttaacccg

SEQ ID NO: 384647 - DNA, 518 bp, Homo sapiens
  misc_feature: GZ8MTXP02GPLGP.10.33.C11.1.454.CMB.2.raw
  modified_base (366)..(366): a, c, t, g, unknown or other
  modified_base (395)..(395): a, c, t, g, unknown or other
  modified_base (436)..(436): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcagtcaggacattacaagtcttaaattggtatcagcagaaaccagggaacggcccctaaactcctgatctacgatgcatcgaacttggaaacaggggtcccatccaaggtcagtggaggtgatcgtgggacagtatttacnctcgcatccgcagcctgcagcctgaagtntttgcgacatattactgtacaacagtaatagaaatgcccgntcgtacgtttcggggacgggggaccgtaagggtcggtaagttacgaaaacgtaactggtagcgtgactaccatctcgtcttc

SEQ ID NO: 384648 - DNA, 519 bp, Homo sapiens
  misc_feature: GZ8MTXP02HSB0F.10.33.C11.1.454.CMB.2.raw
  modified_base (368)..(368): a, c, t, g, unknown or other
  modified_base (420)..(420): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcagtcaggacattacaagtcttaaattggtatcagcagaaaccagggaacggcccctaaactcctgatctacgatgcatcgaacttggaaaacaggggtcccatcccaagttcagtggagtggatcgtgggacagtattttacnctcgcatccgcagcctgcagcctagaagtatttgcgacatatactgtacaanagtatagaaaatcgtccgctcacgtttcggggaccgggggaccgaagggtggaacgttacaaaacgtaacctgtgggcgtcgacactatctcgttactc

SEQ ID NO: 384649 - DNA, 546 bp, Homo sapiens
  misc_feature: GZ8MTXP02F9FVA.10.33.C11.1.454.CMB.2.raw
  modified_base (224)..(224): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccggngagtcaggacatttacaagtctttaaattggtatcagcagaaaccagggaaggcccctaaactcctgatctacgatgcatcgaacttggaaacaggggtccatccaaggttcagtggaggtggatctgggacagtatttactcgtcggcatcgcagcctgcagcctagaagtatttgcgacattattactgtacaaacagtaatagtaaaatgtacccgtctactacgtttcggggacggggggtaaccgaaaggggtggaaggtttacgaaaaccgtaaacgtggttacggcgtcggacaacccattctcgttctttaccc

SEQ ID NO: 384650 - DNA, 515 bp, Homo sapiens
  misc_feature: GZ8MTXP02HV2S7.10.33.C11.1.454.CMB.2.raw
  modified_base (364)..(364): a, c, t, g, unknown or other
  modified_base (405)..(405): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcagtcaggacatttacaagtcttaaattggtatcagcagaaaccaggaagcccctaaactcctgatctacgatgcatcgaacttggaaacaggggtccatccaaggttcagtggagtggatcgtgggacagtattttacnctcggcatccgcagcctgctagcctagaagatttgccgtanattattactgtacaacagtatagaaaattgtacccgctcgtaacgtttcgggacgggggtaccaagggtggagttacgaaacgaacgtgtagcgtgcaccatctgtcttc

SEQ ID NO: 384651 - DNA, 491 bp, Homo sapiens
  misc_feature: GZ8MTXP02INV1I.10.33.C11.1.454.CMB.2.raw
  modified_base (359)..(359): a, c, t, g, unknown or other
  modified_base (408)..(408): a, c, t, g, unknown or other
  modified_base (426)..(426): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacattacaagtcttaaatgtatcagcagaaaccaggaagcccctaaatcctgatctaacgatgcatcgaacttggaaacaggggtcccatcaaggttcagtggagtggatcgtggacagatttacnctcggcatcgcagcctgcagcctgaagatttgcacatattactgtcaanagtatgaaaatgtaccgntacactttcggcgggggaccaagggtcgagttacaaacgaactgtaggctgcacatctcgtcttc

SEQ ID NO: 384652 - DNA, 507 bp, Homo sapiens
  misc_feature: GZ8MTXP02J0TOS.10.33.C11.1.454.CMB.2.raw
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtcttaaattggtatcagcagaaaccagggaaggcccctaaactcctgatctacgatgcatcgaacttggaaacaggggtcccatccaaggttcagtggaggtggatctgggacagatttactctcggcatccgcagcctgcagcctgaagattttgcgacatattactgtcaacagtatagaaaatcgtacccgctctacgtttcgggcgggggtaccaagggtcggagttacaaacgactgtaggctgcaccatctgtcttc

SEQ ID NO: 384653 - DNA, 592 bp, Homo sapiens
  misc_feature: GZ8MTXP02JPZDY.10.33.C11.1.454.CMB.2.raw
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccggcagtcaggacattacaagtcttaaattggtatcagcagaaaccagggaacggcccctaaactcctgatctacgatgcatcgaacttggaaacaggggtcccatcccgaaggttcagtggaggtggatcgtgggactagtattttactctacggcactccgcacgcctgcacgcctagaagtatttgacgtacattaattactagtacaacagtaatagtaaaacttcgtacccgtcttacgtaccgtttcgggggaccgggggtaacccgtaaaggggtacgggtaaacggtttaacgaaaaccggtaaaccgttaggttacgggcgtacggaccgtaacccgtacgtttactacggtttactttaccg

SEQ ID NO: 384654 - DNA, 542 bp, Homo sapiens
  misc_feature: GZ8MTXP02IXDNK.10.33.C11.1.454.CMB.2.raw
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccggcgagtcaggacattacaagtctttaaattggtatcagcagaaacaggaaggcccctaaactcctgatctacgatgcatcgaacttggaaacaggggtccatccgaagtcagtggaggtggatgtgggacagtatttactctcggcatccgcagcctgcagcctgaacgtatttgcgtacatattactgtcaactagtaatagaaaatcgtacccgcttacgtacgtttcgggacgggggtaccgaaaggggtacgggtaacggttacgtaaaacgtaaacgtacggtacggcgtcgacgactacgtcctcgtctttacg

SEQ ID NO: 384655 - DNA, 682 bp, Homo sapiens
  misc_feature: GZ8MTXP02HBYMY.10.33.C11.1.454.CMB.2.raw
  modified_base (225)..(225): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccggngagtcaggactattactaagtactttaattaggtatacagacgagaaaaccgacgggaacggacccctaaacctcgtgatctacgatagcatacgtaacgttacggaaacgacggggtccccgatacccgtaaggttacgaggtgggtaggtaggagtcgtgggtaacgagttatttacgtccgtcggctaacgtccgcgtacgccgtcgctaacgtcccgtagtaaggttaattttcgggaaccgtaactaatttaacgttaccgttagtaaccctaaacgtaaagttaacgtaagtaaaaacgttccgtacccggtaccttaccgtacccgggttttcgggggaaccggggggaaccgtaaaggggttcgggttaaacggtaaccgtaaaaccggaaacgttgggtaacggtcggtacgacccgtaacctacgtttcgtacctttcgtttaaccc

SEQ ID NO: 384656 - DNA, 513 bp, Homo sapiens
  misc_feature: GZ8MTXP02FVDJ9.10.33.C11.1.454.CMB.2.raw
  modified_base (317)..(317): a, c, t, g, unknown or other
  modified_base (344)..(344): a, c, t, g, unknown or other
  modified_base (360)..(360): a, c, t, g, unknown or other
  modified_base (366)..(366): a, c, t, g, unknown or other
  modified_base (504)..(504): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggactatttacaagtcttaaatgtatcagcagaaaccagggaacgcccctaaatcctgactctacgatgcatcgaattggaaacnggtccatccagtcagtggagtgatcgngggactagtatttacnctcggnactcgctacgctcgcgacgcctagaagtgtttagcgtaacattatactgtacaactatatagaaatcgtaccgctcgtacgttcgggacgggggtaccagggtcgagttacaacgactgtggaactgacacgacttcncgttctacg

SEQ ID NO: 384657 - DNA, 589 bp, Homo sapiens
  misc_feature: GZ8MTXP02ICU18.10.33.C11.1.454.CMB.2.raw
  modified_base (349)..(349): a, c, t, g, unknown or other
tcagcatagtagtgcacgaccggtgctcgatttagagtgagctcgttgggtttggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcagtcaggactatttacaagttctttaaatgtatcagcaagaaaccaggaacgcccctaaatcctagatcacgatgcatcgaacttggaaacgcgggtacccatcaaggttccagtggaggtggatcgngggactagtattttacgctcggcactccgcagccctgcagcctagaacgtatttgacgtacattaacttactagtacaactagtactagtaaaactcgtaccgtctacgtacgtttacggggacgggggtaccgtaagggtacggtaacgtttaacgaaaacggtaacgttcggtacggtactacggaaccgtaacccgtaacttaccgtttacgttcccgtttactaaccgtttccccg

SEQ ID NO: 384658 - DNA, 569 bp, Homo sapiens
  misc_feature: GZ8MTXP02JVGZ1.10.33.C11.1.454.CMB.2.raw
  modified_base (201)..(201): a, c, t, g, unknown or other
  modified_base (362)..(362): a, c, t, g, unknown or other
  modified_base (377)..(377): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatcctccctgtatgcatctgtagganacagcgtcaccatcacttgccgggcagtcaggacatttacaagtcttaaatggtatcagcagaaaccagggaacggacccctaaactcctgatctacgatgacatacgaacttaggaaaacgaggggtccccaagtcccaaggttcagtggaggtgatcgngggacagtatttacncgtcggcactccgcacgcctgcacgcctagaagtatttgacgactatacttactgtacactagtaataggaaaatcgtacccgcttacgtacggtttaccggggacgggggtaaccgtagggtacgggtacgttacgaaaacgtaacgtagttacgggtctacggaccacctacgtcctagttactttaccg

SEQ ID NO: 384659 - DNA, 571 bp, Homo sapiens
  misc_feature: GZ8MTXP02GW17Q.10.33.C11.1.454.CMB.2.raw
  modified_base (225)..(225): a, c, t, g, unknown or other
  modified_base (319)..(319): a, c, t, g, unknown or other
  modified_base (373)..(373): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctcctgtatgcatctgtaggagacagcgtcaccatcacttggccgggnagtcaggacattacaagtcttaaatggtatcagcaagaaaccgaggaacgcccctaaactcctagactctacgatgcatcgaacttaggaaacnggggtacccataccgaaggtcaggtggaggtgatcgagggactagtactttacncgtcggcacgtccgcacgcctgctacgcctagtaagttatttagacgtaatattattactagtacaatagtaataagtaaactcgtaccgtctacgtacggttcggggacgggggtaccgtagggtacggtaacgttaacgaaaacggtaccgttaggtacggcgttacggacctactacgttctcgttactttaccg

SEQ ID NO: 384660 - DNA, 598 bp, Homo sapiens
  misc_feature: GZ8MTXP02GI7VN.10.33.C11.1.454.CMB.2.raw
  modified_base (202)..(202): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtcctccatcctccctgtatgcatctgtagganacagcgtcaccatcacttgccgggcgagtcaggacatttacaagtctttaaatggtatcagacaagaaaccagggaacgacccctaaactcctagatactacgatcgacatacgaacgttaggaaaacgtacggggtacccaagtccgtaaaggttcgaaggtggggaggtggtatcggtagggactaagtattttacctcgtcggcctagtcccgacacgcctagcgacgcctagaacgttatttacgacgtaactataacttactgtaacaatagtaatagaaactcgtaccgtctacgtacggttcggggacgggggtaccgaagggtacggtaacgttaacgaaacgtacgtaggttcggcgtacgacgtactacgtcgtacgttcttaccg

SEQ ID NO: 384661 - DNA, 517 bp, Homo sapiens
  misc_feature: GZ8MTXP02JXLJ8.10.33.C11.1.454.CMB.2.raw
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtcttaaatggtatcagcagaaaccagggaaggcccctaaactcctgatctacgatgcatcgaacttggaaacaggggtcccatccaagttcagtggaggtggatcgtgggacagtatttactctcggcatccgcagcctgcagcctagaagtatttgcgacattattactgtacaacagtatagaaaatcgtccgctcacgtttcgggacgggggtaccaagggtcggtagttacgaaacgaacgtggtggcgtgacacgatctacgtcttac

SEQ ID NO: 384662 - DNA, 567 bp, Homo sapiens
  misc_feature: GZ8MTXP02JF2NG.10.33.C11.1.454.CMB.2.raw
  modified_base (367)..(367): a, c, t, g, unknown or other
  modified_base (452)..(452): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatcctcctgtatgcatctgtaggagacagcgtcaccatcacttggccgggcagtcaggacatttacaagttcttaaatggtatcagcagaaaccaggaacggcccctaaactcctgatctacgatgcatcgaacttaggaaacaggggtccatccaagttcagtggagtggatcgtgggacagtactttacnctcggctactcgcacgctgcagcctagaagtatttgcgactatacttactgttaccaagtagtaataagtaaaactcggtacccncttacgtaacgtttcgggacgggggtaccgtaaagggtacggaaacgtttaaccgaaacggtaaaccgtggttagggaacttacggaccaaacgactttcgtacgttctttaacc

SEQ ID NO: 384663 - DNA, 726 bp, Homo sapiens
  misc_feature: GZ8MTXP02H17YE.10.33.C11.1.454.CMB.2.raw
  modified_base (226)..(226): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctcctgtatgcatctgtaggagacagcgtacaccatcacttggccgggnagtcaggactattacaagttacttaaagtgtatcagacaagaaaccgagggaacgacccctaaactcctagactctagatcgacatacgtaaacgttacggaaacgtacggggtacccaagtaccgtaaggttcaaggtaggagtaggttaggtacgttcggtaacggggtacctaaggttaactttttaccgtaccttaccgggtacctacgtacccgacgacgcccgttcgaccgtacggtcccgttaaggtaaagtttacgtttacggaaccgttaaccttaaagtttaacttttaaccgttacgtaaccgtaaaacgttaagttaaacgtaaacggttaaaaaccgttcggtaacccccgttcgtaaccgttaccgggtttaccgggggaccgggggttaaaccgtaaaggggttacggtaaacgttaacgaaaaccggtaaacgtcggtaacgggtactacggtaccctaccttagttccgttacgtttaccccg

SEQ ID NO: 384664 - DNA, 668 bp, Homo sapiens
  misc_feature: GZ8MTXP02G8EZH.10.33.C11.1.454.CMB.2.raw
  modified_base (377)..(377): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctcgtcgggtgtcagatgtgacatccagatgacccagtcctccatcctccctgtatgcatctgtaggagacagcgtcaccatcacttggccgggcagtcaggactattacaagttactttaaagttggtatcagacaagaaaccgagggaacgacccctaaactcctgactctacgatgcagtacgaacgttacggaaacgtacggggtacccagtaccgtaaggttcaggtggaggtgatcgngggactagtatttaccgcgtcggctacgtccgacgacgccgtcgacgacgtacccgtagtaacgttagttttacgacgtaactattaacttacgttagtaacctaacgtaagttaaagtaacgtaaaacgttccgtacccgtaccgttaccgtaacgggtttacccgggggaaccgggggtaaacccgtaaaggggtacgggtaaacggttaaaccgaaaaccggtaacggtcggttacggtaaccgtcggtacctaaccggtactttaccgttcggtttacctttacccg

SEQ ID NO: 384665 - DNA, 616 bp, Homo sapiens
  misc_feature: GZ8MTXP02GCXBX.10.33.C11.1.454.CMB.2.raw
  modified_base (226)..(226): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggnagtcaggactatttacaagttctttaaatgtatcagcaagaaaccgagggaacgcccctaaatcctagatcgtaagatgactatacgtaacgttacggaaaaccgtggggtaccccaagtaccgaaggttcaggtgggaggtggatcgtagggaactaggttacttttacgcgtcggctactccgcacgcctagcacgcctagtaagtatttacgacgtaatatattacgtgtaacaacgtagtaacgtaagtaaacttccgtacccgtcttacggtaccgggtttccgggggaacgggggtaccgtaaaggggtcggtaaacgttaaacgaaaccggtaacgttggtacgtcgtacgaccgtaactacttcgttacgttcctttaaccg

SEQ ID NO: 384666 - DNA, 568 bp, Homo sapiens
  misc_feature: GZ8MTXP02IEFKG.10.33.C11.1.454.CMB.2.raw
  modified_base (423)..(423): a, c, t, g, unknown or other
  modified_base (465)..(465): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatccctcctgtatgcatctgtaggagacagctcaccatcacttggccgggcgagtcaggactatttacaagttcttaaattggtatcagcaagaaaccgagggaacgacccctaaactcctagactactacgatcgacatacgtaacttaggaaacgcggggtacccatccgaaggttcaggtggaggtggatcgtgggactagttattttaccgcgtcgcactccgctacgcctgcagcctagaagtntttcgcgactattatactgtacaatatatagaaatcgtaccntacgtacggttacggggacggggtaactaggggtcgtaacgttaacgaaaccgtagttcgtacggcgttacggacctaccgtacttcgttacgttccttaccg

SEQ ID NO: 384667 - DNA, 673 bp, Homo sapiens
  misc_feature: GZ8MTXP02JDUOI.10.33.C11.1.454.CMB.2.raw
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtcctccatcctccctgtatgcatctggtaggagacagcgtcaccatcacttggccgggcgagtcaggactatttacaagttacttaaatggtatcagacaagaaaccgagggaaccgtacccctaaatccgtagaatcacgatcgacagtacgtaagttacggaaacgtcggggtacccaatccgtaagttcgagtggaggtgactcggtagggactagttactttacgcgtacgcacgtccgacacgtcctagccgacgtccgtaaggtaagttacgtttcgaacgttaaacctatttaacttaacgtacgtacctaaaacgtaagtaaacgtaaggtaaaacgttccgtacccgtacgttaccgttaacccgggttaccgggggtaccgggggtaaaccgtaaagggggtacggtaaaccggttaaacggaaaaccggtaacgttcggtacggtaaccgttacggacctaacccgtattaccggttacgttacctttaccg

SEQ ID NO: 384668 - DNA, 689 bp, Homo sapiens
  misc_feature: GZ8MTXP02IJKG9.10.33.C11.1.454.CMB.2.raw
  modified_base (233)..(233): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctcgtcgggtgtcagatgtgacatccagatcgacccagtctccatcctcctgtatcgctatcgtaggtaggagacagcgtcactatcacgttggccggngagtacgaaggtactagtttaacaagttacttaaagtgtactcaagacaaacgaaaccggagggaaccgtaacccctaacgtcgagtactccgtaagctacgactaagtacgtaacgttacggaaaacgtcgggtaccagttaccgtaaggtcgaaggtggaggtagtactcggggtaggaattagttacttttaccgcgtcgacactccgacgtacgcgtcgaccgtacgtcgttaaggtaacttcgttacgaccgtaattactttaaaggttacccttaagaactaaacgaagtttaaacgaaaacgtaaaccgttccggtacccgttacgtacggttaacccggggttacggggggaccggtaaaacggtaacgggtacgtaaacggtaaactaaacggtacgtgggtaccggaacttacgacctacgtagtttccgtacgtttacttacccg

SEQ ID NO: 384669 - DNA, 596 bp, Homo sapiens
  misc_feature: GZ8MTXP02GDLB8.10.33.C11.1.454.CMB.2.raw
  modified_base (223)..(223): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctcctgtatgcatctgtaggagacagcgtcaccatcacttgccggngagtcaggactattacaagtctttaaatgtatcagcaagaaaccagggaacgcccctaaatcctagatctacgatgacagtcgaacttaggaaacaggggtaccactacaaggttcagtaggaggtcggatcgtgggacagtatttactacgtcgcactccgctacgctcgcgacgcctagaagtatttacgacgactatattactcgtacgtaaactaagtaagtaagtaaacgtacgtacccggtactacgtaccgttacggggtacgggggaacccggtaagggtacgggtaacggttaaacgtaaacggtaaaaccgtggtaacggtaacgttacgacgtacccgtacgttacttacggttctttaccg

SEQ ID NO: 384670 - DNA, 652 bp, Homo sapiens
  misc_feature: GZ8MTXP02J2TDR.10.33.C11.1.454.CMB.2.raw
  modified_base (205)..(205): a, c, t, g, unknown or other
  modified_base (446)..(446): a, c, t, g, unknown or other
tcagcatagtagtgcacgaccggtgctcgatttagagtgagctcgttgggtttgggggcaggagtcagtcccaaccaggacacagcatggacatgagggtccctgctcagctccgtggggctcctgctcctctggctcgtcgggtgtcagatgtgacatccagatcgacccagtctccatcctccctgtatgcatctagtagganacagcgtcaaccatcacgttggccgggagagtcgaaggtactatttaacaagttactttaaagttggtatcaagacaagaaaccgagggaaccgaccccttaaactcctagactctacgatgacatacgtaacgttagggaaaaccgtcggggtaccaagtaccgaaggttcgaggtaggacggtggatcggtaggggaactaggttatttaccgcgttacgcacgtccgcacgcctcgcncgtccgtagtaagttagtttacgaccgtaatattacttacgtacgtaactaacgtaagtataacgtaaacgtccggtaccgtcgttaccgtacgggtttaccgggggaccggggtaaacgtacgggtacgggtaaacgttaaccgaaacggtaacgtcggtacggtcgtacggaccgtacctacgttacctacgttacctttaccg

SEQ ID NO: 384671 - DNA, 660 bp, Homo sapiens
  misc_feature: GZ8MTXP02GK2D9.10.33.C11.1.454.CMB.2.raw
  modified_base (202)..(202): a, c, t, g, unknown or other
  modified_base (226)..(226): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtcctccatccctcctgtatgcatctgtagganacagcgtcacatcacttggccggngagtcaggactatttacaagttctttaaatggtatcagacaagaaaccgagggaacgacccctaaactcctagactactaacgatcgacaatacgaaacgttaggaaaaccgtacggggtaccccagtaccgaaaggttcaaggtgggaggtggattcggtagggaactaggttattttaccgcgtacggactaacgtccgacacgcctgacgacgaccgtagaagttacgtttagacgtaactattaacttaccgtagtaacctaaacgtaagtaacgtaaagtaaaacgttccggtaccccgtacgttaccgttacgggttaccgggggaccgggggtaaccgtaaggggttacggtaaacgttaaccgtaaaacgtaaccgtggtacggaacgtacggacctaccgtacttaccgtcgtttacctttaccg

SEQ ID NO: 384672 - DNA, 593 bp, Homo sapiens
  misc_feature: GZ8MTXP02I2ZJD.10.33.C11.1.454.CMB.2.raw
  modified_base (199)..(199): a, c, t, g, unknown or other
  modified_base (225)..(225): a, c, t, g, unknown or other
  modified_base (386)..(386): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctcctgtatgcatctgtagganacagcgtcaccatcacttggccgggnagtcaggactattacaagtcttaaatgtatcagcaagaaaccgagggaacgacccctaaactcctagatctacgatcgcagtacgaacttaggaaacgtggggtacccatacccgtaaggttcgagtgggaggtggatcggtgggaacaggtacttttacncgtcggcactccgcacgcctgcagcctagaagtatttacgacgtactattattactgtacaaacgtagtaactaagtaaactcgtcccgtactacgtaacgtttccgggggacgggggtaaccgtaaggggtacgggtaaacgttacgaaaacgtaacgttggtacggcgttacgaccgtaccgtactccgttacgtttctttaccg

SEQ ID NO: 384673 - DNA, 579 bp, Homo sapiens
  misc_feature: GZ8MTXP02FQJFD.10.33.C11.1.454.CMB.2.raw
  modified_base (224)..(224): a, c, t, g, unknown or other
  modified_base (317)..(317): a, c, t, g, unknown or other
  modified_base (372)..(372): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccggnagtcaggacattacaagtctttaaatgtatcagcagaaaccagggaacgcccctaaactcctagatctacgatgcatcgaacttaggaaacgnggggtacccataccgaaggttcaggtggaggtgatcgagggactagtactttacncgtcggcactccgcacgcctgcacgcctagaagtatttagcgtaactattattactgtacctaaagtagtaataagtaaaactcggttcccgacttaccgtacggtttaccgggggacgggggtaaccgtaaggggtacggtaacgttaaccgaaaacgtaaccgtggtacggtaacgtcgacctactactctacggttactttacc

SEQ ID NO: 384674 - DNA, 656 bp, Homo sapiens
  misc_feature: GZ8MTXP02I5PFC.10.33.C11.1.454.CMB.2.raw
  modified_base (201)..(201): a, c, t, g, unknown or other
  modified_base (227)..(227): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatcctccctgtatgcatctgtagganacagcgtcaccatcacttggccgggngagtcaggactatttacaagttcttaaattggtatcagacaagaaaccgagggaacgacccctaaactcctagactactacgatgactatacgaaacgttagggaaaacgcggggtaccataccgtaaggttcgaggtaggaggtaggatcggtagggactaggttacttttacgtcgtcggactacgtccgacgtacgcccgtagccgacgtcccgtagtaagttacgtttcgacgtactaatttacttaacgttgtaaccgtaaacgtaaagtaacgtaacgtaaaacgttccggtacccgtcgttaccgtaccgggtttacgggggaccgggggtaaccgtaagggtacggtaacgttaaacgaaacggttaacgtggtacggtaacgtacggacctaccgtacgttccgtacgttacctttaccg

SEQ ID NO: 384675 - DNA, 732 bp, Homo sapiens
  misc_feature: GZ8MTXP02HTYZD.10.33.C11.1.454.CMB.2.raw
  modified_base (145)..(145): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctcgtcgggtntcagatgtgacatccagatcgacccagtctccatccctcctgtatgcatcgtgtagagacagcgtacaccatccacgttcggccgggtacgagtcgaaggactatttaactaagttactttaaagttggtatcaagacaacgaaaccgaagggaacgtacccctaaactccgtagtactcgtaacgatgactagtacgtaacgtttacggaaacgtacggggtaccagtaccgtaaggttacgaggtagggtaggtaggacgtccggtaggggtaactaggttacttttacgaccgttcggtaccacgttaccgacgacggccttcggactacggtacccgtaagtaacgttacgttttacggacccgtaattaaacttaacgtttaaacttacggtaactaaaaccgggttattaagtaaacgttaaaacgtcccggtacccgttccgttacgtaccgggtttacgggggaaccgggggtaaaccgttagggtacgggtaaacgttaaacgtaaaaccggtaaccgttgggtaccggtaacttacgaacccgttaactacgtttacgttcggtttactttaacccg

SEQ ID NO: 384676 - DNA, 587 bp, Homo sapiens
  misc_feature: GZ8MTXP02F823E.10.33.C11.1.454.CMB.2.raw
  modified_base (302)..(302): a, c, t, g, unknown or other
  modified_base (324)..(324): a, c, t, g, unknown or other
  modified_base (381)..(381): a, c, t, g, unknown or other
  modified_base (400)..(400): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggactatttacaagttcttaaagtgtatcagcaagaaaccgaggaacgacccctaaatcctagatctacgntgacatcgaacttaggaaacgnggggtacccataccgtaaggtcaggtggagtggatcgagggactagtattttaccgntcgggcacgtcgcgagccngcacgcctagaagttagtttcgacgtaactattaatttacgtagtaacaaacgtagttaacttaagtaaaacttcgtacccgtccttacgtacggttacggggacgggggtaaccgtaagggtacggtaacgttaacgaaacgtaacgtggtacggaacgtcgactactacgtcttcgttcttaccg

SEQ ID NO: 384677 - DNA, 521 bp, Homo sapiens
  misc_feature: GZ8MTXP02JC65H.10.33.C11.1.454.CMB.2.raw
  modified_base (226)..(226): a, c, t, g, unknown or other
  modified_base (362)..(362): a, c, t, g, unknown or other
  modified_base (441)..(441): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggnagtcaggacatttacaagttcttaaatggtatcagcagaaaccagggaacgcccctaaactcctgatctacgatgcatcgaattggaaacaggggtcccatcaagtcagtggagtgatcgtgggacagtatttacncgtcggcatccgcacgctgcagcctagaacgtatttgcgtacattattactgtacaactagtatagtaaaatcgtaccnctctaacgttcggggacgggggtaccagggtcggagttacgaaacgtaactggtagcgtgcaccatcgtacgtctttacc

SEQ ID NO: 384678 - DNA, 604 bp, Homo sapiens
  misc_feature: GZ8MTXP02H0GLO.10.33.C11.1.454.CMB.2.raw
  modified_base (222)..(222): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctcctgtatgcatctgtagagacagcgtcaccatcactgccgggnagtcaggacatttacaagtctttaaattggtatcagcagaaaccagggaagcccctaaatcctgatcacgatgcatcgaaacttggaaaacacggggtaccccagtccaaaggtttccaggtggaggtggtatcgtgggaactaggatttttaactctagggcaatccgcagcctgcgagccctagaacgtattttgacgactattatttaacgttagtaccaaagtattaagagtaaaaattcgtacccgcttacgtacgtttcggggaccgggggaccgtaaaggggtacgtacggttaaacgaaaacggtaccgttagggttacggaaccgttgggaaccctaaccggtaacttaccgttcggtttaaccctttacccg

SEQ ID NO: 384679 - DNA, 609 bp, Homo sapiens
  misc_feature: GZ8MTXP02JSRLQ.10.33.C11.1.454.CMB.2.raw
  modified_base (381)..(381): a, c, t, g, unknown or other
  modified_base (396)..(396): a, c, t, g, unknown or other
  modified_base (404)..(404): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatcctcctgtatgcatctgtaggagacagcgtcaccatcacttgccggcagtcaggacattacaagtcttaaatggtatcagcagaaaccagggaacgacccctaaactcctgatctacgatgacatacgaacttaggaaactacggggtacccagtacccaaggttccaggtgggaggtggatcgtgggaactaggtattttacncgttcggacatccgnacgccgtncagcctagaagtagtttcgcgaactataattacgtgtacaacgtagtaatagtaaaactcgtacccgtccttacgtaccgtttacgggggaccgggggtaaccgaaggggttacggtaacggtttaacgaaaaccggtaaccgttaggtacggtaacgttaccggaccgtaaccgtaacttacgtttcggttaacgttttacccg

SEQ ID NO: 384680 - DNA, 558 bp, Homo sapiens
  misc_feature: GZ8MTXP02IYPEZ.10.33.C11.1.454.CMB.2.raw
  modified_base (224)..(224): a, c, t, g, unknown or other
  modified_base (287)..(287): a, c, t, g, unknown or other
  modified_base (371)..(371): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctcctgtatgcatctgtaggagacagcgtcaccatcacttgccgggngagtcaggacatttacaagtctttaaattggtatcagcaagaaacgaggaacgcccctaaacncctgatctacgatgcatcgaacttaggaaacgtacggggtccatccgaagttcagtggaggtggatcgtggactagtactttcnctcgggcacgtcgcacgctgcagcctagaacgtatttcggactactaattattacttagtacctaaatagtaataagtaaactcgtacccgtctacgtacgtttaccggggacgggggaaccgtagggtacgggtaagttacgaaacgaacgtggtgtcgtcggactaccattcgttcgttctttac

SEQ ID NO: 384681 - DNA, 720 bp, Homo sapiens
  misc_feature: GZ8MTXP02GYE8S.10.33.C11.1.454.CMB.2.raw
  modified_base (201)..(201): a, c, t, g, unknown or other
  modified_base (226)..(226): a, c, t, g, unknown or other
  modified_base (296)..(296): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtcctccatccctcctgtatgcatctgtagganacagcgtcacatcacttggccgggngagtcaggactatttacaagttctttaaattggtatcagacaagaaaccgagggaaccgacccctaaacncctagatactacgatggactaacgtacgtaacgtttacgggaaaaccgacgggggtacccctaagtacccgtaaagggttaccaagggtgggaggggtggaagtccggtaggggactaggtacttttacgcgtaccggactacgtcccgacgacgtcccgtagaccgtacgcccgtaaggtaaagtttacgttttacgaccggttaaactacgtttaaactttaaccgttaggttaaccctaaacgtaaaggttaaataaacgttaaaacgtccggttaccccgtaccgttaccggttaaccgggtttaccgggggaccggggggtaacctaaagggggttacggtaacgtttaaacggaaaacggtacgtacggttcggaacgttcgaaccgtaccgtacttacgttcggttacctttaaccg

SEQ ID NO: 384682 - DNA, 667 bp, Homo sapiens
  misc_feature: GZ8MTXP02H3FW6.10.33.C11.1.454.CMB.2.raw
  modified_base (146)..(146): a, c, t, g, unknown or other
tcagcatagtagtgcacgaccggtgctcgatttagagtgagctcgttgggtttggggcaggagtcagtccccaaccaggacacagcatggacatgagggtccctgctcagctccgtggggctcctgctcctctggctcgtcgggtntcagatgtgacatccagatcgacccagtctccactccctcctgtatgctatcgtaggtaggagacagcgtaccacctatcacgttcggccgggagagtacgaaggtactattaactaagttactttaaagttggtatcgagacaaacgaaaccgagggaaccgtacccctaaacgtccgtagactactaacgagtacgactaagtaccgtaacgttaacggaaaaccgtccggggtacctagtaccgtaagggttccgtaagggtcgggagggtgtacgtcggtaggggaactaacgttacgttttaccgaccgtacggtacctaccgtcccgtacggtcgaccgtcgacgtacgtaccgtagtaagttacgttacgacgtaaatagttacttacgtacgtaacaagtagtaagtaagtaaacttccgacctcgtaccgtacgggttcggggacgggtacgtaggtacgtaagtaacgaacgtacgtagacgtcgacgacgtactatccttcgtactaccg

SEQ ID NO: 384683 - DNA, 649 bp, Homo sapiens
  misc_feature: GZ8MTXP02IK43U.10.33.C11.1.454.CMB.2.raw
  modified_base (311)..(311): a, c, t, g, unknown or other
  modified_base (410)..(410): a, c, t, g, unknown or other
  modified_base (611)..(611): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctcgtcgggtgtcagatgtgacatccagatcgacccagtcctccactcctcctgtatgcatctgtaggagacagcgtcaccatcacgttcggccggcgagtcgaggactattaactaagttactttaaagttgtatacgagacaacgaaaccgaggaaccgacccctaaactccgtanactctacgatcgacagtacgtaagtacggaaacgcggggtaccagtaccgaggttacgaggtaggaggtaggatcgtagggtactagttacttttaccncgtacgtctactccgcacgccgtcgcacgtacgtaagtaacgttacgttcgacgttactactttacgtttacgtagtaacctaagtaaagttagaaacgttaaacgtcccgttaccgtacgttaccgggtaccgggttaccgggggaccggggtaaacggtagggtaaccgtaaacggttaaaccgaacgtacggtacggngtaaccggtcaaccgtactcgttcgtacttcgtacccg

SEQ ID NO: 384684 - DNA, 635 bp, Homo sapiens
  misc_feature: GZ8MTXP02GL3NC.10.33.C11.1.454.CMB.2.raw
  modified_base (202)..(202): a, c, t, g, unknown or other
  modified_base (227)..(227): a, c, t, g, unknown or other
  modified_base (608)..(608): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatcgacccagtcctccatcctcctgtatgcatctgtagganacagctcaccatcacgtggccgggngagtcagactattacaagttctttaaatgtatcagacaagaaaccgagggaacgacccctaaactctagactctacgatcgacagtacgaagttacggaaaaccgtcggggtaccccatacccgtaaagggttcaagggtacggggtaggttggaacgttccgggtaggggtaaactaggtttaacttttaaccgtcgttacggactacgtcccgacgaacgtcctacggcgaacgtccttaagggaacttagtttacgactaaactaattaacttactagttacaaataagtaataagtaaaacgtcgtaccgctacgtacggttcggggacgggggtaccaaagggtcggaacgttacgaaacgtaccgtaggtcggtntacgacactacgttctcgtacttaccc

SEQ ID NO: 384685 - DNA, 657 bp, Homo sapiens
  misc_feature: GZ8MTXP02IUTC4.10.33.C11.1.454.CMB.2.raw
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatcctcctgtatgcatctgtaggagacagcgtcaccatcctacgttcggccgggcgagtcaggactatttacaagttcttaaatggtatcagacaagaaaccgaggaacgacccctaaactcctagactactacgatgactaagtacgaaacgttggaaaacgtacggggtacccagtacccgtaaaggttcaaggtgggagtggatcggtagggaactaggttactttttacgcgtacggactacgtccgacgacgtccgtgacgacgtaccgtagtaacgttatttcggactaactaattacttacgttacgtactaaacgtaagttaagaagtaaaacgttcgtaccccgtacgttaccggtacggttacccgggggtacgggggtaaaccgtaagggggttacggtaacgtttaaaccggaaaacgtaacgtggtacgaacgtacggactaactacttcgttacgtttacctttaccg

SEQ ID NO: 384686 - DNA, 541 bp, Homo sapiens
  misc_feature: GZ8MTXP02FNX2M.10.33.C11.1.454.CMB.2.raw
  modified_base (225)..(225): a, c, t, g, unknown or other
  modified_base (379)..(379): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatcctcctgtatgcatctgtaggagacagcgtcaccatcacttgccgggnagtcagacatttacaagtctttaaatggtatcagcagaaaccagggaaggcccctaaatcctgatctacgatgcatcgaacttggaaacaggggtcccatccaggttcagtggaggtggatcgtagggacagtattttactctcggcatcccgnagccctgcagcctgaacgtattttgcgacatattactgtacaacagtatagaaaactgtcccgtctacgtacgtttaccgggggcgggggtaaccgaaggggtggtaacgttaccgaaaacgaacctaggtggaacgtgacctaccgatctcgtcctttacc

SEQ ID NO: 384687 - DNA, 775 bp, Homo sapiens
  misc_feature: GZ8MTXP02JLHZL.10.33.C11.1.454.CMB.2.raw
  modified_base (287)..(287): a, c, t, g, unknown or other
  modified_base (417)..(417): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatcgacccagtcctccactccctccctgtatgctatcgtaggtaggagacagccgtacaccatccacgttcggccgggcgagtcgaggtaaccttaatttaacaaagtttactttaaagttgtacncaagacaacgaaaccggaggggaaaccgtacccctaaactccgtagtactctaacgatcgactaagtaccggtaaacgttagggaaaccgtacgggtaccataccgtaagtcggaagtgggtaggtaggntaccggtagggaacgttagttacgtttactccggtcgacgtaacctcgtaccgacgtccgtcgacccgtagtacccggtataaagttacgtttacgacgttaaactacgtttaattaccgttacggtaaaccttaagggtaaaagttaaacgtaaacgttaaaaccgttacccggggttcccctaacggtttacccgtaccgggggtttaaccggggggtaaaccggggggtaaccgttaaacgggggttaaccggtaaacggtttaaaccggaaaaccgtaaaaccgggtttgggtacccggaacggttcctaacccgtaccgttacgtttacccggttactttaccgtttaccccg

SEQ ID NO: 384688 - DNA, 510 bp, Homo sapiens
  misc_feature: GZ8MTXP02HV7KL.10.33.C11.1.454.CMB.2.raw
  modified_base (348)..(348): a, c, t, g, unknown or other
  modified_base (365)..(365): a, c, t, g, unknown or other
  modified_base (367)..(367): a, c, t, g, unknown or other
  modified_base (374)..(374): a, c, t, g, unknown or other
  modified_base (376)..(376): a, c, t, g, unknown or other
  modified_base (378)..(378): a, c, t, g, unknown or other
  modified_base (380)..(380): a, c, t, g, unknown or other
  modified_base (382)..(382): a, c, t, g, unknown or other
  modified_base (416)..(416): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctcctgtatgcatctgtaggagacagctcaccatcacttgcgggcagtcaggacattacaagtcttaaatgatcagcagaaaccaggaagcccctaaatcctgatctacgatgacatacgaattaggaaacaggggtcccatacccaaaggttcaggtgaggtcggattcngggacagtattttaccncncgcatcncncncncncacgctagtagtattagacatatatatatacaanatataagtaaatacgtcactacgtacgtacgggtacgggacggacggtacgtacgtaacgaaacgacgtagagcgtcgacacactactctactc

SEQ ID NO: 384689 - DNA, 669 bp, Homo sapiens
  misc_feature: GZ8MTXP02IAKKJ.10.33.C11.1.454.CMB.2.raw
  modified_base (228)..(228): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatccctcctgtatgcatctgtaggagacagcgtacaccatcacttcggccgggngagtcaggactatttacaagttctttaaagttgtatcagacaagaaacgagggaaccgacccctaaactcctgactcgtacgatcgactatacgaacgttaggaaaccgtacggggtacccaatccgaaaggttcaaggtgggaggtgattcgagggtactaggttactttacgcgtcggacacgtccgctacgcctaggcctaacgtcccgttagtaaacgtttagtttacggacgtaacttaacgtttaacttaacgttcgtaacctaaaacgtagttaagtaaagtaaaacgttccgtaccccggtacctaccgttacccgggtttacgggggaccgggggttaaaccgtaggggttacgttaaacgttaaccggtaaaacgtacgttcggtacggtcgttacgaacctacgtacttaccgttcgtttaccctttccg

SEQ ID NO: 384690 - DNA, 583 bp, Homo sapiens
  misc_feature: GZ8MTXP02FW62H.10.33.C11.1.454.CMB.2.raw
  modified_base (324)..(324): a, c, t, g, unknown or other
  modified_base (378)..(378): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatccctccctgtatgcatctgtaggagacagcgtcaccatcacttgccggcgagtcaggactatttacaagtctttaaatggtatcagcaagaaaccgagggaacgcccctaaactcctagatctacgatgcatcgaacttaggaaacnggggtacccataccgaaggttcaggtggagtggatcgtgggactagtatttacnctcggcatccgcagctgcacgcctagaagtatttagcactatagttactagtacaaacgtagtataagaaatcgtaccgtctacgtacggtttccggggaccgggggtaaccgtaaggggtacggtaacgttaacgtaaaacggtaaacgtcgggtacggtaaccgtcggtacctaccgtacgttccgttacgttccgtttaacc

SEQ ID NO: 384691 - DNA, 605 bp, Homo sapiens
  misc_feature: GZ8MTXP02FHU1P.10.33.C11.1.454.CMB.2.raw
tcagcatagtagtgcacgaccggtgctcgatttagagtgagctcgttgggtttggggcaggagtcagtcccaaccaggacacagcatggacatgagggtccctgctcagctcctggggctcctgctcgtctggctctcgggtgtcagatgtgacatccagatgacccagtcctccatcctcctgtatgcatctggtaggagaccagcgtcaccatcacttggccggcagtcagactattacaatctttaaatgtatcagcagaaaccgaggaacgcccctaaactctagatctacgatgacatacgaacgttaggaaacgaggggtccccaataccgaaggttcagtggaggtggagtcgtcggggaactaggttacttttaccgtcgttcgggactaacgttcccgacacgtccgtgccgtacgccctaggaaagttacttttagaccgtaacattaacttactacgtacaaacgtagtaataagtaaactcgtacccgcttaccgtacggtttccggggacgggggaaccgtaagggtacggtaggtaaccgaaaacggtacgtaggtcggaacgtcgtaaccacctctactcgtctttaccg

SEQ ID NO: 384692 - DNA, 672 bp, Homo sapiens
  misc_feature: GZ8MTXP02HDJWC.10.33.C11.1.454.CMB.2.raw
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatcctcctgtatgcatctgtaggagacagcgtcaccatcacgttcggccgggcgagtcgaggactattacaagttcttaaagttggtatcgagcaagaaaccgagggaacgacccctaaactcctagtactctacgatcgactatacgtaacgttacgggaaacgtacggggtaccctagtacccgtaaggttcgaggtggggacggtaggagttccggtaggggtaactaggttattttaccgcgtcgggacctacgtcccgacgacgtcccgttaggcccgacgtaccgttaggtaaagttacgtttacgacgtaaactatttaacttacgtagtaccctaaagtaagtaagtaaacgtaaacttccgggtaaccctcgttacgtaccgggtttccgggggaacgggggtaaaccgtagggttacgggttaacgtaaaccgtaaacggtacgttggtacgcgttacgacctacgtcttacgttcgtactttaccg

SEQ ID NO: 384693 - DNA, 651 bp, Homo sapiens
  misc_feature: GZ8MTXP02GFOBI.10.33.C11.1.454.CMB.2.raw
  modified_base (144)..(144): a, c, t, g, unknown or other
  modified_base (233)..(233): a, c, t, g, unknown or other
  modified_base (249)..(249): a, c, t, g, unknown or other
  modified_base (268)..(268): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtntcagatgtgacatccagatcgacccagtcctccatccctcctgtatgcatctggtaggagacagctcaaccatcctacgtcggccgggngagtcaggactattanagttactttaaagtgtatnagacaacgaaaccgagggaaccgtacccctaaactctagtactctaacgatcgactaacgtacgtaaacgtttacgggaaaaccgtcggggtacccctaagtacccggtaaaggttcgagggtagggtaggtcggtaagtcgggtagggaactagttactttaccgcgtacggctactcgacacgcctgcgtacgtccgtagtaacgttacgtttcgaacgtaactagttaacttcgtaagtacctaaagtagtaactaaagtaaacgtcgtaccctacgtaccgtacgggttacggggacggggtacgtaaggggtacggaaacgttaccgaaaacgtacgtcggtaacgcgtacgacacgttatcgttacgtaccttaccg

SEQ ID NO: 384694 - DNA, 574 bp, Homo sapiens
  misc_feature: GZ8MTXP02FIBAZ.10.33.C11.1.454.CMB.2.raw
  modified_base (197)..(197): a, c, t, g, unknown or other
  modified_base (347)..(347): a, c, t, g, unknown or other
  modified_base (360)..(360): a, c, t, g, unknown or other
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtagganacagcgtcaccatcacttgccgggcgagtcaggactatttacaagttcttaaatggtatcagcaagaaaccagggaacggcccctaaactcctgatctacgatgcatcgaactggaaactaggggtcccatcaggtccagtgagtgatcngggcagatttacnctcgcatccgcagcctgcacgcctagaagtatttcgcgtactattattactagttacaaacagttaatagaaaactcgtacccgcttacgacggtttcggggacgggggtaacccaaaggggttcgggtaaacgtttaacgaaaaccggtaaacgtcggtacggcgttacggaaccgaacctaacgtcttcgttaccttactactttcccccgg

SEQ ID NO: 384695 - DNA, 664 bp, Homo sapiens
  misc_feature: GZ8MTXP02JEOS5.10.33.C11.1.454.CMB.2.raw
  modified_base (236)..(236): a, c, t, g, unknown or other
  modified_base (427)..(427): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgcctcctctggctctcgggtgtcagatgtgacatccagatgaccccagtctccatccctcctgtatgcatctgtaggagaccagccgtcaccatcctacgttcggcccgggnaacgtcaggtaactatttacaaagttcttaaattggtactcgagacaaggaaaccgaggggaacgacccctaaactccgttagacttctaacgatcgactataccgaagttacggaaacgcggggtacccataccccgtaaggttcgaggttaggtagtcggatccggtagggactaaggttacttttacncgtcggactacgtcgaccagtccagactagccgtagaacgttatttcgacgtaactattacttacttacggtactaagtaagtaataacgtaaacgttcgtaacccctcgtacgttacggtttaccggggaccgggggtaacccgaaggggttaccggaaaggttaaccgtaaaacgtaaccgttaggtcggtaacgttaccgacggtaacccttacgtaccgttacgttacttacg

SEQ ID NO: 384696 - DNA, 688 bp, Homo sapiens
  misc_feature: GZ8MTXP02H9CGC.10.33.C11.1.454.CMB.2.raw
  modified_base (240)..(240): a, c, t, g, unknown or other
tcagcatagtagtgcacgaccggtgctcgatttagagtgagctcgttgggtttggggcaggagtcagtccccaaccaggacacagcatggacatgagggtccctgctcagctccgtggggctcctgctcctctggctcgtcgggtgtcagatgtgacatccagatcgaccccagtcctccactccctcctgtatcgcatcgtaggtaggagacagcgtacaccatcacgttcggccgggngacgtcgaaggactattaactaagttactttaaagttgtatcagacaacgtaaaccgacgggaaccgtaccctaaactccgtagactactacgatcgactacgtacgtaacgttaggaaacgacggggtacctagtaccgtaaggtcgaggtagggtaggtggtagtcgtagggtaactagttactttaccgcgtcgcactccgctacgtcgtcgacgtacgtacctaaggtaagttacgtttacgacgttaaatactttactttaacgttagtaactaaacgtaaggttaaactaaacgtaaaacttccggtaccccgtacgttacccggtttaccggggttacccgggggaccgggggtaaccgtaaagggggtacgttaacggtaaacgtaacggtacgtggtacgaaccgtacgacctacgtactcgttacgtttacctacccg

SEQ ID NO: 384697 - DNA, 666 bp, Homo sapiens
  misc_feature: GZ8MTXP02ICHGM.10.33.C11.1.454.CMB.2.raw
  modified_base (229)..(229): a, c, t, g, unknown or other
  modified_base (407)..(407): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgaccccagtctccatccctcctgtatgcatctgtaggagacacgcgtcacctatcacttggccgggnagtcaggactatttacagtcttaaagtgtatcagacagaaaccgagggaaccgtcccctaaactcctagactcgtaacgatcgctaataccgaacgttacggaaaacgtccggggtacccagtaccgtaaaggttcaggtaggaggtgacttcggtagggtaactagtttactttacncggtacgtcaccgtccgcgtacgccgtgaccgtacgtccgtaaggtaaagttcgtttcgaaccgtaattaattttaaccgttaacgtttagtaacctaaaaccggttaagttaagtaaaacggttaaaacgttcccgtaccccgtacttaccgggtaccggggtttaccgggggaaccgggggtaaacgtagggttacggtaacgttaaaccgaaacgtacgttggacgtcgtcaacgactagttcctagttcctaacc

SEQ ID NO: 384698 - DNA, 662 bp, Homo sapiens
  misc_feature: GZ8MTXP02G0ODO.10.33.C11.1.454.CMB.2.raw
  modified_base (225)..(225): a, c, t, g, unknown or other
  modified_base (647)..(647): a, c, t, g, unknown or other
tcagcatagtagtgcacgaccggtgctcgatttagagtgagctcgttgggtttgggggcaggagtcagtcccaaccaggacacagcatggacatgagggtccctgctcagctcctggggctcctgctcctctggctctcgggtgtcagatgtgacatccagatgacccagtctccatcctcctgtatgcatctgtaggagacagcgtcaccatcacttgccgganagtcagactatttacaagttctttaaatggtatacagacaagaaaccgagggaacgacccctaaactcctagatctacgatgcatacgtaacttaggaaacgacggggtaccctagtaccgtaaggttcaggtggaggtgtatcgtaggggactaggttacttttactcgtaccggactacgttcccggcacggtcctacgggacctaacgccttaagggaaacctttgttttaccggacgtaaacttaacttaacgtttaacccttaggttaacccaaacttaagtaaccgttaaggtaaaaccttccggggttaccccagttacccgttaaccgggtttccggggggacgggggtaaacccgtaggggtacggtaaacgttacgaaaacggtacgtggtacgcgttacggactaaccgtnttacgtacgtctacg

SEQ ID NO: 384699 - DNA, 798 bp, Homo sapiens
  misc_feature: GZ8MTXP02FQL7Q.10.33.C11.1.454.CMB.2.raw
  modified_base (142)..(142): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctctctggctctcgggtntcagatgtgacatccagatcgacccagtcctccactccctcctgtatgcatcgtgtaggagacagcgtaccactatcacgttcggccgggcgagtcgaggacttaatttacgaaagtttacttttaaagtggtaactccgaagaccgaaaacggaaaacccgaggggaaaccccgacccccttaaaacgtcctaagacttacctaaggattcggacctaacgttaccgaacggtttaacggaaaaccgtcggggtaacccctagtaccggttaaaacgggttcaaggggtgggtaggtaggaacttggggaagtactaagtttactttacgcgcgtacactccgacgactcgtagacgtacgtcccgtaaggttaaccgttagtttacggacttaaaacttacgttaaactttacgtacgtaaccgtaaaacgttagggtttaaaacttaaacgtaaaacggtttccggttaaccccgtacgttaaccggttaccgggggttttacccgggggaaccggggggttaaacccgttaaagggggtacgggtttaaactaaaccggggtaaaaaccgtttcggggtacggttaacgggtccgtaaacccggtaacgtttaccccaagggttttccttaacggtttcccgtttaaccccg

SEQ ID NO: 384700 - DNA, 633 bp, Homo sapiens
  misc_feature: GZ8MTXP02JPA34.10.33.C11.1.454.CMB.2.raw
  modified_base (287)..(287): a, c, t, g, unknown or other
  modified_base (324)..(324): a, c, t, g, unknown or other
  modified_base (393)..(393): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctcctgtatgcatctgtagagacagcgtacaccatcacttgccgggcagtcaggactatttacaagttctttaaagtgtatcagcaagaaaccgaggaacgcccctaaancctagatcacgatcgacagtcgaacttaggaaaacgnggggtaccctatacccgtaaggttcaggttggaggtggacttcggaggggtaactaggttacttttacncgtcggacacgtccgacgacgcctggccgtacgtccgtagaagttatttcgacgtaacgtattagttacgtcgtaactaacgtaagttagtaagtaaacttcggtacccgtactaccgttaaccggttcgggggacgggggtaccgtaagggtacggtaacgtaaccgtaaaaccgtaacgttcggtaccggtaaccttcggaacccgtaaccgtacttaccgttcgttacctttacccg

SEQ ID NO: 384701 - DNA, 746 bp, Homo sapiens
  misc_feature: GZ8MTXP02FHAQ3.10.33.C11.1.454.CMB.2.raw
  modified_base (226)..(226): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcgtctggctctcgggtgtcagatgtgacatccagatcgacccagtcctccatccctcctgtatgcatctgtaggagacagcgtcaccatcacttgccggnagtcagacattacaagttacttaatgtatcagacaagaaaccgaggaacgacccctaaactctagactctacgatcgactacgtacgtaaacgttacgggaaaaccgtacggggtacccctaagtaccccggtaaagggtttccgaagggttacggggtacggggttacggaacgtttccgggtaaggggtaaaccttaacggtttaacgtttttaaccgtcgtaccgggtactaaccgtcccgtaccgtaaccgtcccgtacgtacccgtacgtacccgttaaagggtaaaccgttagttttaaccggaaccgttaaacttaaactttaaactttaccgtacggtaacctaaaaccgtaaagttaaaccgtaaagtaaacgtcccgggttacccctacgttaccggttaccgggttaccgggggaccgggggtaaaccgtaaggggtacggtaaacgttaaacggaaacggtacgtcggtacgcgtacgacccgtaacctgttaccgtacgttctaccc

SEQ ID NO: 384702 - DNA, 523 bp, Homo sapiens
  misc_feature: GZ8MTXP02JM7S8.10.33.C11.1.454.CMB.2.raw
  modified_base (222)..(222): a, c, t, g, unknown or other
  modified_base (260)..(260): a, c, t, g, unknown or other
  modified_base (268)..(268): a, c, t, g, unknown or other
  modified_base (314)..(314): a, c, t, g, unknown or other
  modified_base (365)..(365): a, c, t, g, unknown or other
  modified_base (396)..(396): a, c, t, g, unknown or other
  modified_base (418)..(418): a, c, t, g, unknown or other
tcagcatagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctcctgtatgcatctgtaggagacagctcaccatcacttgccggnatcagcattacagtcttaaatggtatcagcagaaacgnggtaaacnccccgtaaactcctgaatcgtacgactgcatcggaacttggaaacnggggtcccatccaggttcagtggacggtgactcgtgggactaggtatttcnctcgggcagtcgacgtacgcctagctagccngagtattgtcacatattacttntacactagtatagtaatcgtccgtctacgtacgtacggtacggggacggtaggtacggtacgtacgtaacgacgtacgtacgtcgtcgacactactctcgtactc

SEQ ID NO: 384703 - DNA, 745 bp, Homo sapiens
  misc_feature: GZ8MTXP02H0XQY.10.33.C11.1.454.CMB.2.raw
  modified_base (428)..(428): a, c, t, g, unknown or other
tcagcatagtagtgcacgaccggtgctcgatttagagtgagctcgttgggtttgggggcaggagtcacgtcccaaccaggacacagcatggacatggacgggtccctgctcagctccgtggggctcctgctcctctggctcgtcgggtgtcagatgtgacatccagatcgacccagtctccatcctcctgtatgcatctggtaaggagacagcgtacaccatcacgttcggccgggcgagtcgaggaactaatttaaccgaagttactttaaaagttggtaatcgaagacaaagaaaaccgaaggggaaaccggtacccctaaaactcctagactactaacgatgacatacgaaacttaggaaaacgtcgggtccataccgaaggttcaggtggaggtggatcggtagggaactagttacttttaccncgtaccggactactaccgacgaacgcccgtacggaccacggtacccgtaaggtaaacgttaagtttttcgaaccgtaaaccgttaaactttaaagtttaaccttaaggttaaaccgaaacctaaacgttaaacgtaaaggtaaaaaacgttccggttacccccgtaccgttaccgttaacgggtttaccgggggtaaccgggggtaaacccggtaaaacggggtacgggtaaacggtttaaaccgaaaaaccggtaaaccgttggtacggtaacgtacggaacctaaccgtaacgttcctacggtttacctttaccg

SEQ ID NO: 384704 - DNA, 575 bp, Homo sapiens
  misc_feature: GZ8MTXP01EO0OP.25.71.G05.1.454.CMB.2.raw
  modified_base (344)..(344): a, c, t, g, unknown or other
  modified_base (347)..(347): a, c, t, g, unknown or other
  modified_base (349)..(349): a, c, t, g, unknown or other
  modified_base (357)..(358): a, c, t, g, unknown or other
  modified_base (360)..(360): a, c, t, g, unknown or other
  modified_base (384)..(384): a, c, t, g, unknown or other
  modified_base (386)..(386): a, c, t, g, unknown or other
  modified_base (418)..(418): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtctgggggaggcctggtcaaagcctggggggtcccgaagactctcttgtgcagcctctggattcaacttcaaaaggctacagcatgaactggatccgccaggctccggggaaggtctgcagtggatttcatccattagtggtcttaagngtnanaaattatnnanactcgtgaacgcgtcacatctcananacaacgacgacgacttcttcttcttctacaanaagaacaacacacacggagacgacggacgacgcgtcgttagtttacttgtgtcgaggagggaagggtagggacgggaaaacgttaaacggtacgtacgttacggttacggttaggtaagtagtcgtttgttagttacgttcgggttcgggtaacggg

SEQ ID NO: 384705 - DNA, 578 bp, Homo sapiens
  misc_feature: GZ8MTXP01CNEO2.25.71.G05.1.454.CMB.2.raw
  modified_base (230)..(230): a, c, t, g, unknown or other
  modified_base (236)..(236): a, c, t, g, unknown or other
  modified_base (240)..(240): a, c, t, g, unknown or other
  modified_base (248)..(248): a, c, t, g, unknown or other
  modified_base (254)..(255): a, c, t, g, unknown or other
  modified_base (258)..(258): a, c, t, g, unknown or other
  modified_base (262)..(262): a, c, t, g, unknown or other
  modified_base (307)..(307): a, c, t, g, unknown or other
  modified_base (331)..(331): a, c, t, g, unknown or other
  modified_base (395)..(395): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggagcctggtcaagcctggggtccagctcntgtgcngctngatcactnaagcanncangacnggatcgcaggctcgggaggtctgcagtggatttcatccatttagnggtcttaagcgtgactaaattttngcagactcggtagaacggtccgttacaccatcacagacgacacgccgacgtactttctctttcngactaaatcgaactacgacctacgacggggacggaccggtaaggaccgacggtcttagttttactttcgtggtcgacggtaggagggtaaggtacgggacggtaaacgttacggtacgtacgttacggttagggttagtaagtgttcgtttgttagtttacggttcgggttaacggtaacggg

SEQ ID NO: 384706 - DNA, 551 bp, Homo sapiens
  misc_feature: GZ8MTXP01CJQ0C.25.71.G05.1.454.CMB.2.raw
  modified_base (356)..(356): a, c, t, g, unknown or other
  modified_base (482)..(482): a, c, t, g, unknown or other
  modified_base (533)..(533): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtctggggaggcctggtcaagcctggggggtcccaagactctcttgtgcagcctctggattcaacttcaaagggctacagcatgaactggatccgccaggctccggggaaggtctgcagtggatttcatccattaggtggtcttaagcgtgactaaattttangcagactcggtagaacggccggttcaccatcctccagagacaacgccgacgtactttctctttctgacaaatgaacagcctcagacgggccgaggcacgggcttgtttattctgtgcgtagagggngtgggcgaaacgtggcgtcgtacgggaggttgatggtcttttgagtttcgngggggtccaaggggtaac

SEQ ID NO: 384707 - DNA, 588 bp, Homo sapiens
  misc_feature: GZ8MTXP01EEZK8.25.71.G05.1.454.CMB.2.raw
  modified_base (359)..(359): a, c, t, g, unknown or other
  modified_base (394)..(394): a, c, t, g, unknown or other
  modified_base (505)..(505): a, c, t, g, unknown or other
  modified_base (544)..(544): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtctgggggaggcctggtcaaggcctggggggtcccaagactctcttgtgcagcctctggattcaacttcaaaaggctacagcatgaactggatccgccaggctccgggggaaggtctgcagtggatttcatccatttagtggtcttaagcgtgactaaatttttangcagtacgtcgggtagaaccggtccgttacacctntcctacagacacaacgccgacgtactttcttctttctagacaaatcgaacacgacctacaacggggacgaccggaacggaccgacggtcttgtttatttcgtgtgcgaggngggaaggtgggacgtaaacgttggacgtacgttacgggnggttgtaagtgttcgttttgtagtttcggtcggggccgtaaggg

SEQ ID NO: 384708 - DNA, 525 bp, Homo sapiens
  misc_feature: GZ8MTXP01EVZY1.25.71.G05.1.454.CMB.2.raw
  modified_base (291)..(291): a, c, t, g, unknown or other
  modified_base (498)..(498): a, c, t, g, unknown or other
  modified_base (520)..(520): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgcttgttttaaaaggtgtccaatgtgaggtgcaactggtggagtcgtgggggagcttggtacagccaggcccggtccctgacactctcctgcacagcttccggactcacctttggtgagcatgctatgacctgggtccnccaggctccgaggggagggtctggagtggcttgggttcagttagaagcgaaacctgtgggtggggacaacacaagtaacgccgcgtactagtaaaaggcaagattcagcctctacaagagatgaattaccaaaagcatcgctatctgcacatgagcagcctagagaagcgacggctcagccgtagttattactgttacttattactntgaagtagtagttgtttaattnttaac

SEQ ID NO: 384709 - DNA, 541 bp, Homo sapiens
  misc_feature: GZ8MTXP01DZY2F.25.71.G05.1.454.CMB.2.raw
  modified_base (477)..(477): a, c, t, g, unknown or other
  modified_base (483)..(483): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttggtccaggccggggggtcctgagactctcctgtgcagcctctggattcagttttagcagtatttggatgagctgggtccgccaggccccagggaggggctggtgtgggtagccaacatacacgaagatggaggtgaacgaaatactatgcggaactctgtgaaacgggccgattcacatcctccgagggacaactccaaacaactacagtatatctagacaaatagaagtaggtgtagagagccgacggacgaacggcgtgtgttattntgtggngagacgtacgacccgacgttcttactaacgtacctaactgtcgtttagtaagttgtgg

SEQ ID NO: 384710 - DNA, 843 bp, Homo sapiens
  misc_feature: GZ8MTXP01BZKB1.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgcttattttagaaggtgtccagtgtgaggtgcaggttggaggagtcgtgggggagcgttgggtccgaggccggggggtcctgagactctcctgtgcagcctcgtggtattcgtagttttagctagtattggatgagcgtgggtcccgcgacggccccgaaggggaacggggctggggtggtgggtagaccaaacataaccgagaagagtgggaggtacgaaaggtaaatacgtaagtcggacgggtaaaccttcggttgggtacgggaaacgggggcccgttaaatttcccgaaacccctagttacccgttacccggaaacggggtaaaccaaaccccgttaaccccgaaaactaaacccttaacccgtaaaggttaacttaaacgttacctaaggaaacctaaaagttaaggtaaaacgggtttggggttaacccggttaacgggaaagggtaaaccgggaaccccggggtaaaggggtaacccggaaaccgggggttcccgttagggtttaacgggttttaaattttccccgggttgggtttacgggttacccgggaaaggttaacccgggttaccccggaaccccccgggttaaaacttccccggttaaacttaaacccgggtaacccccctttaaagttccccggttacgtttttttaacggaacgttaaacggggttttcgggggg

SEQ ID NO: 384711 - DNA, 583 bp, Homo sapiens
  misc_feature: GZ8MTXP01EYCAQ.25.71.G05.1.454.CMB.2.raw
  modified_base (356)..(356): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagccgtggggggtcccaagactctcttgtgcagcctctggattcaacttcaaaggctacagcatgaactggatccgccaggctcggggaggtctgcagtgatttcatccatttagtggtacttaagcgtagactaaattttangcagactcggtagaacgggccgttcaccatctaccagagaccaacgccgacgtactttctctttctgactaaatacgaacacgacctacagacggggaccgaaggaccgacgggtcttggtttactttgtgtgcgaggagggaggtgggacgaaaacgtcggacgtcgtaacgggaggttgttagtgtcgttttgtagtttcgttacggggtccgttaagggtaacg

SEQ ID NO: 384712 - DNA, 528 bp, Homo sapiens
  misc_feature: GZ8MTXP01AI74L.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccaggccgggggggtccctgagactctcctgtgcagcctctggattcagttttagcagatttggatgagctgggtccgccgaggccccaggggaaggggctgggtgtgggtagccaacatacacgaagatggaggtgagaaatactatgcggaactctgtagaaggggccattcaccatctccagggacaactccaaacaactcagtatatctgacaaatgaagtggtctgagagccgagacacggctgtgttattcgtgtgcgagagtcgccccgaattcccataacgaccctaatgtctttgaagttgtgggg

SEQ ID NO: 384713 - DNA, 553 bp, Homo sapiens
  misc_feature: GZ8MTXP01AEXZQ.25.71.G05.1.454.CMB.2.raw
  modified_base (358)..(358): a, c, t, g, unknown or other
  modified_base (476)..(476): a, c, t, g, unknown or other
  modified_base (480)..(480): a, c, t, g, unknown or other
  modified_base (511)..(511): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggtttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggatccgccaggctccggggaaggtctgcagtggatttcatccatttagtggtcttaagcgtgactaaattttangcagactcgggtgaacggcgttcaccatcctcagacgacaacgccgacgtactttctctttctgacaaatgaacagcctcagggacgccgagacacggctgtttatttctgtgcgagngggngtgggacgaaaacgttggactcgttacgggnggttgaagttgtcttttggagtttcgtcggggccgtaagggg

SEQ ID NO: 384714 - DNA, 570 bp, Homo sapiens
  misc_feature: GZ8MTXP01CD1Z8.25.71.G05.1.454.CMB.2.raw
  modified_base (242)..(242): a, c, t, g, unknown or other
  modified_base (277)..(277): a, c, t, g, unknown or other
  modified_base (357)..(357): a, c, t, g, unknown or other
  modified_base (381)..(381): a, c, t, g, unknown or other
  modified_base (410)..(410): a, c, t, g, unknown or other
  modified_base (418)..(418): a, c, t, g, unknown or other
  modified_base (420)..(420): a, c, t, g, unknown or other
  modified_base (423)..(423): a, c, t, g, unknown or other
  modified_base (425)..(425): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggtttcctgtcgctattttagaaggtgtccagtgtgaggtggtgctgggtggagtctggggggagcctggtcaaggccgtggggggtcccaagactctcttgngcagcctctggattcaacttcaaaggctacagcangaactggatccgccaggcgtccgggaaggtctgcagtggatttcatccattagtggtcttaagcgtagactaaattttangcagactcgggtgaacggccgttnaacatctccagacgacacgccagactttntctttcananaananacacacacgacggacgacgacgacgacgtcgttgtttagtttcgttgtgacggaggaggaagggtagggacggtaaacgacggtacgtacgttacggttaggttagtaagtgttcgttgttagttcgtcgggttaacggtaacgg

SEQ ID NO: 384715 - DNA, 522 bp, Homo sapiens
  misc_feature: GZ8MTXP01DF6JW.25.71.G05.1.454.CMB.2.raw
  modified_base (224)..(224): a, c, t, g, unknown or other
  modified_base (227)..(227): a, c, t, g, unknown or other
  modified_base (229)..(229): a, c, t, g, unknown or other
  modified_base (232)..(233): a, c, t, g, unknown or other
  modified_base (238)..(238): a, c, t, g, unknown or other
  modified_base (245)..(245): a, c, t, g, unknown or other
  modified_base (253)..(257): a, c, t, g, unknown or other
  modified_base (259)..(259): a, c, t, g, unknown or other
  modified_base (261)..(261): a, c, t, g, unknown or other
  modified_base (263)..(263): a, c, t, g, unknown or other
  modified_base (265)..(265): a, c, t, g, unknown or other
  modified_base (275)..(275): a, c, t, g, unknown or other
  modified_base (277)..(278): a, c, t, g, unknown or other
  modified_base (294)..(294): a, c, t, g, unknown or other
  modified_base (301)..(301): a, c, t, g, unknown or other
  modified_base (303)..(303): a, c, t, g, unknown or other
  modified_base (310)..(313): a, c, t, g, unknown or other
  modified_base (332)..(332): a, c, t, g, unknown or other
  modified_base (367)..(367): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggagcctggtcaagctgggtccantcntntgnngctgngatcatnaaggctannnnnangncncngcgcggagtngnngtgattcatctattgngtatagntnataattnnnnactgtgcgcgtcacactcncagacgacacgacgactacttcttcttctcacaanacacacactacacggacgacgacgacgacgtcgttgtttatttctgtgacggaggaggtaaggtacgggaacggtaaacgttacggtacgtacgttacgggttaggttaggtaagtgttcgtttgttacgtttcggttcgggttaacggtaacgg

SEQ ID NO: 384716 - DNA, 633 bp, Homo sapiens
  misc_feature: GZ8MTXP01DQ3C5.25.71.G05.1.454.CMB.2.raw
  modified_base (362)..(362): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtgggctccgctgggtttcctgtcgctattttagaaggtgtccagtgtgaggtggtgctggtggagtcgtggggggaggcctgggtcaaggccgtggggggtcccgaagactctcttgtgcagcctctggattcaacttcaaaaggctacagcatgaactggatccgccaggcgtccgggggaaggtctgcagtggatttcatccattagtgtacttaagcgtagactaaattttcngcagactcggtaacgaaccggtccggttacaaccgtatcctaccagacgacaaccgccgacgtactttctcttctagactaaatacgaacacgcctacacgacgggaccggaaggaccgtacgggtcttgtttagtttcgtaggtggtaggagggagggtagggtaaggggtaaccggttaaaaggtcggacgtacggtacggggttagggttgttaagttggttacgttttggtacgtttcgggttacggggtaaccggaagggttaacg

SEQ ID NO: 384717 - DNA, 557 bp, Homo sapiens
  misc_feature: GZ8MTXP01A9SZ1.25.71.G05.1.454.CMB.2.raw
  modified_base (362)..(362): a, c, t, g, unknown or other
  modified_base (436)..(436): a, c, t, g, unknown or other
  modified_base (491)..(491): a, c, t, g, unknown or other
  modified_base (509)..(509): a, c, t, g, unknown or other
  modified_base (523)..(523): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggatccgccaggcgtccggggaaggtctgcagtggatttcatccatttagtggtacttaagcgtagactaaattttangcagactcgggtacgaacggccgttcacatcctcagacgacaacgccgacgtacttctctttctcgactaaatnaacacgacctacgagggacgaccggaggacacggtcttgtttattctgtgcgagngggaagtgggacgaaagnggacgtcgttaggngttgaatgtcgtttgagttcgtgggccgtaaggg

SEQ ID NO: 384718 - DNA, 785 bp, Homo sapiens
  misc_feature: GZ8MTXP01A5KHI.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccgaggccggggggtcctgagactctcctgtgcagcctctggattctagtttagctagtattggatgagcgtgggtccgccgacgggcccccgaagggggaacgggggcgtggggtggtgggggtacgacccgaagacgtaacgaacggaaaggagtaggggagggtagaaacgtaaaatacgtaagtcggaccggtaaacttcgtggtagggaaacggggtcccgtacttaccgaacctagtacccgtacccgaacggggaaccctaaaccctacccaaaccaaaccgttaccaaaggtttaaacttaactcttaacggaacctaaaagttacggtaaaacggttggggttaccgttaagggaacgggaaaccgggtacccgggaaacgggggttaaccgaacccgggggttcgtttaggtttacggtttacgttttccggtaagggtacgggttacgggtaaacggttaccgggtacccggtaacccccggttaaacgttacccgttaaacgttaacccgttaaccctttaagttcgttacgttttaggtaacgtttaacgggtcggggg

SEQ ID NO: 384719 - DNA, 571 bp, Homo sapiens
  misc_feature: GZ8MTXP01CYXCB.25.71.G05.1.454.CMB.2.raw
  modified_base (331)..(331): a, c, t, g, unknown or other
  modified_base (343)..(343): a, c, t, g, unknown or other
  modified_base (354)..(354): a, c, t, g, unknown or other
  modified_base (420)..(420): a, c, t, g, unknown or other
  modified_base (430)..(430): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggagcctggtcaaggcctgggggtcccaagactctcgttgtgcaggcctcgtggaattcaacttcaaaggctacagcatgaactggactccgcaggctcgggaaggtctgcagtgatttcatcatttagngtcttaagcgtnactaaattttngcagactcgggtagaacggtccgttcaccatccaccagacgacacgccgactactttctcgtttcngacaaataanacacgactcacggacgacgacgacgacgtcgttgtttattctgtgtacggaggaggtaaggtacgggaacggtaaacgttacgtacgtcgttacggttggttgtaagtgttcgtttgttgttcggtcgggttcggtaacgg

SEQ ID NO: 384720 - DNA, 558 bp, Homo sapiens
  misc_feature: GZ8MTXP01B7Y2V.25.71.G05.1.454.CMB.2.raw
  modified_base (354)..(354): a, c, t, g, unknown or other
  modified_base (484)..(484): a, c, t, g, unknown or other
  modified_base (516)..(516): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtggggggaggcctgggtcaaggccgtgggggggtccccaagactctcttgtgcagcctctggattcaacttcaaaggctacagcatgaactggatccgcaggctcggggaggtctgcagtgatttcatccattagtgtcttaagctgactaaatttngcagactcgggtgaacggccgttcaccatctccgagacgacaacgccgacgtactttctctttactgactaaatgaaacagacctcacggacgccgagacacggcttgtttattctgtgcggagtagggngtgggacgaaaacgttggacgtcgttacgggnggttgtaatgtcttttgagtttcggtcggggttccgtaaggg

SEQ ID NO: 384721 - DNA, 646 bp, Homo sapiens
  misc_feature: GZ8MTXP01AQNAW.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagcgtggttctcttgtgctatttagagtgtcagtgtgaggtgcagttggaggagtcgtgggggagcttgggtccaggccggggggtcctgagactctcctgtgcagcctctggattcagttttagctagtattggatgagcgtgggtccgccgacggccccgaggggaaggggctgggtgtgggtagccaacatacgagaagagtaggaggtgaacgaaatacgtaagtcggacggtaaactcgtggtagggaaacggggcctaattccacctaacttcccgtacccgaaggggtaaccaaaccttacccaaaactaactacgacgtttaaactattaccgtaacgtaacgtaaagtaagtaacgggtacggtacgtaggaacggacggaccggacggacggtacggtacgttgttgttacgttgtgtcggttacggtacgttacgtaccgtaccgttacgttaccgttacgtaaccgtacgtaacgttgttacgttacgtaagttggtggg

SEQ ID NO: 384722 - DNA, 521 bp, Homo sapiens
  misc_feature: GZ8MTXP01B6M4S.25.71.G05.1.454.CMB.2.raw
  modified_base (290)..(290): a, c, t, g, unknown or other
  modified_base (413)..(413): a, c, t, g, unknown or other
  modified_base (425)..(425): a, c, t, g, unknown or other
  modified_base (430)..(430): a, c, t, g, unknown or other
  modified_base (432)..(432): a, c, t, g, unknown or other
  modified_base (477)..(477): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttgggtccaggccggggggtccctgagactctcctgtgcagcctctggattcagttttagcagtatttggatgagctgggtccnccaggccccaggggaaggggctgggtgtggggtagccaacatacacgaagatggaggtgaagaaatactaatgcggaactcgtgtgaaaggggccattcaccatctcagggacaactccaaanaactcagtatancgtananaatagagtgtgtgagagacgacgacgacgcgtgtgtattgtgtgngagagtcgccgacgttcactaacactaactgtcttgtgttgtgg

SEQ ID NO: 384723 - DNA, 659 bp, Homo sapiens
  misc_feature: GZ8MTXP01D1PJH.25.71.G05.1.454.CMB.2.raw
  modified_base (344)..(344): a, c, t, g, unknown or other
  modified_base (357)..(357): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtgggctccgctgggttttcctgtcgctattttagaaggtgtccagtgtgaggtggtgctggtggagtcgtgggggagcctggtcaagcctggggtcccaagctctcttgtgcagcctgtggattcaacttcaaaggctacagcatgaactggactccgccaggcgtccggggaaggtctgcagtggatttcatcctagttagtggtacttaagcgtanactaaattttcgngacagtacgtcggaacgaaccggtccgtacaaccgtactcctaccgaaggacgaacccaaccgtccgtaacgttacctttcttactttcgtacgtaactaaagtacgaacgacgtccgtacgaacgacggggaccggaacggaaccgtacggtacgttcgtttacgtttacgttacggtcggtacggaaggtagggtaagggtaacgggaacggttaaacggtacggttacgtacggtaacgggttaggttgttagttgttcgtttgttacgttcggttacgggtaacggttaacggtaacg

SEQ ID NO: 384724 - DNA, 620 bp, Homo sapiens
  misc_feature: GZ8MTXP01BX67N.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccaggccggggggtcctgagactctcctgtgcagcctctggattctagttttagcagtatttggatgagctgggtccgccgacggccccgaggggaacgggggctggggtggtggggtacgccaacgataacgacgaagagtgggaggtgaagaaatacgtagtgcggaactcgtggtggaaacgggccattcacatcctaccgaggacaactccaaacaactacagtatatctagactaaatgaaagtggtctgaggacgccgaaggacgaacggtctggttagttactttcgtaaggtcggacggtaaggacggttcccggaaccccggttaaacttcccgaacgttaaccggtaccccttaagttcggttactttttacgggtaacgttaagggtttcgggggg

SEQ ID NO: 384725 - DNA, 574 bp, Homo sapiens
  misc_feature: GZ8MTXP01EDWQA.25.71.G05.1.454.CMB.2.raw
  modified_base (357)..(357): a, c, t, g, unknown or other
  modified_base (493)..(493): a, c, t, g, unknown or other
  modified_base (528)..(528): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggatccgccaggctccggggaaggtctgcagtggatttcatccatttagtggtcttaagcgtgactaaatttntgcagactcgggtagaacggtccgttcaccatctcagacgacaacgccgacgtactttctcttttctgacaaatcgaaacacgcctacaggggacgcccggaaggaccacggtcttgtttattctgtgacgtaggnggaagtgggacgtaaaacgttggctcgttacgggnggttgaagttgtcttttggagtttcggtaacggggaaccgtaaggg

SEQ ID NO: 384726 - DNA, 576 bp, Homo sapiens
  misc_feature: GZ8MTXP01BIEHA.25.71.G05.1.454.CMB.2.raw
  modified_base (358)..(358): a, c, t, g, unknown or other
  modified_base (486)..(486): a, c, t, g, unknown or other
  modified_base (520)..(520): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggatccgccaggctccggggaaggtctgcagtggatttcatccattagtggtcttaagcgtgactaaattttangcagactcgggtgaacggccgttacaccatctaccagacgacaacgccgacgtactttctctttctgacaaatgaaacagacctcaggacgccgaacggacacggtcttgtttatttctgtgcgaggnggaagtgggacgaaacgttggactcgttacgggnggttagtaagttgttcgtttttgtagttttcggtcgggggttaacccgtaaagggg

SEQ ID NO: 384727 - DNA, 571 bp, Homo sapiens
  misc_feature: GZ8MTXP01AE4IP.25.71.G05.1.454.CMB.2.raw
  modified_base (168)..(168): a, c, t, g, unknown or other
  modified_base (288)..(288): a, c, t, g, unknown or other
  modified_base (556)..(556): a, c, t, g, unknown or other
  modified_base (563)..(563): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtntccagtgtgaggtgcagttggaggagtcgtgggggagcttggtccaggccggggggtcctgagactctcctgtgcagcctctggattctagttttagcagtattggatgagctgggtccncgaggccccgaggggagggctgggtgtgggtagccaacgatacgacgaagagtggaggtgaagaaatactagtgcggaactcgtgtaggaaacggggtccgtattccgaccattcccgacccgaaggggaaccaaacctacccaaactaactcgaagtataactccgtagaacaaattgaaagttgggtactggaagagcccgagaccgacggtctgtgtatttcgaagtgacgagagtccgcccgagttccagtcaccctaatcgtnttttagnttgtgggg

SEQ ID NO: 384728 - DNA, 620 bp, Homo sapiens
  misc_feature: GZ8MTXP01EYETS.25.71.G05.1.454.CMB.2.raw
  modified_base (568)..(568): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggccgtggggggtcccaagactctcttgtgcagcctctggattcaacttcaaaggctacagcatgaactggactccgccgaggccgtccggggaaggtctgcaggtgatttcatccattagtggtcttaaagcgtagaactaaattttatggactagaccgttacgggtagtaaccggggcccggtttcaaccctatcctaccgagacgaacgaacgcccgacgtactttctctttctagtacaaatagaacacgacctacacgggaacgaccggacgaacgacgtcgttgttttatttcgtgttgaggaggagggaaggtcgggacgaaaacgttggacgtcgttaacgggnggttaggtaatgttcgtttggtagtttcggtaacggggttaaccgtaagggg

SEQ ID NO: 384729 - DNA, 547 bp, Homo sapiens
  misc_feature: GZ8MTXP01EO8CN.25.71.G05.1.454.CMB.2.raw
  modified_base (358)..(358): a, c, t, g, unknown or other
  modified_base (509)..(509): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagcctggggggtcccaagactctcttgtgcagcctctggattcaacttcaaaggctacagcatgaactggatccgccaggcgtccggggaaggtctgcagtgatttcatccatttagtggtacttaagcgtagactaaattttngcagactcggtgaacggcgttcaccatctcagacgacaacgccgacgtactttctctttctgacaaatgaacagacctcaggacgccgaggacacggtctgtttattctgtgcgagaggaaggtgggacgtaaacgttggctcgttagggnggttgaagtgtctttgagtttcgtcggggccgtaaggg

SEQ ID NO: 384730 - DNA, 541 bp, Homo sapiens
  misc_feature: GZ8MTXP01DMCPN.25.71.G05.1.454.CMB.2.raw
  modified_base (408)..(408): a, c, t, g, unknown or other
  modified_base (518)..(518): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtcctgtgtgaggtgcaactggtggagtctgggggaggcctggtcaagcctggggggtccctgagactctcctgtgtagcctccggattcagcttcagcaaatatagtgtgaactgggtccgccaggctccgagggaaggggctgggagtggggtcgcattcgtgagtagtagtagtacttataaatactacgcagagtcagtgggagggccgattcactatctcagagacaacaccaagnctattttgttctgacaaatgaacagcctagggagagccgaggataccggctctagtattattgtgcgaagacataaagaagacaggttggcttggggcttaggcttacgngggggccaaggggaacccctggg

SEQ ID NO: 384731 - DNA, 551 bp, Homo sapiens
  misc_feature: GZ8MTXP01CO11B.25.71.G05.1.454.CMB.2.raw
  modified_base (355)..(355): a, c, t, g, unknown or other
  modified_base (382)..(382): a, c, t, g, unknown or other
  modified_base (387)..(387): a, c, t, g, unknown or other
  modified_base (511)..(511): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtggggggaggcctggtcaaggccgtggggggtcccgaagactctcttgtgcagcctctggattcaacttcaaaggctacagcatgaactggatccgccaggctccggggaggtctgcagtgattcatcattagtgtcttaagcgtgactaaatttangcagactcggtgaacggcgtcacatcncaganacacgccgacgtacttctcttctgacaaatcgaacagcctacaggacgaccggacggacgacggtcttgtttatttcgtgtgcgaggaggaaggtgggacgaaaacgttggactcgttacgggnggttgtaagtgtctttgtagtttcggtcggggcgtaaggg

SEQ ID NO: 384732 - DNA, 618 bp, Homo sapiens
  misc_feature: GZ8MTXP01ATXWL.25.71.G05.1.454.CMB.2.raw
  modified_base (279)..(279): a, c, t, g, unknown or other
  modified_base (359)..(359): a, c, t, g, unknown or other
  modified_base (423)..(423): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggtctggtcaagccgtggggggtcccgaagactctcttgtgcagcctctggattcaacttcaaaggctacagcangaactggatccgccaggctccggggaaggtctgcagtggatttcatccattagtggtcttaagcgtgactaaatttttangcagactcgggtgaaccggcggttccacatctccagacgacaacgccgacgtactttctcttcngacaaatgaacacgccctacacgggacgaccggaggaaccacgggtccttggtttactttcgtggttcgacggtagggtagggaaggtacgggggacggtaaaaccgttgggtaccgttacggttacggggttaggttcggtaagttggttccgttttaggtagttttccggtgggggttaacccgtaaaggggg

SEQ ID NO: 384733 - DNA, 599 bp, Homo sapiens
  misc_feature: GZ8MTXP01C2Y7Y.25.71.G05.1.454.CMB.2.raw
  modified_base (370)..(370): a, c, t, g, unknown or other
  modified_base (556)..(556): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgcttattttagaaggtgtccagtgtgaggtggtgctgggtggagtcgtggggggaggcctggtcaagccgtggggggtcccaagactctcttgtgcagcctctggattcaacttcaaaggctaacagcatgaactggactccgcgaggcgtccgggggaaggtctgcagtggtactttcatcctatttaggtcgtacttaagcgtagactaaattttngcagtacgtcgggagaacggccgttacacctatcctacgagacgacaacgccgacgtactttcttctttactagactaaatacgaaacacgcctacgagggacgccggaaggaccgtacggtcttgtttacttcgtgtgacggaggagggtaagtagggacgtaaacgttgggtactacggagggngttaggtaatgttcgttttgagtttcggtcggggcgtaacggg

SEQ ID NO: 384734 - DNA, 608 bp, Homo sapiens
  misc_feature: GZ8MTXP01EJ13K.25.71.G05.1.454.CMB.2.raw
  modified_base (357)..(357): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtgggctccgctgggttttcctgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggactccgccaggctccggggaaggtctgcagtgatttcatcattagtggtacttaagcgtagactaaattttangcagactcggtagaacggtccgttcacatctaccagacgacacgccgacgtactttctctttctagacaaatcgaacacgcctacacgacgggaccggaagggacctacgggtccttagtttacgtttcgtaggtcgcggtaaggagggaggtcggggaacgttaaaacgtcggaccgtacggtaacgggaggttgagttggttacgttttggtacgtttcggacggggtaacccgttaaaggggtaaccg

SEQ ID NO: 384735 - DNA, 598 bp, Homo sapiens
  misc_feature: GZ8MTXP01C6QRG.25.71.G05.1.454.CMB.2.raw
  modified_base (344)..(344): a, c, t, g, unknown or other
  modified_base (499)..(499): a, c, t, g, unknown or other
  modified_base (534)..(534): a, c, t, g, unknown or other
  modified_base (549)..(549): a, c, t, g, unknown or other
  modified_base (553)..(553): a, c, t, g, unknown or other
  modified_base (584)..(584): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcgttggtccgagggcccggggggtcctggagacctctccgtgtgcagcctcgtggtattctagttttagctagtatttggatgagcgtgggtcccgccgacggccccgaggggaggggctgggtggtgggtacgccaanataacccccgaggaagagtggaggtagaaacgaaatacgtagtggaccggtaacttcgtggtacggaaacggggtcccgtaattccaacctagttccctacccgaagggaacctaaacctaccaaacctaaacgtacaagttaatactactaganaaatagtaagtgtgtagagagacgacggacgacgngtgtgtattgtgtgngagngtcgccgacgttcactaactacctaactgtnttgtgttaagtggg

SEQ ID NO: 384736 - DNA, 524 bp, Homo sapiens
  misc_feature: GZ8MTXP01CI4YD.25.71.G05.1.454.CMB.2.raw
  modified_base (473)..(473): a, c, t, g, unknown or other
  modified_base (481)..(481): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggaggcttgggtccaggccgggggggtccctgagactctcctgtgcagcctctggattcagttttagcagatttggattgagctgggtccgccagggcccccaggggaaggggctgggtgtgggtagccaacatacacgaagatgggaggtgagaaatactatgcggaactctgtgaaagggccgattcaccatctccagggacaactccaacaactcagtatatctgacaaatgaagtggtctgagagccgaggacacggctgtgtatttcngtgcgagngtcgcccgattccatcgaccctaatcgtctttgaacttgtggg

SEQ ID NO: 384737 - DNA, 681 bp, Homo sapiens
  misc_feature: GZ8MTXP01BYDOB.25.71.G05.1.454.CMB.2.raw
  modified_base (375)..(375): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtggggggaggcctggtcaaggccgtggggggtcccgaagactctcttgtgcagcctctggattcaacttcaaaggctacagcatgaactggactccgccgaggccgtaccgggggaaggtctgcaggtggtatttcatccagtttaggtggttacttaagcgttagaactaaattttngacagtacgtcgggtagaaccgggtcccggttacacctactcctaccgagacgaccgaaccgccgacgtactttctctttactacgacaaatacgaacacgtacctacgaaggggacggaccggaacggaaccgtacggtccgtttagttttaactttccgtggtcgacggtaagggaggggtaacgggttacggggaacggtaaaacgttcgggtaccgttacggttaacggggttaggttggtaagtttcggttaacgtttttggtacgttttccgggtaacgggggttaaccggttaaagggg

SEQ ID NO: 384738 - DNA, 642 bp, Homo sapiens
  misc_feature: GZ8MTXP01EJIAB.25.71.G05.1.454.CMB.2.raw
  modified_base (314)..(314): a, c, t, g, unknown or other
  modified_base (336)..(336): a, c, t, g, unknown or other
  modified_base (360)..(360): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtggggggaggcctgggtcaaggccgtgggggggtcccaagactctcttgtgcagcctctggattcaacttcaaaggctacagcatgaactggatccgccaggctcggggaaggtcngcagtggatttcatccattagnggtcttaagcgtgactaaattttngcagactcgggtagaacggtccgtacacctatcctacgaagacgaacaacgccgtaacgtactttcttctttacgagtactaaactaacgaacgaacgaccgtacgacgggacggaccggaacggaaccgtaccgtacgttacgtttacgtttacgttcgtgtacggtacggaagggtaagggtacgggttaacggtaaacgttacggtacgtacggttacggttacggttaggtaagtagttcgtttagttacgttacggttaacgggttaacggtaacgg

SEQ ID NO: 384739 - DNA, 572 bp, Homo sapiens
  misc_feature: GZ8MTXP01EDIS0.25.71.G05.1.454.CMB.2.raw
  modified_base (362)..(362): a, c, t, g, unknown or other
  modified_base (527)..(527): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtggggggaggcctggtcaagccgtggggggtcccaagactctcttgtgcagcctctggattcaacttcaaaggctacagcatgaactggatccgccaggcgtccggggaaggtctgcagtgatttcatccatttagtggtacttaagcgtagaactaaattttngcagacgtcgggtagaaccgggtccgttacacctatcctaccagacgacaacgccgacgtactttctctttactgacaaatgaacagacctcaggacgaccggagacgacgtcttgtttattctgtgcgagaggaaggtggacgaaacgttggctacgttagggngttgtaagttgtcgttttgacgtttcggtcggggaaccgtaaggg

SEQ ID NO: 384740 - DNA, 565 bp, Homo sapiens
  misc_feature: GZ8MTXP01EV3C3.25.71.G05.1.454.CMB.2.raw
  modified_base (350)..(350): a, c, t, g, unknown or other
  modified_base (518)..(518): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagcctggggggtcccaagactctcttgtgcagcctctggattcaacttcaaaggctacagcatgaactggatccgcaggcgtccggggaaggtctgcagtgatttcatcattagtgtctaagcgtagactaatttngcagacgtcggtagaacggtccgtcacctatcctacagacacacgccgacgtacttctctttcacgacaatagaacacgacctcgaggacgtacgacggacacggtcttgttttacttctgtgacgaggagggaaggtgggaacgtaaacgttggactacgttagggnggttgtaagtgttcgttttgacgtttcggtcgggttaaccgtaaggg

SEQ ID NO: 384741 - DNA, 584 bp, Homo sapiens
  misc_feature: GZ8MTXP01EW9UE.25.71.G05.1.454.CMB.2.raw
  modified_base (362)..(362): a, c, t, g, unknown or other
  modified_base (423)..(423): a, c, t, g, unknown or other
  modified_base (535)..(535): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccaagactctcttgtgcagcctctggattcaacttcaaaggctacagcatgaactggatccgccaggccgtccgggggaaggtctgcaggtggatttcatccatttagtggtcttaagcgtagactaaattttngcagactcggtagaacggccgtacaccatcacagacgacacgccgacgtacttctctttcngacaaatcgaacacgacctacgacggagacccggaagaccgacggtcttgtttactttcgtgtgacggaggagggaaggtagggacgtaaacgttggacgtcggttacgggnggttgtaagtgttcgttttgtagtttcggtaagggggttccgtaagggg

SEQ ID NO: 384742 - DNA, 588 bp, Homo sapiens
  misc_feature: GZ8MTXP01AIW4Q.25.71.G05.1.454.CMB.2.raw
  modified_base (358)..(358): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagcctgtggggtcccgaagactctcttgtgcagcctctggattcaacttcaaaggctacagcatgaactggatccgcaggcgtccggggaaggtctgcagtggatttcatccattagtggttacttaagcgtgaacctaatttngcagaactcggtgaaccggtccgtacaccatctcagacgacaacgccgtacgtactttcttactttcagacaaatcgaacacgacctcgaaggacgccgaacggacctacgggtctttggtttacttcgtggtcgcggaggaagggtaggttaggggacgaaaacgtcgggacttcggttacgggaggttgagttcgttcgtttggttacgtttcggttcggggaaccgg

SEQ ID NO: 384743 - DNA, 396 bp, Homo sapiens
  misc_feature: GZ8MTXP01CKKS5.25.71.G05.1.454.CMB.2.raw
  modified_base (366)..(366): a, c, t, g, unknown or other
  modified_base (387)..(387): a, c, t, g, unknown or other
  modified_base (394)..(396): a, c, t, g, unknown or other
tcagactgtacagtcacgaccggtgctcgatttagtgtcgtcgcaagagagaggggtgagggtttagaacctatgaacattctgtaggggccactgtcttctcacggtgctcccaaaactgtgatgtttggaaattctccgccctcagggatccctgaccgcttctctggctcgaagtctgggaccacagcctccctgactatctcggacctccagcctgaggacgaggctgattattactgttctacatgggactacagcgtcagtggtcatgtggtttcggcggaggcaccaagctgaccgtcctaggtcagcccaaggctcgccccctggtccactctcgttcccgccctcctccactgtacngtctgagcggctggcaaggcncgatagnnn

SEQ ID NO: 384744 - DNA, 554 bp, Homo sapiens
  misc_feature: GZ8MTXP01A5XZY.25.71.G05.1.454.CMB.2.raw
  modified_base (497)..(497): a, c, t, g, unknown or other
  modified_base (501)..(501): a, c, t, g, unknown or other
  modified_base (503)..(503): a, c, t, g, unknown or other
  modified_base (507)..(507): a, c, t, g, unknown or other
  modified_base (511)..(511): a, c, t, g, unknown or other
  modified_base (541)..(541): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccaggccggggggtccctgagactctcctgtgcagcctctggattcagttttagcagtattggatgagcgtgggtccgccaggcccccaggggaggggctgggtgtgggtagccaacatacacgaagatggaggtgaagaaatactaagtggcggaacttcgtgtggaaacggggcccgtattccgaacccattaccctaccgaacggggaaccaaacctccaaacaactacagttaatatctagacaaaatgaaagtgggtactgagagccgaggacacggtntgtntnttgngtgngagcgcgacccattccataacgactgtgtntttagtgttgtgg

SEQ ID NO: 384745 - DNA, 547 bp, Homo sapiens
  misc_feature: GZ8MTXP01EO1XP.25.71.G05.1.454.CMB.2.raw
  modified_base (354)..(354): a, c, t, g, unknown or other
  modified_base (508)..(508): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccaagactctcttgtgcagcctctggattcaacttcaaaggctacagcatgaactggatccgccaggctcggggaaggtctgcagtgatttcatccattagtgtcttaagcgtagactaaattttngcagactcggtagaacggccgttcaccatctaccagacgacaacgccgacgtactttctctttctgacaaatgaacagcctcaggagccgaggacacggcttgtttattcgtgtgcgagagggaagtgggacgaaaacgttgggctcgacgggnggttgaatgtctttttgagtttcgtcgggggcgtaaggg

SEQ ID NO: 384746 - DNA, 603 bp, Homo sapiens
  misc_feature: GZ8MTXP01AF9WP.25.71.G05.1.454.CMB.2.raw
  modified_base (359)..(359): a, c, t, g, unknown or other
  modified_base (424)..(424): a, c, t, g, unknown or other
  modified_base (469)..(469): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggactccgcaggcgtccggggaaggtctgcagtgatttcatccagttagtgtacttaagcgtagaactaatttangacagactcggtacgaacggccgttcactatctacagacgacacgccgacgtactttctctttcngacaaatcgaacacgcctacgagggacgaccggagaccgacggtnttgtttatttcgtgtcggcgtaggagggaaggtacggggaacgtaaaacgttcgggtaccgtacggttacgggttaggttgtaagttgttccgttttggtacgtttcgggtaacggggttaacccgtaaagggg

SEQ ID NO: 384747 - DNA, 655 bp, Homo sapiens
  misc_feature: GZ8MTXP01CNYGY.25.71.G05.1.454.CMB.2.raw
  modified_base (368)..(368): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggagcctggtcaaggccgtgggggtcccaagactctcttgtgcaggcctgtggattcaacttcaaaggctacagcatgaactggactccgccgaggccgtaccgggggaaggtctgcagtggatttcatccatttagtggtacttaagcgtagaactaaattttagngacagtacgtcgggtacgaaccggtccgtacacctactcacgagacgacacgaccgtacgtctttcttcttactacgaactaaacgtacgaacacgtacctacgaacggggacggaccggacgtaaccgtacggttctttagttttacttcgtaggtcggacggtaagggagggtaacgggtacggggaaacgtaaacggttggtaccgttacggttaacgggttggttagtaagttggtttaacgtttaggtacggtttacgggtaacggggttaaccgtaacggg

SEQ ID NO: 384748 - DNA, 544 bp, Homo sapiens
  misc_feature: GZ8MTXP01B5RQF.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttgggtccaggccggggggtcctgagactctcctgtgcagcctctggattcagttttagcagtatttggatgagctgggtccgccaggccccaggggaggggctgggtgtgggtagccaacatacacgaagatggaggtgaagaaatactagtgcggaactcgtggtagaaaggggccattcgaccatcctccagggaccaactccaaacaactcagtatatctgacaaatgaagtggtctgagagccgaggacacggctgtgttattcgtggtgccggagcgtcgaccccgagttccaagtaacgacccttaatcgtcttttgaagttaagtcgggg

SEQ ID NO: 384749 - DNA, 652 bp, Homo sapiens
  misc_feature: GZ8MTXP01CDIZI.25.71.G05.1.454.CMB.2.raw
  modified_base (293)..(293): a, c, t, g, unknown or other
  modified_base (332)..(332): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgcttattttagaaggtgtccagtgtgaggtgcagttggaggagtcgtgggggaggcttgggtccagggccggggggtcctgagactctcctgtgcagcctctggattctagtttagctagtattggatgagcgtgggtccncgaggccccgaggggaggggctgggtgtgggtagccaanataacgacgaaagagtagggaggtagaaagaaatactaagtggacggtaacttcgtggtaggaaacgggccgtattaccaaccgtaactccgtacccgaacgggaacaaacctaccaaacaactacaagtaatactctagaacaaagttgaaaggtggtacgtagaggacgcggtaacggacgtaacgggtctggttagttacgtttcgtggttggacggaacggacgttcccggaaccccgttaacttcccgttaacgttaaccggtaccccttaagttaccggttacgtttttacggaacgtttaacggttcgggggg

SEQ ID NO: 384750 - DNA, 626 bp, Homo sapiens
  misc_feature: GZ8MTXP01B9C9B.25.71.G05.1.454.CMB.2.raw
  modified_base (310)..(310): a, c, t, g, unknown or other
  modified_base (361)..(361): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggatccgcaggcgtccggggaggtcngcagtggatttcatcctagttagtggtcttaagcgtagaactaaattttangcagtacgtcggtaacgaaccgggtccggttacaccatctacagacgacacgccgacgtactttctcttctgacaaatcgaacacgcctacgaacggacgggaccgagggaccgacggtcttagtttacttcgtggtcggcggtaagggagggaagggtaacggggaacgttaaaacggtcgggaccgttacggtacgggttagggttgttagttgttcgttttggtacgtttcgggttacggggtaacccgttaaggggtaacg

SEQ ID NO: 384751 - DNA, 527 bp, Homo sapiens
  misc_feature: GZ8MTXP01EX6AT.25.71.G05.1.454.CMB.2.raw
  modified_base (330)..(330): a, c, t, g, unknown or other
  modified_base (463)..(463): a, c, t, g, unknown or other
  modified_base (469)..(469): a, c, t, g, unknown or other
  modified_base (476)..(476): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggagcttggtccaggccgggggggtccctgagactctcctgtgcagcctctgggattcagttttagcagtatttggatgagctgggtccgccaggcccccaggggaaggggctgggtgtgggtagccaanatacacgagatggaggtgaagaaatactagtgcggaactcgtgtgaaagggccgattcgaccatctcgaggacaactccaacactcagtatatctgacaaatgaagtgtctgagagccgagacgacggctgtntatttntgtgcgngagtcgcccgaattccataacgaccctaatgtctttgaacgttaagtgggg

SEQ ID NO: 384752 - DNA, 666 bp, Homo sapiens
  misc_feature: GZ8MTXP01EPZAK.25.71.G05.1.454.CMB.2.raw
  modified_base (279)..(279): a, c, t, g, unknown or other
  modified_base (281)..(281): a, c, t, g, unknown or other
  modified_base (351)..(351): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggaggcttggtccagccggggggtccctgagactctcctgtgcagcctctggattcagttttagcagtattggatggangngcgcgccgaccggacccggacggggacgggacggtggtggtgggtacggacgaacgaacgtaacgaacgnaaacgtaggtaggtaaggtaggaagtaaaagtaacgtaagtacggtacggtacgtacgtcggtacgggtacgggacggtacgtaccgtaccgacgtacctaccgtaccggaaccgaacctaaccaaaccaacctaactaacgtaactaacttacgtacgtaacgtaacgtaacgtaagtacgtacgtacgaggacggtacggacggacggacggtaacgtcggttagttacgttcgttacgtcggttacggttacggttacggtaaccggtacccggtaaccgtaccgtacgttaccgtaaccgttaacgtaacg

SEQ ID NO: 384753 - DNA, 560 bp, Homo sapiens
  misc_feature: GZ8MTXP01DRDLI.25.71.G05.1.454.CMB.2.raw
  modified_base (535)..(535): a, c, t, g, unknown or other
  modified_base (541)..(541): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttggtccgaggccggggggtcctgagactctcctgtgcagcctctggattcagttttagcagtattggatgagctgggtccgccgaggccccgaggggaggggctgggtgtgggtagccaaacataacgacgaagagtgggaggtgaagaaatactagtgcgaactcgtgtgaagggccatcacatctccgaggacaactaccaactaactcagtatatctagacaaatgaagtggtctagagagccggaagacgacggcttggttagttatttcgtggttcgcggagttacgtccggacccccgaattccaactaacgtaacccttnttcgtnttttagtaagttggtcggg

SEQ ID NO: 384754 - DNA, 725 bp, Homo sapiens
  misc_feature: GZ8MTXP01AV8XD.25.71.G05.1.454.CMB.2.raw
  modified_base (294)..(294): a, c, t, g, unknown or other
  modified_base (337)..(337): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtggggggagcttgggtccaggccgggggggtccctgagactctcctgtgcagcctctggtattctagttttagcagtattggatgagcgtgggtccnccgacggccccgaggggaggggctgggtggtgggtagaccaanatacgacgaagatggagtgaagaaatacgtagtgcggtaactcgtggtaggaaacggggcccgtacttccgaacccattacccgtacccgaaacggggaaccctaaacccttacccaaaaccaaacctaccgaagttaataactaccgttagaacctaaaagttgtaaacggttgggttaccgtaggaaacgggaaccgaccccgggaaagggaacccgtaaccgggggtccttaagggtttcgtttaacgttttccggtaaggttcgggaccgggtaacggttacgggttacccgaacccccggttaaacttcccgttaacgttaacccggtaacccctttaagttccggttaccgttttttaggaacgtttaagggttccgggggg

SEQ ID NO: 384755 - DNA, 657 bp, Homo sapiens
  misc_feature: GZ8MTXP01BCDHF.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttgggtccaggccggggggtcctgagactctctgtgcagcctctggtattcagttttagcagtattggatgagcgtggggtcccgccgacggccccgagggggaacggggtcgtgggtggtgggtacgacccgaacgatacgaacggaagagtagggaggtaggaaacgtaaatacgtagtcggacgtaacttcgtggtagggaacgggccgtattaccgactattccaccgaacggaacctaaccaccaaacctaactaacgattaactacttaccgataaactaaagtagtaaggttcggtacgtaggaacggacgaccggaaggaccgtaccggtgttagttagttacgtttgtggttcgacggtaacggttcgtacccggaccccgaacttcccgaacgttaaccgaccctttaagtacgtttcgtttagtaagttaacgttggggg

SEQ ID NO: 384756 - DNA, 709 bp, Homo sapiens
  misc_feature: GZ8MTXP01DTOX4.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttggtccgaggccggggggtcctgagactctctgtgcagcctctggtattcagttttagcagtatttggatgagcgtgggtccgccgacggccccgaggggaacggggtctgggtggtgggtacgccaacataacgaacggaagagtggaggtgaagaaatactagtgacggtaacttcgtggtaggaaacggggcccgtattacccgacctatcctaccgaagggaaccaaaccgtacccaaactaaactaccgtaagttaactactacgttacgaactaaaagttagtaaaggttcgggttaccgttagggaacgggaacggacccgggaaacgggaacccgtaacggggtccgtttagggttacgtttaacttttccggtaaggtcggttacgggtaacggttacggtacccggtacccccgttaaacgttcccttaaacgttaacccggtaaccctttaagttcgtttacgttttacggtaagtttaacggttgggggg

SEQ ID NO: 384757 - DNA, 599 bp, Homo sapiens
  misc_feature: GZ8MTXP01BWUZC.25.71.G05.1.454.CMB.2.raw
  modified_base (366)..(366): a, c, t, g, unknown or other
  modified_base (549)..(549): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtgggctccgctgggttttccttgtcgctattttagaaggtgtccagtgtgaggtggtgctggtggagtcgtgggggagcctggtcaagccgtggggggtcccaagactctcttgtgcagcctctggattcaacttcaaaggctacagcatgaactggactcccgcgaggccgtaccgggggaaggtctgcagtggtatttcatcctagtttgtggtacttaagcgtagaactaaattttngacagacgtacgggtagaaccggtccgttacaccgtatcctaccagacgacaacgccgtacgtactttctcttactagtacaatagactacgacctacacgggacgccggaacggaccgtacggtcttgtttatttcgtgtgcgaggaggaaggtcgggacgaaacgttggactgttacgggnggttgtaagttgtcgttttgtacgtttcggtaacgggttaaccgtaaggg

SEQ ID NO: 384758 - DNA, 567 bp, Homo sapiens
  misc_feature: GZ8MTXP01EN8EX.25.71.G05.1.454.CMB.2.raw
  modified_base (379)..(379): a, c, t, g, unknown or other
  modified_base (485)..(485): a, c, t, g, unknown or other
  modified_base (518)..(518): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggagcctggtcaagcctggggggtcccgaagactctcttgtgcagcctctggattcaacttcaaaggctacagcatgaactggatccgccaggctccggggaaggtctgcagtggatttcatccattagtggtcttaagcgtgacaaattttatgcagactcggtgaacggcccggttnaccatctccagaagacaacgccgacgactttctctttctgacaaatgaaacagcctacaggacgccgagggacacgggctcgtttattactgtgacggtgaagggnggtggggacgaaaacgttggcgtcgttacgggnggaggtaatggttccgtttggtactttcggtcggggttaacgaacgggg

SEQ ID NO: 384759 - DNA, 649 bp, Homo sapiens
  misc_feature: GZ8MTXP01AGHR0.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttgggtccagggccggggggtcctgagactctcctgtgcagcctctggtattctagttttagcagtatttggatgagcgtgggtcccgccgacggccccgaggggacggggcgtggggtggtgggtagaccaacatacgaacggaagagtggaggtagaagtaaatactaagtggacggtaactcgtggtaggaacggggccgtattaccgactactcctaccgaagggaaccaacctaacccaaactaactacgattatataccgtagaactaaagtgaaaggtggtacgtagaacggacgcccggaaggaccgtacggtcttaggtagtttacgtttcgtggtcgttacggacgttacggtcccggaaccccgttaacttcccgttaactaaccggtaaccccttgttacgttccgttttagtaacgttaaggtcgggggg

SEQ ID NO: 384760 - DNA, 593 bp, Homo sapiens
  misc_feature: GZ8MTXP01E1B5S.25.71.G05.1.454.CMB.2.raw
  modified_base (292)..(292): a, c, t, g, unknown or other
  modified_base (520)..(520): a, c, t, g, unknown or other
  modified_base (540)..(540): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttgggtccaggccggggggtccctgagactctcctgtgcagcctctggattcagttttagcagtatttggatgagcgtgggtcccnccgacggcccccgaaggggaacggggctggggtcgtgggggtaacgccgaaacgagtaaccaacggaaagagtaggggaggtagaaaggaaatactagtggaccggtaaactcgtggtaggaaagggcccgatttccgaccatccctaccgagggacctaaacctaccaaactaactacgaagttatactctagacaaatgaagtggtctgacgagcgaggacacggntgtgtattcgtgtgcggagngtcgccccgaattccactaacgaccctaatcgtactttgaagttaagtcgggg

SEQ ID NO: 384761 - DNA, 571 bp, Homo sapiens
  misc_feature: GZ8MTXP01D88DS.25.71.G05.1.454.CMB.2.raw
  modified_base (315)..(315): a, c, t, g, unknown or other
  modified_base (357)..(357): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtgggggagcctggtcaaggccgtggggggtcccaagactctcttgtgcagcctcgtggattcaacttacaaaggctacagcatgaactggactccgccgaggccgtcggggaggtcngcagtgtattcatcattagtggtctaagcgtagactaatttngcagacgtcggtagaacggtcgttcatcatcacagacacacgcgacgtacttcttcttctagacaatacgaacacgtcctacgagacgaccgagacgtacgtcttgtttacttgtggtgacgtagggaaggtggttagggacgaaagtcggtacttccggttagggaggtgtagttcgttcgtttgttacggtttccggttaaggggtaaccgg

SEQ ID NO: 384762 - DNA, 566 bp, Homo sapiens
  misc_feature: GZ8MTXP01B1EBQ.25.71.G05.1.454.CMB.2.raw
  modified_base (361)..(361): a, c, t, g, unknown or other
  modified_base (496)..(496): a, c, t, g, unknown or other
  modified_base (526)..(526): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggactccgccaggcgtccggggaaggtctgcagtggatttcatccatttagtggtcttaagcgtagactaaattttngcagactcgggtgaaccgggccgttacaccatcctccagacgacaacgccgacgtactttctctttctcgtacaaatgaacagcctgacggacgccggagacgacggtcttgtttatttctgtcgtcgaggaggnggtgggacgaaacgttggcgtcgttacggnggttgaatgtcttttgatttcggcgggttaaccgtaaggg

SEQ ID NO: 384763 - DNA, 544 bp, Homo sapiens
  misc_feature: GZ8MTXP01CO4SQ.25.71.G05.1.454.CMB.2.raw
  modified_base (413)..(413): a, c, t, g, unknown or other
  modified_base (464)..(464): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggaggcttggtccagccgggggggtccctgagactctcctgtgcagcctctggattcagttttagcagattggatgagctgggtccgccaggccccagggaaggggctggtgtgggtagccaaacgatacacgaaagatggaggtgaagaaatactatgcggaaactctgtgaaagggccgattcaccatctccagggacaactccaacaacncagtatatctgacaaatggaaatggtactgagagccgaggacaaccgggtntgtagttattgtgtgagagacgtaccgaccccgaacgttccactaacgacccttaagtcgtctttagtaagttaagtggg

SEQ ID NO: 384764 - DNA, 632 bp, Homo sapiens
  misc_feature: GZ8MTXP01BDHTQ.25.71.G05.1.454.CMB.2.raw
  modified_base (368)..(368): a, c, t, g, unknown or other
  modified_base (544)..(544): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggacgtggggggtcccgaagactctcttgtgcagcctctggattcaacttcaaaggctacagcatgaactggactccaccgaggccgtccgggggaaggtctgcaggtgatttcatccatttagtggtacttaagcgtagtaactaaattttngctagtaccgtacgggtacgaaccggggtcccggttaccaacccgtatcctaccgaagacgaaccaaccggcccgtacgtactttccttctttactagactaaagtcgaaaccacgacctacgaggggacgccggaacggaccgtacggtccttagtttattcgtgtcgcgtaggngggaaggtacgggaacgtaaacgttggacgtacggagggttggttgtaagttgtcgttttagtcgtttacggtcgggaaccgtaaggg

SEQ ID NO: 384765 - DNA, 542 bp, Homo sapiens
  misc_feature: GZ8MTXP01DJE7B.25.71.G05.1.454.CMB.2.raw
  modified_base (330)..(330): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccaggccgggggggtcctgagactctcctgtgcagcctctggattcagttttagcagtatttggatgagctgggtccgccaggccccaggggaaggggctgggtgtgggtagccaanatacacgaagatgggagtgaagaaatactagtgacggaactctgtagaagggccgattccacatcctcagggacaactccaaacaactcaagtatatctagacaaatagaaagtggtactagaagacgccgaggacacggctgtgttacttcgtgtgcgagagtcgaccccgaattccataacgaccctaatgtcttttgaagttgtcgggg

SEQ ID NO: 384766 - DNA, 732 bp, Homo sapiens
  misc_feature: GZ8MTXP01BCSJR.25.71.G05.1.454.CMB.2.raw
  modified_base (275)..(275): a, c, t, g, unknown or other
  modified_base (361)..(361): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggtttccttgtcgctattttagaaggtgtccagtgtgaggtggtgctggtggagtcgtgggggagcctggtcaagccgtggggggtcccaagctctcttgtgcagcctctggattcaacttcaaaggctacagcangaactggatcccgcaggcgtccggggaaggtctgcagtggatttcatcctagtttagtggttcttaagcgtagaactaaatttttnagcagtacgtcggggtagaacccgggtcccgggttaccaacccgtactacctacccgaaaggtacgaacccgaaccggacccggtaaccgttaccttttccttacgttttacctacggtactaaaacgtacgaaacctacgtacccgtaccgaaggggacggtacccgggaacggaaccgtaccgggtcctttaggttttaacgttttccgtggttagggtaccggaagggtaggggtaagggttacgggggaaacggtaaaaaccgttcggggtaccttacccgggttaacgggttacgggttacgtaagttcggttaaccgtttttaggtaggttttccgggtaacgggggttaacccgttaaaggggg

SEQ ID NO: 384767 - DNA, 590 bp, Homo sapiens
  misc_feature: GZ8MTXP01BR7I5.25.71.G05.1.454.CMB.2.raw
  modified_base (359)..(359): a, c, t, g, unknown or other
  modified_base (542)..(542): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccaagactctcttgtgcagcctctggattcaacttcaaaggctacagcatgaactggactccgcaggccgtaccggggaaggtctgcagtggatttcatccattgtggtacttaagcgtagactaaatttngacagactcgggtagaacggcgttcaccatctccagacacaacgccgacgtacttctctttctcgtactaaatagaacacgacctacagggacgaccggaacggaccgacggtcttaggtttactttcgtgtgacggagagggtaaggtacgggacgtaaaacgttggtacgtcgttacgggnggttgtaagtgtcgttttggacgtttcggtggggttaaccgtaagggg

SEQ ID NO: 384768 - DNA, 617 bp, Homo sapiens
  misc_feature: GZ8MTXP01DLFRY.25.71.G05.1.454.CMB.2.raw
  modified_base (367)..(367): a, c, t, g, unknown or other
  modified_base (558)..(558): a, c, t, g, unknown or other
tcagactgtacagtcacgaccggtgctcgatttagtgtcgtcgcaagagagaggagccttagccctggattccaaggcctttcaacttggtgatcagcactgagcaccgaggattcaccatggaagtggggctccgctgggttttccttgtcgctattttagaaggtgtccagtgtgaggtggtgctgggtggagtcgtggggggagcctggtcaagccgtggggggtcccaagactctcttgtgcagcctctggattcaacttcaaaggctacagcatgaactggactccgcgaggcgtccggggaaggtctgcaggtggatttcatcctatttagtggttacttaagcgtagaacttaaattttngacagactcgggtagaaccggccgttacacctatcctacgagacacaacgccacgtactttctcttctgacaaatacgaacacgtacctacgacgggacggaccggaacggacgacggtcttgtttactttcgtgtgacggaggagggtaaggtcgggaaacgtaaacgttcggtacgtcggttaacgggnggttagtaagttgttcgttttgtacggtttaccggtaacggggttaacccgtaaagggg

SEQ ID NO: 384769 - DNA, 513 bp, Homo sapiens
  misc_feature: GZ8MTXP01EZX1Y.25.71.G05.1.454.CMB.2.raw
  modified_base (291)..(291): a, c, t, g, unknown or other
  modified_base (328)..(328): a, c, t, g, unknown or other
  modified_base (419)..(419): a, c, t, g, unknown or other
  modified_base (424)..(424): a, c, t, g, unknown or other
  modified_base (426)..(426): a, c, t, g, unknown or other
  modified_base (431)..(431): a, c, t, g, unknown or other
  modified_base (458)..(458): a, c, t, g, unknown or other
  modified_base (465)..(465): a, c, t, g, unknown or other
  modified_base (473)..(473): a, c, t, g, unknown or other
  modified_base (500)..(500): a, c, t, g, unknown or other
  modified_base (502)..(502): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggagcttgggtccaggccgggggggtccctgagactctcctgtgcagcctctgggattcagttttagctagatttggatgagctgggtccnccaggccccagggaggggctgggtgtgggtagccaanatacacgaagatggagtgagaaatactagtgcggaactgtgtagaagggccgattcacatctaccgaggacaactccaaacactacagtanatcananaatanagtgtgtagagacgacgacgacgacgngtgtgtnttgtgtgngagcgcgaccgacgcactaacactctntnttgtgttgtgg

SEQ ID NO: 384770 - DNA, 779 bp, Homo sapiens
  misc_feature: GZ8MTXP01DBY4R.25.71.G05.1.454.CMB.2.raw
  modified_base (249)..(249): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttgggccaggccggggggtcctgagactctcctgtgcagcctntggtattcagtttagctagtattggatgagctgggtccgccgaggcccccgaggggaacggggctgggtggtgggtacgaccgaactatacgacgaagagtagggaggtagaacgaaatactaagtgggaccggtaaacttcgtggtacgggaaacgggggtcccgtaatttcccgaaccgtacttacccgttacccgtaagggggaaaccaaaccccgttacccaaaaccgtaaaccgtacccgtaaacgtttaaactaaaattcccttaacggaacgtaaaacttaaacggtaaaacggggttacggggtttacggtttaacggtaaagggtaaaccgggtaaacccgggtaaccggggtaaaccggaaacccggggtaaacccgttacggtttcgggttaacttttcgtttaacggttacggggttacggtacggttacggtaccgtaaccccgttaaccgttaccgttaacgtaaccgtaaccgttaacgttacgttacgtttacgttaacgttaacggtaacggg

SEQ ID NO: 384771 - DNA, 539 bp, Homo sapiens
  misc_feature: GZ8MTXP01BJQ6N.25.71.G05.1.454.CMB.2.raw
  modified_base (331)..(331): a, c, t, g, unknown or other
  modified_base (497)..(497): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttggtccaggccgggggggtccctgagactctcctgtgcagcctctggattcagttttagcagtatttggatgagctgggtccgccgaggccccgaggggaaggggctgggtgtgggtagccaanatacacgaagagtggaggtgaagaaatactagtgcggaactcgtgtggaaagggccagttcaccatcctaccgagggacaactccaaacactacagtatactctagacaaatgaagttggtctagacgagccgaggacgacggctggtgttagttctggtgcgagngtcgcccgaattccatcgacctaatgtctttgcttgtcgggg

SEQ ID NO: 384772 - DNA, 584 bp, Homo sapiens
  misc_feature: GZ8MTXP01AZEAO.25.71.G05.1.454.CMB.2.raw
  modified_base (356)..(356): a, c, t, g, unknown or other
  modified_base (540)..(540): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggtttccttgtcgctattttagaggtgtccagtgtgaggtggtgctgggtggagtcgtggggggaggcctggtcaagccgtggggggtcccaagactctcttgtgcagcctctggattcaacttcaaaggctaacagcatgaactggactccgccaggcgtccggggaggtctgcagtgtattcatcagttagtgtcttaagcgtagactaaatttngacagtacgtcggtacgaacggccgttacacatcctacagacacacgccgacgtactttactctttactgactaaatacgaactacgcctacgagggacgccgaaggaccgacggtcttgtttactttcgtgtggacggaggagggtaaggtcgggacgtaaacgttcgacgtcggttaagggnggttgtaagtgttctttggtacgttcgtcggggaaccgtaaggg

SEQ ID NO: 384773 - DNA, 615 bp, Homo sapiens
  misc_feature: GZ8MTXP01CJVQF.25.71.G05.1.454.CMB.2.raw
  modified_base (355)..(355): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccaagactctcttgtgcagcctctggattcaacttcaaagctacagcatgaactggactccgcgaggccgtcggggaggtctgcagtggatttcatctattaggtgtctaagcgtagactaattttngcagacgtcggtacgaaccggtccgtacacctatcaccagacgaccacgccgtacgtacttctcttctagacaaatcgaacacgacctagaacggacggacccgggaaggaccgtacggtctttaggtttactttcgtagtggcggtaaggaggtagggtaacggggaacaaacggtggaccgtacgtacggggttaggttggttagttcggttcgttttcggtacgtttcgggttacggggtaaccgttaagggtaacg

SEQ ID NO: 384774 - DNA, 587 bp, Homo sapiens
  misc_feature: GZ8MTXP01CQTX4.25.71.G05.1.454.CMB.2.raw
  modified_base (280)..(280): a, c, t, g, unknown or other
  modified_base (314)..(314): a, c, t, g, unknown or other
  modified_base (336)..(336): a, c, t, g, unknown or other
  modified_base (360)..(360): a, c, t, g, unknown or other
  modified_base (421)..(421): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggccgtggggggtcccgaagactctcttgtgcagcctctggattcaacttcaaaggctacagcangaactggactccgccaggcgtccggggaaggtcngcagtgtatttcatccatttgngtacttaagcgtgaactaaatttngcagactcggtagaacggtccgttcaccatcctcagacacacgccgacgtactttctcttntcgacaatacgaacacgacctacgacgggacgaccggaggacgacggtcttgtttacttacgtgtgtcgaggtaggaaggtgggacgtaaacgttggtaccgtcgttacgggaggttgtaagttgttcgttttaggtagtttcggtcggggttaaccgtaaagggg

SEQ ID NO: 384775 - DNA, 623 bp, Homo sapiens
  misc_feature: GZ8MTXP01A0D9E.25.71.G05.1.454.CMB.2.raw
  modified_base (368)..(368): a, c, t, g, unknown or other
tcagactgtacagtcacgaccggtgctcgatttagtgtcgtcgcaagagagagggccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggagcctggtcaagccgtggggggtcccaagactctcttgtgcagcctctggattcaacttcaaaggctacagcatgaactggactccgccgagggccgtaccgggggaaggtctgcgaggtggtatttcatcctagtttagtgtacttaagcgtagaactaaatttngacagactcggtaagaaccgggtccgttacaccatcctccgaagacaccaacgccgaacgtctttctctttacacgactaaagtcgaaacacgccctagaacggacggacccggtaaggaccgtaccgggttctttcgtttaactttccgtggttgcggtaaggacggggtaggtaacgggaacgaaacgtgggcttacggtacgggagttgattgtcgttttggctttcggacggggtaaccttaaggggtaac

SEQ ID NO: 384776 - DNA, 650 bp, Homo sapiens
  misc_feature: GZ8MTXP01ARL0U.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgcttattttagaaggtgtccagtgtgaggtgcaggttggaggagtcgtgggggaggcttgggtccgagggccggggggtcctgagactctctgtgcagcctctggtattcgtagttttagctagtatttggatgagcgtgggtccgccgacggccccgaggggaggggctggggtgtgggtacgaccaacatacgacggaagagtggaggtagaacgtaaatactagtgcggtaactcgtggtaggaaacggggccctattccgacctatccgtacccgaagggaacctaaacctaccaaacctaactacgtaacgttactactacctagaactaaagtagtaaagttcggtacgtaggaacgacgccggaaggacgacggtcttaggttagttactttcgtggtcggacggtaaggttacgtacccggaaccccgttaattccgaacgttaaccggtacccttaagttcgttacgttttagaacgtttggtcggggg

SEQ ID NO: 384777 - DNA, 532 bp, Homo sapiens
  misc_feature: GZ8MTXP01AB8OS.25.71.G05.1.454.CMB.2.raw
  modified_base (332)..(332): a, c, t, g, unknown or other
  modified_base (350)..(351): a, c, t, g, unknown or other
  modified_base (375)..(375): a, c, t, g, unknown or other
  modified_base (406)..(406): a, c, t, g, unknown or other
  modified_base (411)..(411): a, c, t, g, unknown or other
  modified_base (419)..(419): a, c, t, g, unknown or other
  modified_base (422)..(422): a, c, t, g, unknown or other
  modified_base (459)..(459): a, c, t, g, unknown or other
  modified_base (492)..(492): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtggggggaggcctgggtcaagccgtggggggtcccgaagactctcttgtgcagcctctggattcaacttcaaaggctaacagcatgaactggatccgcaggctccggggaaggtctgcagtgattcatcattagngtctagctgactaatttnncagcgtaggacgaacggcgtcacnctcacagacgacacgcactacttctcttcanacaanacgacacncanaggacgcgagacacgtctgttatctgtgagaggaggnggtacggacgtaaacgttgacgtcggttacggnggttgtaatcgttcgtttgtagttcggtcggaacgtaagg

SEQ ID NO: 384778 - DNA, 566 bp, Homo sapiens
  misc_feature: GZ8MTXP01BBJC3.25.71.G05.1.454.CMB.2.raw
  modified_base (358)..(358): a, c, t, g, unknown or other
  modified_base (529)..(529): a, c, t, g, unknown or other
  modified_base (547)..(547): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggagcctggtcaagccgtggggggtcccaagactctcttgtgcagcctctggattcaacttcaaaggctacagcatgaactggatccgccaggcgtccggggaggtctgcagtgatttcatccatttagtggtacttaagcgtagaactaattttangcagactacgggtgaacggtccggttacaccatctacagacgacaacgccgacgtacttctctttctgacaaatacgaacacgtacctacaggggacgtacggacggacgtacggcttgtttatttctggtgacgaggaggaaggtagggacgaaacgttgcgtgacgggngttgtaagtgtctttagngtttcggtgggcgtaaggg

SEQ ID NO: 384779 - DNA, 727 bp, Homo sapiens
  misc_feature: GZ8MTXP01ETLCL.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagtcgttgggtccgagggccggggggtcctgagactctcctgtcgcagtcctcgtggtattcgtagttttagctagtattggatgagtcgtcgggtccgccgacggccccgaaggggacggggtctaggggtggtagggtaacgacccaaagaacgtaacgaacggaaagtagtagggaaggtagaaagtaaatacgtaagtcggaccggtaactcgtgggtaggaaacgggtccgtacgttacccaactacgttacccgtaccggaaacgggaaccctaaacctacccaaaacctaacttaccgtaaagttacttaacgtactacgtaaactaaattcggtaaaggttgggttaccgtaggaacggaacggtaccggaacggaccgtaaccgggtcgtttaggttacgtttagtttcgtaaggtcggacgggtagttacggttacccgaaccccgttaattcccgttaacgtaaccggtaccctttaagtcgtttacgtttagtaacgtttggtaaccggggg

SEQ ID NO: 384780 - DNA, 614 bp, Homo sapiens
  misc_feature: GZ8MTXP01DK3HL.25.71.G05.1.454.CMB.2.raw
  modified_base (359)..(359): a, c, t, g, unknown or other
  modified_base (568)..(568): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtggggggaggcctggtcaagccgtggggggtcccaagactctcttgtgcagcctctggattcaacttcaaaggctacagcatgaactggatccgcaggcgtccggggaaggtctgcagtgatttcatccatttagtggtacttaagcgtagactaaatttngacagtacgtacgggtgaaccgggtccgttacaacctatcctaccgaagacgaaccaaccgacccgtacgtactttcttctttctacgtacaaatagaaacacgacctacgacggggacgaccggacggaccgacggtcgttgtttatttcgtggtggtacggaggagggtaaggtagggacgtaaacgttggtacgtacgttacgggnggttgtaagttgtcgttttgtagtttcggtcggggaaccgtaaggg

SEQ ID NO: 384781 - DNA, 598 bp, Homo sapiens
  misc_feature: GZ8MTXP01B7F4T.25.71.G05.1.454.CMB.2.raw
  modified_base (361)..(361): a, c, t, g, unknown or other
  modified_base (549)..(549): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggactccgccaggcgtccggggaaggtctgcagtggatttcatccatttagtggtcttaagcgtgactaaattttangacagacgtacgggtacgaaccgggtccgttacacctatcctaccagacgaacaacgccgtacgtactttcttctttactagtacaaatacgaacacgacctacacggacgaccggacggacgacgtcttgtttatttcgtgttgcgtaggaggaaggtgggacgtaaacgttggactcggttacggnggttgaagtcgttgttttacgtgtttacggtcggggttaacgtaacggg

SEQ ID NO: 384782 - DNA, 607 bp, Homo sapiens
  misc_feature: GZ8MTXP01CFIR3.25.71.G05.1.454.CMB.2.raw
  modified_base (354)..(354): a, c, t, g, unknown or other
  modified_base (449)..(449): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccaagactctcttgtgcagcctctggattcaacttcaaaggctacagcatgaactggatccgcaggctccggggagtctgcagtgattcatccattagtggtcttaagcgtagactaaattttacngacagactcgggtaacgaaccgggtccggttacaccgtatcctaccgaagacgaccaacgccgacgtacttctactttctagactaaatcgaacncgcctcagacgggccgaaggaccacggtcttagtttactttcgtggtcgtacggagagggaggtaacgggaacgttaaaacgtcggacgtacgtacgggaggttgttagttgttcgttttgtagtttcggttacggggtaaccgttaaggggtaaccg

SEQ ID NO: 384783 - DNA, 670 bp, Homo sapiens
  misc_feature: GZ8MTXP01CHOSQ.25.71.G05.1.454.CMB.2.raw
  modified_base (358)..(358): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggagcctggtcaagccgtgggggtcccaagctctcttgtgcagcctctggattcaacttcaaaggctacagcatgaactggactcccgccaggcgtccgggggaaggtctgcagtggatttcatccatttagtgtcttaagcgtagactaaattttngacagactcggtaacgaacggtcccgttcacctatcaccgagacacaacgccgacgtactttctcttctagactaaatcgaaacacgacctacgaacggaacgggacccggaacgggaaccgtaaccggttccgtttagtttttaacgtttccgttaggttacggtacgggtaagggacgggtaagggttaacggggaaacgttaaaacggtcggttaccgttaccgggtaacgggttagggttcgttaagtttcggttacgtttttggtacgttttcgggttacggggtaacccgttaaaggggttaaccg

SEQ ID NO: 384784 - DNA, 640 bp, Homo sapiens
  misc_feature: GZ8MTXP01EZ9AQ.25.71.G05.1.454.CMB.2.raw
  modified_base (297)..(297): a, c, t, g, unknown or other
  modified_base (567)..(567): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaggtgtccagtgtgaggtgcagttggaggagtcgtgggggagcttgggtccaggccgggggggtcctggagactctccgtgtgcagtcctgtggtattctagttttagctagtattggatgagcgtcggggtccnccgacggcccccggaggggaacggggtctggggtggtagggtacgaccaaacgataacgacggaagagttagggaaggtagaagtaaatacgtagtaggccgggtaaacttcgtggtacgggaaacgggggtccctaagttacccacgtacttaccctacccggaagggaaccctaaacctacccaaacgtaactaccgtaagttactacgtacttagaacaaagttagaaacgttgggttacaggaagacgtaccgaggacgacggttnttgttagttcgttgtgtgagtagcgtccgaccttacgttcactaacgtcttgtcgtcttagtaagttggtggg

SEQ ID NO: 384785 - DNA, 650 bp, Homo sapiens
  misc_feature: GZ8MTXP01CMLXL.25.71.G05.1.454.CMB.2.raw
  modified_base (377)..(377): a, c, t, g, unknown or other
  modified_base (544)..(544): a, c, t, g, unknown or other
  modified_base (589)..(589): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggagtgggctccgctgggttttccttgtcgctattttagaaggtgtccagtgtgaggtggtgctgggtggagtcgtgggggaggcctggtcaaggccgtggggggtcccgaagactctcttgtgcagcctctggattcaacttcaaaggctacagcatgaactggactcccgccgaggccgtccgggggaaggtctgctaggtggtatttcattcctagtttaggtggttacttaagcgtagtaacttaaattttngacagtacgtcgggtacgaacccgggtccgttaccacctactcctaccgaaggaacgaaccgaacccggccgtaacgttaccttttccttctttctacgactaaatcgaaacacgcctacgagggacgaccggacggacgcggtcttgtttacttcgtgtgcgaggngggtaaggtacgggacgtaaacgttggtaccgttaggttacgggnggttggtaagttggtttcgttttaggtacgtttaccgggtaacggggttaaccgtaagggg

SEQ ID NO: 384786 - DNA, 543 bp, Homo sapiens
  misc_feature: GZ8MTXP01DB3E7.25.71.G05.1.454.CMB.2.raw
  modified_base (477)..(477): a, c, t, g, unknown or other
  modified_base (488)..(488): a, c, t, g, unknown or other
  modified_base (496)..(496): a, c, t, g, unknown or other
  modified_base (530)..(530): a, c, t, g, unknown or other
tcagactgtacagtcacgaccggtgctcgatttagtgtcgtcgcaagagagaggagccttagccctggactccaaggcttttccacctggtgatcagcactgagcacagaggactcaccatggaattggggctgagctgggttctccttgttgctattttagaaggtgtccagtgtgaggtgcagttggaggagtcgtgggggagcttgggtccaggccggggggtccctgagactctcctgtgcagcctctggattcagttttagcagtatttggatgagctgggtccgccgaggcccccgaggggaaggggctgggtggtgggtagccaacatacgacggaagagtggaggtgaagaaatactatgacggaactctggtagaagggccgatccacatctccaggacaactccaacaactcagtataatctagacaaatgaaagttggtactaggaagacgccgaggacaaccggntgtgtatttcngtgcgagngtcgcccgaattccgataacgaccctaatcgttnttgtaagttgtgg

SEQ ID NO: 384787 - DNA, 586 bp, Homo sapiens
  misc_feature: GZ8MTXP01D4JAH.25.71.G05.1.454.CMB.2.raw
  modified_base (538)..(538): a, c, t, g, unknown or other
  modified_base (543)..(543): a, c, t, g, unknown or other
  modified_base (545)..(545): a, c, t, g, unknown or other
  modified_base (575)..(575): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaggtgtccagtgtgaggtgcagttggaggagtcgtggggggagcttgggtccaggccggggggtccctgagactctcctgtgcagcctctggattctagttttagctagtatttggatgagcgtgggtcccgccgacggcccccgaagggggaacgggggcttggggtggtagggggtacgccccgaaacagttaaccgaaggaaaggagttagggggaggtagaacgaaatacgtaagtggcggtaactcgtggtaggaaacggggcccgtattccacctatcccgtaccgagggacctaactccaaacaactcaagtatatcagacaaagtgaagtggtctgagacgccgaggtacacggctagtgttatttgngtcgngngcgtcgccgacgttcactaactactctgtnttgtgttgtgg

SEQ ID NO: 384788 - DNA, 614 bp, Homo sapiens
  misc_feature: GZ8MTXP01CN9P0.25.71.G05.1.454.CMB.2.raw
  modified_base (367)..(367): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtgggctccgctgggttttccttgtcgctattttagaaggtgtccagtgtgaggtggtgctggtggagtcgtgggggaggcctggtcaagccgtggggggtcccaagctctcttgtgcagcctcgtggtattcaacttacaaaggctacagcatgaactggactccgcaggccgtaccgggggaagtctgctagtggtatttcatcctattagtggtacttaagcgtagaactaaattttcngacagtactcggtaacgaaccggtcgttacacctatccaccagacgacacgccgacgtacttctcttctagacaaatcgaacacgacctacgaaggacgggacccgaaggaccgtacggtctttagtttacttgtagtcgacgaggtaggaggtaacgggaacgttaaaggtcgacgtaccgtagggttaggttgttagttcgttgttttggtacgtttcggacggggtaaccgttaagggtaaccg

SEQ ID NO: 384789 - DNA, 727 bp, Homo sapiens
  misc_feature: GZ8MTXP01D5ELN.25.71.G05.1.454.CMB.2.raw
  modified_base (251)..(251): a, c, t, g, unknown or other
  modified_base (382)..(382): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgcttattttagaaggtgtccagtgtgaggtggtgctggtggagtcgtgggggaggcctggtcaaggccgtggggggtcccaagctctcttgtgcagcctntggattcaacttcaaaggctacagcatgaactggactccgcagggccgtaccgggggaaggtctggcaggttcggtatttcattacctagtttaggtggttacttaagcgttaagtaacttaaaacttttnagtactagtaccgttacgggtacgaacccgggtcccgtttaccaacccgtataccgtaccaaggtacgaaccgaacggtcccggtaactaccttttcttccctttacgtacgtaacctaaacaacgaaccgtacgtaccctacggaacggggaccggaccggaaccggtaccgtaccggttcgtttacgttttacgtttacggtggtacgggtacggtaagggagggtaagggtaacggggaaaccgtaaacggttcggtacgttacgggttacgggttggttacggttaagttcggttaacgtttacggtacggtttacgggtaacgggttaaccggtaacggg

SEQ ID NO: 384790 - DNA, 575 bp, Homo sapiens
  misc_feature: GZ8MTXP01D1UP0.25.71.G05.1.454.CMB.2.raw
  modified_base (336)..(336): a, c, t, g, unknown or other
  modified_base (360)..(360): a, c, t, g, unknown or other
  modified_base (364)..(364): a, c, t, g, unknown or other
  modified_base (422)..(422): a, c, t, g, unknown or other
  modified_base (439)..(439): a, c, t, g, unknown or other
  modified_base (546)..(546): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtggggggaggccgtggtcaaggccgtgggggggtcccaagactctcttgtgcagcctcgtggattcaacttcaaaggctacagcatgaactggactccgcaggcgtcggggaaggtctgcagtgattcatcatttagnggtactaagcgtagactaaatttngcanactcggagaacggccgttcaaccatcctacagagacaacgccgagtacttctctttcnacaaatgaaacataccncgaggacgccgagacaacggtctgtttaacttctagtgacgagagggtaaggtgggaacgtaaacgttcggacgtcgttaagggttggttagtaagttgtcgttttntagtttcggtaacggggaacgtaaagggg

SEQ ID NO: 384791 - DNA, 627 bp, Homo sapiens
  misc_feature: GZ8MTXP01CJV85.25.71.G05.1.454.CMB.2.raw
  modified_base (363)..(363): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaggtgtccagtgtgaggtggtgctgggtggagtcgtggggggaggcctggtcaagccgtggggggtcccgaagactctcttgtgcagcctctggattcaacttcaaaggctacagcatgaactggactccgccgaggcgtcggggaaggtctgcagtggatttcatcctagttagtggtacttaagcgtagaactaatttngcagactcgggtacgaacggtccggttacaccgtatcctccagacgacacgccgacgtactttctctttactgacaatacgaacacgtacctacgacggggacgaccggaacggaccgtacggtctttcggtttatttcgtggtggtacggaaggagggtaagggtacggggaacgtaaaacgttcggtaccgttcggttacgggttagggttcggtaagttggttcgttttggtaggtttcgggtaacggggccgtaaagggg

SEQ ID NO: 384792 - DNA, 638 bp, Homo sapiens
  misc_feature: GZ8MTXP01DGX4B.25.71.G05.1.454.CMB.2.raw
  modified_base (358)..(358): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtgggggtccaagactctcttgtgcagcctcgtggattcaacttcaaaggctacagcatgaactggatccgcaggcgtccggggaagtctgcagtggatttcatcattagtgtacttaaagctagaactaaattttacgngactagtacgtacggtaacggaccgtccgttacactactctacaacgacaaccgtaaccgccgtaacttactttctcgtttacacgaacaaatacgaacacacacgacgacgggacgacggaccgtacgtacgttagtttacgtttcgttacgtcgtagacggacggtaggtaacgggtaaacggttaaacggtacggttacgtacggtaacgggttaggttgttacgttaagttacgtttcgttacgttacggttacgggtaaccggttaacggtaacg

SEQ ID NO: 384793 - DNA, 575 bp, Homo sapiens
  misc_feature: GZ8MTXP01ECE9L.25.71.G05.1.454.CMB.2.raw
  modified_base (281)..(281): a, c, t, g, unknown or other
  modified_base (362)..(362): a, c, t, g, unknown or other
  modified_base (505)..(505): a, c, t, g, unknown or other
  modified_base (536)..(536): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtggggggaggcctggtcaagccgtgggggggtcccaagactctcttgtgcagcctctggattcaacttcaaaggctacagcangaactggatccgccaggctccgggggaaggtctgcagtggatttcatccatttagtggtcttaagcgtgaactaaattttngcagactacgggtgaaccgggtccgttcaaccatcctaccagacgacaacgccgacgtactttcttctttctacgacaaatacgaacacgacctacgagggacgaccgaggaccgacggtcttagtttattcgtgtgcgaggnggaagtgggacgaaacttgacgtcgttaggnggttgaagttgtcgtttgtcgttcgtggggccgtaaggg

SEQ ID NO: 384794 - DNA, 557 bp, Homo sapiens
  misc_feature: GZ8MTXP01DTHOS.25.71.G05.1.454.CMB.2.raw
  modified_base (239)..(239): a, c, t, g, unknown or other
  modified_base (249)..(249): a, c, t, g, unknown or other
  modified_base (303)..(303): a, c, t, g, unknown or other
  modified_base (344)..(344): a, c, t, g, unknown or other
  modified_base (484)..(484): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttcctgtcgctattttagaaggtgtccagtgtgaggtggtgctggtggagtcgtgggggagcctggtcaagccgtgggggtcccaagctctcttgngcagccttcnggattcaacttcaaaggctacagcatgaactggatccgcaggctcggggagtcngcagtgattcatcattgtggtcttaagcgtgactaattttngcagactggtaacgaacggtccgttacacccatcctacagacaccacgccgacgtacttctctttctacgactaaatcgaacacgcctacgagacgggcgaaggacctacgggtcttgtttatttcgtgtgcgagagggnggtaagggacgaaacgtggacgtgtaacgggagttgagttgtcttttgagtttcgaggggtccgaagggtaac

SEQ ID NO: 384795 - DNA, 853 bp, Homo sapiens
  misc_feature: GZ8MTXP01BHIAO.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcgttggtccgaggccggggggtccctggagactctcctgtgcagcctctggtattcgtagttttagctagtatttggatgagtcgtcgggtcccgccgacggcccccgaagggggaacggggtcgtggggtggtaggggtacgacccaaacgagtaaccgaacggaaaggtagttggggaaggttagaaacggtaaaattacgtaagtcggaccggtaaccttacgttgggtagggaaaccggggtcccgtaactttacccgaacccgtaacgttcccgttacccggaaacggggaaaccctaaacccgtaacccaaaaacctaaaccgtttaaccctaaaacggtttaaattaaacttacccggttaaacgtaaacgtaaaacgttaaacggttaaacggggttaacgggtttaacggttaacgggtaaacgggtaaaccgggtaacccgggtaaaccgggtaaccgggtaaccgggtacggttacgggtttacggtttacgttttcggttaacgggttacgggttacgggtaacgggttaaccggtacccggtaaccccgttaaacccgttaccgttaaccgttaaccgttaacccgttaacgtttacgtttacgttttacgttaacggttaacgggttaacgggg

SEQ ID NO: 384796 - DNA, 614 bp, Homo sapiens
  misc_feature: GZ8MTXP01BJMB7.25.71.G05.1.454.CMB.2.raw
  modified_base (358)..(358): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttcctgtcgctattttagaaggtgtccagtgtgaggtggtgctggtggagtcgtgggggaggcctggtcaagccgtggggggtcccaagactctcttgtgcagcctcgtggattcaacttcaaaggctacagcatgaactggatccgcaggcgtccggggaaggtctgcagtggatttcatccattagtggtacttagcgtagaactaaattttngcagtactcggtacgaacggtccgtcaccatcctacagacgacaccgcgtacgtactttctcttctacgactaaatcgaaccacgtacctacgacgacggggaccgacgggacgtacggtcttagtttactttcgtggtgtacggagagggaggtaacggggaaccgaaaacggtcggcgtacggtacgggttaggttgttagttggttcgtttaagtcgtttcggttacgggggtaacccgttaaggggttaacg

SEQ ID NO: 384797 - DNA, 590 bp, Homo sapiens
  misc_feature: GZ8MTXP01DBT2F.25.71.G05.1.454.CMB.2.raw
  modified_base (359)..(359): a, c, t, g, unknown or other
  modified_base (371)..(371): a, c, t, g, unknown or other
  modified_base (428)..(428): a, c, t, g, unknown or other
  modified_base (467)..(467): a, c, t, g, unknown or other
  modified_base (491)..(491): a, c, t, g, unknown or other
  modified_base (551)..(551): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgcttattttagaaggtgtccagtgtgaggtgcagttggaggagtcgtgggggagcttgggtccaggccggggggtcctgagactctcctgtgcagcctctggattcatcttcagtgacccactacatggacctgggtcccgcaggctccgagggaaggggctggagtgggtggaccgttatagaaataagctaagagttaccaccanagaatacgcccngtctgtagaaagggtcagtattcattatactacaagagatgaattacaaagtaactnaactgtaatctagactaaatagaacacgacccgaaacgngtaacacggtcctagtacttacgngtcgacgttagggttcaacggtacgttaacgggttcttaacccttccttaaaaccccctnttttaacccctcccttaacgttaaccttaacctaacggg

SEQ ID NO: 384798 - DNA, 643 bp, Homo sapiens
  misc_feature: GZ8MTXP01DTQD6.25.71.G05.1.454.CMB.2.raw
  modified_base (360)..(360): a, c, t, g, unknown or other
  modified_base (549)..(549): a, c, t, g, unknown or other
tcagactgtacagtcacgaccggtgctcgatttagtgtcgtcgcaagagagaggggccttagccctggattccaaggcctttccacttggtgatcagcactgagcaccgaggattcacgatggaagtggggctccgctgggttttccttgtcgctattttagaaggtgtccagtgtgaggtggtgctggtggagtcgtgggggaggcctggtcaagccgtggggggtcccaagactctcttgtgcagcctctggattcaacttcaaaggctacagcatgaactggactccgcaggcgtccgggggaaggtctgcagtggatttcatcctattagtgtcttaagcgtagactaaattttangcagacgttcgggtaacggaacgggtcccggttacaaccctattcccgtaccaaggaacgtaacccaaaccggcccgtaaccggttaccttttcctttccttttactacgtaacaaacttacgaaaccacgccctacgacggacgggaccgaggacctacggtcttgtttattcgtgtgcgtaggaggnggtaacgggacgaaacgtcggacgtcgtacgggttagggttgttagttgttacgtttggttagtttcggttacggggtaaccgaagggttaacg

SEQ ID NO: 384799 - DNA, 717 bp, Homo sapiens
  misc_feature: GZ8MTXP01CYOFX.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattgggctgagctgggttctccttgttgctattttagaaggtgtccagtgtgaggtgcagttggaggagtctgggggagcttggtccaggccggggggtccctgagactctcctgtgcagcctctgggattcgtagttttagctagtatttggatgagcgtgggtcccgccgacggcccccgaggggaggggctggggtggtgggtacgccaaactataaccgacggaagagtaggggaggttagaacggaaatacgttaagtcggacgggtaaaccttcgtggtaggaaacggggtccccgtaattcccaacctacgtcccgtaccgaacgggaaccaacctacccaaacctaacttacgaacgttaataactccgtagtaacgtaaaagtaggtaaggttacggttacgtaacgggaacggaaccggacccggtaacgggaccgtaaccgggttccgttaggttagtttcgttttcgtggtcggacggaaggttccggttaacccggacccccggttaaattccccgttaacgtaacccggtaaccccttgtttcggttacgtttttaggtaagtttaacgggttcggggg

SEQ ID NO: 384800 - DNA, 579 bp, Homo sapiens
  misc_feature: GZ8MTXP01DAIAQ.25.71.G05.1.454.CMB.2.raw
  modified_base (330)..(330): a, c, t, g, unknown or other
  modified_base (340)..(340): a, c, t, g, unknown or other
  modified_base (362)..(362): a, c, t, g, unknown or other
  modified_base (381)..(381): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggccgtggggggtccccaagactctcttgtgcagcctctggattcaacttcaaaggctacagcatgaactggactccgcaggcgtccggggaggtctgcagtgattcatcattgngtctaagctnactaatttagcagactcgggtnaacgggtcgtcacctatcnccagacacaacgccgacgtcttacttcttctgacaaatcgaaacacgacctaccgacgggacgccggaacggaccgacgtcttgtttatttcgtgtgcgaggtaaggaaggttacgggacgtaaaacgttggtacgtcgttacgggttggttgtaagtgttaacgttttgagtttcggtaacggggccgttaaagggg

SEQ ID NO: 384801 - DNA, 667 bp, Homo sapiens
  misc_feature: GZ8MTXP01BIZ3B.25.71.G05.1.454.CMB.2.raw
  modified_base (348)..(348): a, c, t, g, unknown or other
  modified_base (558)..(558): a, c, t, g, unknown or other
tcagactgtacagtcacgaccggtgctcgatttagtgtcgtcgcaagagagaggagccttagccctgaactccaaggcctttccacctggtgattagcactgagcacagaggactcaccatggaattggggctgagctgggttctccttgttgcttattttagaaggtgtccagtgtgaggtgcagttggaggagtcgtggggggagcttggtccgagggccggggggtcctgacgactctcctgtgcagcctctggtatttcagttttagctagtatttggatggagcgtgggtccgccgacgggccccgaggggaaggggcgtgggtcggtagggtacgaccaaanagtacgaacggaagagtgggaagtgaaagtaaactactagcggacgtcctagtaggtggaacggggtcctattcccacctactccgtaccgaacgggaaccaacctacccaaactaacctcgtaatatactccgtagaactaaatacgtaagttgggggtactaggacggacggaccgaaggacgacggtacttggttgttacgtttcgnggtcgtacggacggtcgttaccggtaacccctaagttaccccgttagttaacccgtaacccttgttaaccgttcgttttgacgtttaagggtttcggggtaaccggggg

SEQ ID NO: 384802 - DNA, 554 bp, Homo sapiens
  misc_feature: GZ8MTXP01DVHJD.25.71.G05.1.454.CMB.2.raw
  modified_base (289)..(289): a, c, t, g, unknown or other
  modified_base (330)..(330): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttgggtccaggccggggggtcctgagactctcctgtgcagcctctggattcagttttagcagtatttggatgagctgggtccnccaggccccgaagggaggggctgggtcgtgggtagccgaanagtaacacgaagagtggaggtagaacgaaatacgtatgacggaaccttgtggtgaacgggccgtattccactatcctaccgagggacaactaccaaacaactacaagtatatctagacaaatgaagttgtcgtagagagccgagacgacgtctgtgttattcgtgtgcgagttagtcgcccgaattccataacgaccctaagtgtcttttgaagttaagttggg

SEQ ID NO: 384803 - DNA, 638 bp, Homo sapiens
  misc_feature: GZ8MTXP01DDXC9.25.71.G05.1.454.CMB.2.raw
  modified_base (281)..(281): a, c, t, g, unknown or other
  modified_base (343)..(343): a, c, t, g, unknown or other
  modified_base (370)..(370): a, c, t, g, unknown or other
  modified_base (595)..(595): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggccgtggggggtccccgaagactctcttgtgcagcctctggattcaacttcaaaggctacagcangaactggactccgccaggccgtaccgggggaaggtctgcaggtggtatttcatccatttagnggttcttaagcgtagaactaaattttngcagacgtcgggtagaaccgggtccgttacacccgatcctccgaagacgaacaccgaccgtacgtactttcttcttactagtacaaatagaacgacacctacgacgggacggaccggaaggaccgacggtccgtttagttttactttcgttggttcggacggaaggagggtaagggtcggggaaacgtaaacggttcggtaccgtcgggttacgggaggttacgngttagttcgttttagtagtttcgggtcggggaacgtaacgggg

SEQ ID NO: 384804 - DNA, 649 bp, Homo sapiens
  misc_feature: GZ8MTXP01CHX02.25.71.G05.1.454.CMB.2.raw
  modified_base (279)..(279): a, c, t, g, unknown or other
  modified_base (381)..(381): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgcttattttagaaggtgtccagtgtgaggtggtgctggtggagtcgtgggggaggcctggtcaagccgtggggggtcccaagactctcttgtgcagcctctggattcaacttcaaaggctacagcangaactggactcccgcgaggccgtccgggggaaggtctgctagtggtactttcacttcctaatttagtggttacttaaaggcgttagaacttaaaactttttngcgtaagtacgttacgggtacgaaccgggtccggtttacaacccgtatcctaccgagaacgaaccgaaccgccgtacgtactttcttcttctcgtacaaatacgaacacgacctacacgggacgaccgacgacgacggtcttacggtttatttcgtgtgcggaggaggtaaggtagggaacgtaaaacggttggtaccgtacgttacgggttggttacgtgtagttcgttttaggtactttcgggtaacgggttaaccggtaaagggg

SEQ ID NO: 384805 - DNA, 610 bp, Homo sapiens
  misc_feature: GZ8MTXP01BDLFE.25.71.G05.1.454.CMB.2.raw
  modified_base (368)..(368): a, c, t, g, unknown or other
  modified_base (565)..(565): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtggaggtggtgctggtggagtcgtgggggaggcctggtcaaggccgtggggggtcccgaagctctcttgtgcagcctctggattcaacttcaaaggctacagcatgaactggactccgccgaggccgtccgggggaaggtctggcagtggtatttcatccatttagtggtacttaagcgtagactaaattttngcagtacgtacgggtcgaaccgggtccgttacaccatcctaccagaacgacaaccgccgtacgtactttctctttctagacaatacgaactacgacctacacgggacgaccggaacggacgacggtcttcgtttagtttcctggttgacggaggaggaaggtacgggacgtaaaacgttggtacgtacgttacgggnggttgtaagttgtcgtttgtagttcggtcgggttaacgtaacggg

SEQ ID NO: 384806 - DNA, 585 bp, Homo sapiens
  misc_feature: GZ8MTXP01AR0AO.25.71.G05.1.454.CMB.2.raw
  modified_base (349)..(349): a, c, t, g, unknown or other
  modified_base (488)..(488): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtcgtgggggagcctggtcaaggccgtggggggtcccaagctctcttgtgcagcctctggattcaacttcaaaggctacagcatgaactggactccgcaggcgtcggggaaggtctgcagtgattcatcattagtgtcttaagcgtagactaatttngcagactcgggtacgaaccggtccgtacactatctacagacacaacgccgacgtactttctcttctagacaatacgaacacgcctacgacggggacgaccggaacggaccacgggtcttgtttattcgtgtgcggaggngggaaggtacggaacgtaaacgttcggtacgttaccggacgggttaggttgtaagttggttcgtttaggtcgttcggtaacggggaaccgtaagggg

SEQ ID NO: 384807 - DNA, 591 bp, Homo sapiens
  misc_feature: GZ8MTXP01DRVPS.25.71.G05.1.454.CMB.2.raw
  modified_base (361)..(361): a, c, t, g, unknown or other
  modified_base (429)..(429): a, c, t, g, unknown or other
  modified_base (442)..(442): a, c, t, g, unknown or other
tcagactgtacagtcacgaccggtgctcgatttagtgtcgtcgcaagagagaggagccttagtcctggactccaaggcctttccacctggtgatcagcactgagcacagaggactcaccatggaattggggctgagctgggttctccttgttgctattttagaaggtgtccagtgtgaggtggtgctggtggagtcgtgggggagcctggtcaagccgtgggggtcccaagactctcttgtgcagcctctggattcaacttcaaaggctacagcatgaactggactccgcaggcgtccgggggaaggtctgcaggtggtatttcatctattagtggtctaagccgtagactaaattttagngaacagtcgtcggtacgaccggtccgtacactactccacagacgacacgcgtactactttctcttcanacaagtacgaacncggacctacgacgacggaccgacgacgtacggtacgtttgtttctttcgtgtcggaaggagggagggtagggttacgggtaaacggtaacgttcgggttcgttacggtaagggtaggtgttagttgtttcgttttaagttcgtttcggg

SEQ ID NO: 384808 - DNA, 622 bp, Homo sapiens
  misc_feature: GZ8MTXP01DBD4X.25.71.G05.1.454.CMB.2.raw
  modified_base (280)..(280): a, c, t, g, unknown or other
  modified_base (380)..(380): a, c, t, g, unknown or other
  modified_base (477)..(477): a, c, t, g, unknown or other
  modified_base (572)..(572): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtctggggggaggcctggtcaagccgtgggggggtcccaagactctcttgtgcagcctctggattcaacttcaaaggctacagcangaactggactcccgccgaggccgtaccggggaagggtctggctaggtggtatttcatcctatttaggtggttacttaaaggcgtagaacttaaattttangcagacgtcgggtagaaccgggtccggttaccaccctatcctacagacgaaccaacggcccgtacgtactttcttctttacagtacaaactcgaacncgacctacaggggacgccggaagaccgacggtctttgtttatttcgtgtgacgaggaggaaggtagggacgtaaacgcggtacgtcgttacgggnggttgtaacttgttcgttttagtcgtttcggtcggggaacgttaaacggg

SEQ ID NO: 384809 - DNA, 564 bp, Homo sapiens
  misc_feature: GZ8MTXP01D5IH0.25.71.G05.1.454.CMB.2.raw
  modified_base (242)..(242): a, c, t, g, unknown or other
  modified_base (286)..(286): a, c, t, g, unknown or other
  modified_base (324)..(324): a, c, t, g, unknown or other
  modified_base (440)..(440): a, c, t, g, unknown or other
  modified_base (497)..(497): a, c, t, g, unknown or other
  modified_base (552)..(552): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttggtccgaggccggggggtcctgagactctctgtncagcctctgtattcagtttagcagtattggatgagctgggtccnccgaggccccgagggaggggctgggtgtggtagccaanatacacggaagagtggaggtgaagaaattacgatgacggaaacttcgtggtaggaaacggggcccagttaccaaccatcctaccgagggaccaacgtaccaaacaactcagttatnctagcaaatgaataggtctagagagacccgaggtacacggtctggttattatttcgnggttgcggtaggacgtcgaccccgattccagtaacgtacctaatcggtctttagnttaagtcggggg

SEQ ID NO: 384810 - DNA, 651 bp, Homo sapiens
  misc_feature: GZ8MTXP01CBEND.25.71.G05.1.454.CMB.2.raw
  modified_base (365)..(365): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggccgtggggggtcccgaagactctcttgtgcagcctctggattcaacttcaaaggctacagcatgaaactggactccgccaggccgtaccgggggaaggtctgcaggtggatttcatccatttagtggtcttaagcgtgactaaatttngcagactcggtacgaacggtccgttacacctatctccagacgaccaacgccgtacgtacctttctctttctagacaaagtcgaaacacgaccctacgaggaacgcccggaagggaccgtaccggtcgttgttttaacgttttcgtggtcggtacggagggtaaggggtaaggtcgggggaaccggtaaaaccgttggggtaacgttccggttaaccggggttggttggtaattcgggttccgtttttaggacgttttccggtaacgggggttaacccgtaaagggg

SEQ ID NO: 384811 - DNA, 571 bp, Homo sapiens
  misc_feature: GZ8MTXP01A98D5.25.71.G05.1.454.CMB.2.raw
  modified_base (352)..(352): a, c, t, g, unknown or other
  modified_base (379)..(379): a, c, t, g, unknown or other
  modified_base (522)..(522): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggatccgcaggctcggggaaggtctgcagtggatttcatcattagtgtacttaagcgtgactaatttngcagactcggtgaacggcgtcacatcncagacgacaacgccgacgtactttctctttctgtacaatgaacagacctacgacggacgccggacggacgacgtcgttgtttatttcgtggtcggcggtaggagggaaggtggggacgtaaacgttcgggactcgttacgggnggttggaagttgtcgttttggtagtttcggtcgggggttccgtaagggg

SEQ ID NO: 384812 - DNA, 661 bp, Homo sapiens
  misc_feature: GZ8MTXP01DD3ZT.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgcttattttagaaggtgtccagtgtgaggtgcagttggaggagtcgtgggggagtcgttgggtccgagggcccgggggggtccctgacgtacctctcctgtgcagcctctggtattcgtagttttagctagtagtttggatgagtcgtcgggtcccgccgacggccccgaggggacggggtctggggtggtgggtaacaccgaacacgtaacgaacgaagagtaggaggtagaaagaaatactagtggaccgtaactgtggtaggaaacgggtcctatccaactatccgtaccgaggtaacctaacctaccaaactaacctacgtaacgttaattactacgtagaactaaaagttaggaaagttcggtacgtaggaacggacggaccggaacggaccgtaacgggtcttggttacgtttattcgtaaggtcgacgtaggacgttccgacccgttaaattcccaagtaaccgtaaccttgttcgttcgtttagtaacgttggttcggggg

SEQ ID NO: 384813 - DNA, 629 bp, Homo sapiens
  misc_feature: GZ8MTXP01CLTI7.25.71.G05.1.454.CMB.2.raw
  modified_base (279)..(279): a, c, t, g, unknown or other
  modified_base (359)..(359): a, c, t, g, unknown or other
  modified_base (399)..(399): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggccgtggggggtcccaagactctcttgtgcagcctctggattcaacttcaaaggctacagcangaactggatccgcaggcgtcggggaaggtctgcgagtggatttcatcctattagtggtcttaagcgtgaactaaattttngcagactcgggtgaacggtccggttcactatcctccaganacaacgccgacgtactttcttctttctagacctaaagtcaaacgacgaccttacgaagggacggccggaacggacgtaaccggtcgttaggttttactttccgtgttcggacggaggtagggaagggttacgggaacggtaaaaccgttggtaccgttacggttacggggttggttggtaagtttggttccgttttggtacgttttcgggtcgggggttccgtaaagggg

SEQ ID NO: 384814 - DNA, 621 bp, Homo sapiens
  misc_feature: GZ8MTXP01C0NJA.25.71.G05.1.454.CMB.2.raw
  modified_base (295)..(295): a, c, t, g, unknown or other
  modified_base (327)..(327): a, c, t, g, unknown or other
  modified_base (332)..(332): a, c, t, g, unknown or other
  modified_base (342)..(342): a, c, t, g, unknown or other
  modified_base (363)..(363): a, c, t, g, unknown or other
  modified_base (377)..(377): a, c, t, g, unknown or other
  modified_base (541)..(541): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgcttattttagaaggtgtccagtgtgaggtgcagttggaggagtcgtgggggagcgttgggtccagggccggggggtcctggagctctcctgtgcagcctctggattctagttttagctagtatttggatgagcgtgggtccnccgaggccccgaggggaggggctggtgtgganccaanatacacgaangtaggagtgaacgaaatactntggacgaacttcgnggtacgaaacggggtcccagttacaccctaatccctaccgaagggaaccaaacctaccaaacctaaactactaacgtaataattccaagtaacaaaattgtaaaggtggttaccaggaagacgaccggacgacgaacggtcttggtagttatttcgttaagggngttacggaacggacgtacccgacccgttaagttcccgttagtaaccgtaccttgttgttcgtttagtaagttggtcgggg

SEQ ID NO: 384815 - DNA, 588 bp, Homo sapiens
  misc_feature: GZ8MTXP01ASPK6.25.71.G05.1.454.CMB.2.raw
  modified_base (276)..(276): a, c, t, g, unknown or other
  modified_base (359)..(359): a, c, t, g, unknown or other
  modified_base (371)..(371): a, c, t, g, unknown or other
  modified_base (517)..(517): a, c, t, g, unknown or other
  modified_base (536)..(536): a, c, t, g, unknown or other
  modified_base (549)..(549): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggccgtgggggtcccgaagctctcttgtgcagcctcgtggattcaacttcgaaaggctacngcatgaactggatccgccgaggccgtccggggaaggtctgcaggtggtatttcgatccgatttaggtggtacttaagcgttanactaaacttttncggtcagtacgcgggtacggaaccggtccggtccaactatccaccagacgacaacgccgactactttcttacttctagacaaagtcgaacacgccctgacgggacgccggagtacgacggtcttggtttattcgtagtcgaggagnggaacggtgggacaaacgngacgtcgttaggnggttgtaagtgtcttttagcgttcggtcggggctaaggg

SEQ ID NO: 384816 - DNA, 633 bp, Homo sapiens
  misc_feature: GZ8MTXP01ABZOO.25.71.G05.1.454.CMB.2.raw
  modified_base (236)..(236): a, c, t, g, unknown or other
  modified_base (352)..(352): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtgggctccgctgggtttcctgtcgctattttagaaggtgtccagtgtgaggtggtgctggtggagtctgggggagcctggtcaagcctgggggtcccaagactctcttgngcagcctctggattcaacttcaaaggctacagcatgaactggatccgcaggctcggggaaggtctggcagtcggatttcagtccattagtggtcttaagcgtgactaaattttcgngcagtcgtcgggtacgaaccggtccgtacacctactccgtacgagaacgaccaaacgtccgtaacgttacctttcgttcttacgtacgtaactaaagtacgaacacgtaccgtacgacgggacgaccggacggaccgaccggtcgttacgtttacgtttacgttcgtcgtacggtacggagggtaacgggtacgggacggtaaacgttacggtacgtacgttacggttacggttagtaagtcgttcgtttcgttacgttacggtcgggttaacggtaacgg

SEQ ID NO: 384817 - DNA, 660 bp, Homo sapiens
  misc_feature: GZ8MTXP01AL303.25.71.G05.1.454.CMB.2.raw
  modified_base (294)..(294): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttgggtccaggccgggggggtcctggagactctcctgtgcagcctctggattcagttttagctagtattggatgagcgtggggtcccncgacggccccgaagggggaacggggtctggggtgtgggggacgccaaacgataccaggaagtagtgggaagtgaacgtaaaactctaagtggacggaaacttcgttaaggtggaaacgggggtcctacgtttacacccaattcccgtaccgaagggaaccaaacctccaaaactaactacaagtataattccctaagaactaagtaagtaaggtacgtacgtaggacgacggaccggaacggacgacggtacgttgttagttacgttgtgtggacggtacggttacggtaccgtaacccgttaaccgttaccgttacgtaaccgtaccgttaacgttacgttacgtttacgtaacgttaaggtggg

SEQ ID NO: 384818 - DNA, 728 bp, Homo sapiens
  misc_feature: GZ8MTXP01AKFTL.25.71.G05.1.454.CMB.2.raw
  modified_base (358)..(358): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcgttgggtccgagggccgggggggtccctggacgactctccctgtgcagcctcgtggtattcgtagttttagctagtagtttggattggagtcgtcggggtccccgccgacgggcccccgaggggggacggggcgtaggggtggtggggtacnccaaacgacgtacgaacggaagagtaggggaggtagaaagtaaatacgtagtggaccggtaaacttcgtggtacgggaacgggtccgtattaccgactacgtaccgtaccgaagggaacccaaacctacccgaaacctaacgtaccgaattactacgtacctagaactaaagtaggtaagttcggttagaggaacgggaacggaccggaacggaaccggtaacggtccgttggttacggttaccgtttggtcggttagacggtaacggttcggttacccggaacccccggttaacttcccggttaacttaacccggtaaccccttaagtttcccgggtttacttttagggaacgtttggggttcgggggg

SEQ ID NO: 384819 - DNA, 580 bp, Homo sapiens
  misc_feature: GZ8MTXP01BMGJ5.25.71.G05.1.454.CMB.2.raw
  modified_base (361)..(361): a, c, t, g, unknown or other
  modified_base (396)..(396): a, c, t, g, unknown or other
  modified_base (435)..(435): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgcttattttagaaggtgtccagtgtgaggtggtgctggtggagtcgtggggggaggcctggtcaaggccgtggggggtcccgaagactctcttgtgcagcctctggattcaacttcaaaggctaacagcatgaactggactccgccaggccgtccggggaaggtctgcagtgattcatccattgtgtacttaagcgtgactaaatttangacagtactcgggtagaacggtccggttacaaccntcctaccgagacaccaacgccgacgtactttctctttcngtacaaatgaaactgcctcgagggacgcgaacggacgacggtcttgtttattcctgtgacgaggaggaaggtgggactaaacgttggtactcgacgggttgttgtaattggtaattttgacgttttcggcgggttaaccgaaggg

SEQ ID NO: 384820 - DNA, 598 bp, Homo sapiens
  misc_feature: GZ8MTXP01EBSEM.25.71.G05.1.454.CMB.2.raw
  modified_base (514)..(514): a, c, t, g, unknown or other
tcagactgtacagtcacgaccggtgctcgatttagtgtcgtcgcaagagagaggagccttagccctggattcccaaggcctttccacttggtgatcagcactgagcaccgaggattcaccatggaagtggggctccgctgggtttccttgtcgctatttagaaggtgtccagtgtgaggtggtgcgtggtggagtcgtgggggaggcctggtcaagccgtggggggtcccgaagactctcttgtgcagcctctggattcaacttacaaaggctacagcatgaactggatccgccaggcgtccggggaaggtctggcaggtggtatttcgatcctagtttagtggtacttaagcgtgaactaaatttatgcagtactcgggtagaaccgggtccgttcaccatcctaccgagacgacacgaccgacgtactttcttcgtttactgacaaatcgaaacacgacctacgacgggacgccggagaccgacggtccttggtttattcgtgtgacgtagnggaagtgggacgaaacgttggcttaccgttaggttggttagtaagtgttcgttttggtgtttcggtaacggggcgttaaacggg

SEQ ID NO: 384821 - DNA, 594 bp, Homo sapiens
  misc_feature: GZ8MTXP01DDECW.25.71.G05.1.454.CMB.2.raw
  modified_base (334)..(334): a, c, t, g, unknown or other
  modified_base (361)..(361): a, c, t, g, unknown or other
  modified_base (523)..(523): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggccgtggggggtcccgaagactctcttgtgcagcctctggattcaacttcaaaggctacagcatgaactggatccgcgaggcgtcggggaaggtctgcagtgtattcatccatttagnggtacttaagcgtagacttaaatttangcagacgtacgggtagaaccggtccgggttcacctatcctacagacgacaacgccgtacgtactttcttcttctacgacaaatgaacacgctacacgggacgcgaagacgacggtcttagtttagttctgtgacgaggtggaaggtcgggaacgtaaaacgnggtaccgtcgttacgggttggttacgaagttagttcgtttggtacgtttcggtcggggaacgtaaccgggg

SEQ ID NO: 384822 - DNA, 589 bp, Homo sapiens
  misc_feature: GZ8MTXP01EH0LX.25.71.G05.1.454.CMB.2.raw
  modified_base (168)..(168): a, c, t, g, unknown or other
  modified_base (298)..(298): a, c, t, g, unknown or other
  modified_base (336)..(336): a, c, t, g, unknown or other
  modified_base (342)..(342): a, c, t, g, unknown or other
  modified_base (516)..(516): a, c, t, g, unknown or other
  modified_base (520)..(520): a, c, t, g, unknown or other
  modified_base (528)..(528): a, c, t, g, unknown or other
  modified_base (533)..(533): a, c, t, g, unknown or other
  modified_base (572)..(572): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtntccagtgtgaggtgcagttggaggagtcgtggggggagcttgggtccgagggccgggggggtccctgagactctcctgtgcagcctgtggtattctagttttagctagtatttggatgagcgtgggtccnccgaggccccgaaggggaggggctgggtgtgggtaacnccaaanataacgaacggaagagtaggaggtagaaaggaaatactagtcggacggtaactcgtgagaaacggggtcccaattccgaaccgtatccgtaccgaagggaaccaactaccaaactaactacgaattatatacagaacaaaatgaaagttcggtatgacgagaccgagacgacgntgtntatttcgngtcgngagacgcgaccccgaattcccataaccacctaattcgtntttagaagttaagtggg

SEQ ID NO: 384823 - DNA, 615 bp, Homo sapiens
  misc_feature: GZ8MTXP01DJG2O.25.71.G05.1.454.CMB.2.raw
  modified_base (324)..(324): a, c, t, g, unknown or other
  modified_base (363)..(363): a, c, t, g, unknown or other
  modified_base (427)..(427): a, c, t, g, unknown or other
  modified_base (496)..(496): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgcttgggttttccttgtcgcttattttagaaggtgtccagtgtgaggtggtgctggtggagtcgtgggggaggcctggtcaagccgtggggggtcccaagactctcttgtgcagcctcgtggtattcaacttacaaaggctacagcatgaactggatccgcaggcgtccgggggaaggtctgcagtgtnttcatctatttagtgtactaagcgtagactaaattttcngcagacgtcggtacgaacggtccgttcaccatcacagacacaccgcgacgtacttctcttactnactaaatcgaaacgtacgcctacgacgacggacggacgaaccgtcgtctttgtttatttcgtaggtcgngggtaaggagggtaggtaacggggaacgaaacgttcggcgttaccggtaagggttaggttgttagttgtttacgttttcgtacggtttcggttacggggtaaccgttaagggttaaccg

SEQ ID NO: 384824 - DNA, 653 bp, Homo sapiens
  misc_feature: GZ8MTXP01A30M5.25.71.G05.1.454.CMB.2.raw
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggagcctggtcaagccgtgggggtcccaagctctcttgtgcagcctctggattcaacttcaaaggctacagcatgaactggatccgccgagggcgtccgggggaaggtctgcgagtgatttcatctagttagtgtacttaagcgtagtaactaattttacgcgtacaggtaccgttcgggtaacgaacccgggtccgttcaccgtactcctaccgagacgaaccgacgaccgtacgtactttcttactttctagactaaatacgaacgacgtacctacgacgacggggaccgaacggaccgtaacggtcgtttacgtttcgtttacgtaggttcgacgagggtacggagggtaacggaacgttaaaacgtcggttacgtacggtaacggttaggttggttagttgtttcgtttggtactttcgggttacgggtaacgttaacgggttaaccg

SEQ ID NO: 384825 - DNA, 600 bp, Homo sapiens
  misc_feature: GZ8MTXP01C028P.25.71.G05.1.454.CMB.2.raw
  modified_base (313)..(313): a, c, t, g, unknown or other
  modified_base (332)..(332): a, c, t, g, unknown or other
  modified_base (350)..(350): a, c, t, g, unknown or other
  modified_base (418)..(418): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgcttgggttttccttgtcgcttattttagaaggtgtccagtgtgaggtggtgctggtggagtcgtggggggagcctggtcaaggccgtggggggtcccaagactctcttgtgcagcctctggattacaacttacaaaggctacagcatgaactggactccgcaggcgtcgggaggtcngcagtgattcatcattagngtatagctgactaatttngcagctcgggtacgaacggtccgttacacgtactccacagacgacacgccgtacgtactttctctttntacgactaaagtcgaaacacgtacctacgacgggacggaccggacgaacgtacgggtacctttgtttactttcgtggtcgacggaggaggtaagggtagggaccgtaaagcggtacgtacggttaggttggttagtaagttcggttcttttggacgttttcggtcggggaacgttaacgggg

SEQ ID NO: 384826 - DNA, 642 bp, Homo sapiens
  misc_feature: GZ8MTXP01AFVYW.25.71.G05.1.454.CMB.2.raw
  modified_base (293)..(293): a, c, t, g, unknown or other
  modified_base (327)..(327): a, c, t, g, unknown or other
  modified_base (332)..(332): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagccgtgggggagcttgggtccaggccggggggtcctgagactctcctgtgcagcctcgtggattcgagttttagctagtatttggatgagtctgggtccncgaggccccaggggacggggctgggtgtgggtanccaanatacgacgaagatggaggtgaagaaatcgtaagtcggacggtaacttcgtgtagggaaacggggccgtattccgaacctataccctacccgaaggggaacctaaaccgtaccaaaactaactaccgaagttacttaatcccgttagaacctaaaagtggaaagttcgggtacttggaacgacggccggaggaccgtacgggtcttaggtgttaacgtttcgtaaggtggaccgagacggtccgaccccggttaattcccgattaaccggacccttaagtcgttcgttttagaacgttggttaaccggggg

SEQ ID NO: 384827 - DNA, 630 bp, Homo sapiens
  misc_feature: GZ8MTXP01D0TPZ.25.71.G05.1.454.CMB.2.raw
  modified_base (377)..(377): a, c, t, g, unknown or other
  modified_base (520)..(520): a, c, t, g, unknown or other
  modified_base (526)..(526): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtggggggaggcctgggtcaaggccgtgggggggtcccaagactctcttgtgcagcctctggattcaacttcaaaggctacagcatgaactggactcccgcgaggccgtccggggaaggtctgctaggtggtatttcacttccagtttagtggtacttaaagcgtagtaactaaattttngacagtactcgggtagaacgggccgttacacctatcctacagacacaacgccgtactactttctcttttcagtaacaaatacgaaacacgacctacgacggggaacggccggtaaggaacgtcggtacgttgtttactttcgngtacgnggaggtagggaaggtgggaacgtaaacgttggacgttcgttaagggttggttaggtaattcgttaacgttttggtactttcgggtaacggggaaccgtaagggg

SEQ ID NO: 384828 - DNA, 685 bp, Homo sapiens
  misc_feature: GZ8MTXP01BIUKX.25.71.G05.1.454.CMB.2.raw
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgcttattttagaaggtgtccagtgtgaggtggtgcgtggtggagtcgtgggggaggcctggtcaagccgtggggggtcccgaagactctcttgtgcagcctctggtattcaacttacaaaggctaacgagcatgaactggatccgccgaggccgtaccggggaggtctgcgtagtggtattcatcctagtttgtggttacttaagcgttagaacttaaacttttatgacgagtaccggtacgggtacggtaaccgggtcccggttacaaccctactcctaccgagaacgacccaacggacccggtactacttttcctctttacgtacgtaacgtaaattacgaaccgttacgacccgtaccgaagggggacggacccgggaacgggaccgtaaccgggtcctttgttttacgtttccgtggtcggtacgtagggagggtaaggtacgggaacgtaaacggttggtaccgtacggttacgggttaggttcgtaagttgtaacgttttgagtttcggtcgggttaacggtaaggg

SEQ ID NO: 384829 - DNA, 591 bp, Homo sapiens
  misc_feature: GZ8MTXP01CJQ6D.25.71.G05.1.454.CMB.2.raw
  modified_base (279)..(279): a, c, t, g, unknown or other
  modified_base (335)..(335): a, c, t, g, unknown or other
  modified_base (357)..(357): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtggggggaggcctggtcaagccgtggggggtcccaagactctcttgtgcagcctctggattcaacttcaaaggctacagcangaactggactccgcaggccgtcgggggaaggtctgcagtgatttcatccatttagnggtctaagcgtagactaatttngcagactcgggtagaacggtccgttacacctatcctacagacgacacgccgacgtactttctctttctacgactaaatacgaacacgacctacgagggacgaccggacggaccacggtcttagtttactttcgtgtgcggtaggagggtaaggtcgggacgtaaacgttcggacgtcggacgggttggttgtaagttgttcgttttggagtttcggtcggggttccgtaagggg

SEQ ID NO: 384830 - DNA, 763 bp, Homo sapiens
  misc_feature: GZ8MTXP01AOFWI.25.71.G05.1.454.CMB.2.raw
  modified_base (635)..(635): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcaggttggaggagtcggtggggggaggtcgttgggtccgacgggcccggggggggtccctggagtacctccgtcctggtgcagtcctcgtgggtattcgtagttttagctagtagttggatgagtcgtcgggtcccgccgacgggccccggaagggggacggggtcgtggggtcggtacggggtaacgaccaaacgtagtaaccgaacggaaaggtaggttaggggaaggtaggtaaacgtaaacgttaacgtagtcgggaccggttaaaccgttcggtaagggttaacgggaaacggggtcccgttaacgtttacccgaaccgtacgttacccgtaccggaacgggaaaccctaaaccgtaacccaaacctaactacgtaagtaactactacgttacgaactaaagtaggtaagttcggtacgtagacggacgaccggaggacgtaccggtnttggttattacgtttcgtggtcgacggtaacgttacggtacccgtaacccgttaacttaccgttaacgttaaccggtaccctttaagttcggttacgttttaggtaacgtttaagggttaaccggggg

SEQ ID NO: 384831 - DNA, 616 bp, Homo sapiens
  misc_feature: GZ8MTXP01C5ADT.25.71.G05.1.454.CMB.2.raw
  modified_base (567)..(567): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggagcttggtccaggccggggggtccctgagactctcctgtgcagcctctggattcagttttagcagtatttggatgagctgggtccgccgaggccccgaggggaaggggctgggtgtgggtagccaaacataacgaacgaaagagtaggaggtagaagaaatactagtgcggtaactctgtggaaacgggccgtatccgaccatcctacccgagggaaccaacctaccaaacaactactaagtataatacctagacctaaaagtagaaagttcggtacctaggaagacggaccgaacggaaccacgggtactggttaggttacttttcgtaagttcggacggaggacgttacggacccccgttaancccgttactaacggacccttaagtcgtcttttggtaacgttaagtgggg

SEQ ID NO: 384832 - DNA, 641 bp, Homo sapiens
  misc_feature: GZ8MTXP01B7LEX.25.71.G05.1.454.CMB.2.raw
  modified_base (367)..(367): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtcgtgggggagccgtggtcaagccgtggggggtcccaagactctcttgtgcagcctctggtattcaacttcaaaggctacagcatagaactgactccgccgaggccgtaccggggaaggtctgcgagtggattcatcctaagttggtgtacttaagcgtagaacttaaattttngtacaggtacgtacgggacggtaaccggtccggttacacccgtatcccgtacgaaagacgaaccgaaccgtaccgtaccgttactttcctactttcgtacgactaaagtacaaccgcgtacctcgaaggggacgacggtacgacgtacggtcctttgtttactttacgtgtgacgtaggaggtaacgggagggttacgaaacgttcggactcggttaacggttggttgttaagttgtaacgttttggtagtttcgggaacgggaacgtaacggg

SEQ ID NO: 384833 - DNA, 652 bp, Homo sapiens
  misc_feature: GZ8MTXP01AQ4AW.25.71.G05.1.454.CMB.2.raw
  modified_base (379)..(379): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggagcctggtcaagccgtggggggtcccgaagctctcttgtgcagcctctggattcaacttacaaaggctacagcatgaactggactcccgcgaggccggtaccgggggaaggtctggctaggtggtatttcgattccagtttaggtggttcttaaggcgtagtaactaaatttttangcaggtaccgtcgggtacggaacccggtcccggttaccaacctactccgtacgagaacgaaccaaccgcccgtaacgtactttcgttctttacgtagtacctaaagtacgaaaccacgcctacgacgggacggaccggacggaccgtacggtcttcgtttacttcgtaggtgaggaggaggggtggtacgggaacgtaaacggttcggtctacgggttacgggaggttgtaagttcgttgtttgtggtttacggtcggggttaaccgtaaggg

SEQ ID NO: 384834 - DNA, 609 bp, Homo sapiens
  misc_feature: GZ8MTXP01BYX14.25.71.G05.1.454.CMB.2.raw
  modified_base (311)..(311): a, c, t, g, unknown or other
  modified_base (355)..(355): a, c, t, g, unknown or other
  modified_base (383)..(383): a, c, t, g, unknown or other
  modified_base (492)..(492): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggactccgcaggcgtccggggaggtcngcagtgatttcatccattagtggtcttaagcgtagactaatttngcagactcgggtgaacggccgttcactntctcgagacgacacgccgacgtacttctctttctgactaatgtacacgacctacagggacgaccggacggacgacggtcgttcgtttactttacgtcgtgacggacggnggggtaaggtcggggaacggtaaacgttcgggtacgttcgttacggggttgggttacggtaagttggttaacgttttggtacggttttacgggtcggggttaaccggttaacggggg

SEQ ID NO: 384835 - DNA, 588 bp, Homo sapiens
  misc_feature: GZ8MTXP01EEGJ2.25.71.G05.1.454.CMB.2.raw
  modified_base (361)..(361): a, c, t, g, unknown or other
  modified_base (474)..(474): a, c, t, g, unknown or other
  modified_base (541)..(541): a, c, t, g, unknown or other
  modified_base (546)..(546): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagcctggggggtcccaagactctcttgtgcagcctctggattcaacttcaaaggctacagcatgaactggactccgccaggccgtccggggaaggtctgcagtggtattcatccatttacgtggtacttaagcgtagactaaatttngcagacgtcggtagaaccggtcgtacaccagtctaccagacgacaacgccacgtactttctactttctgactaaatcgaactagcctacgacggggacgccggtaacggaacncggtcttgttttactcgtgtcgacgaggaggaagtgggacgtaaacgttgggactcggttaacgggngttgngttaggtcttttggagttttcgggtcggggaaccgtaaaggg

SEQ ID NO: 384836 - DNA, 590 bp, Homo sapiens
  misc_feature: GZ8MTXP01BIOMT.25.71.G05.1.454.CMB.2.raw
  modified_base (240)..(240): a, c, t, g, unknown or other
  modified_base (247)..(247): a, c, t, g, unknown or other
  modified_base (274)..(274): a, c, t, g, unknown or other
  modified_base (308)..(308): a, c, t, g, unknown or other
  modified_base (339)..(339): a, c, t, g, unknown or other
  modified_base (356)..(356): a, c, t, g, unknown or other
  modified_base (394)..(394): a, c, t, g, unknown or other
  modified_base (398)..(398): a, c, t, g, unknown or other
  modified_base (432)..(432): a, c, t, g, unknown or other
  modified_base (448)..(448): a, c, t, g, unknown or other
  modified_base (547)..(547): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtgggctccgctgggttttcctgtcgcttattttagaaggtgtccagtgtgaggtggtgcgtggtggagtcgtgggggagctggtcaagccgtgggggtccaagactctcttgtncagcctntggattcaacttcaaaggctacagcangaactggactccgcgaggccgtcggggaaggtcngcagtgatttcatcagttacgtgtacttagngtagaacttaaattttngacagtcgtacgggtacgaaccgggtccgtacaccgtntccncgagaccgacaacgccgtactactttcttcttangtactaaatacgaacncgtacacgacgggacgtacggacgacgtacgttcgttagtttattcgtggtgacggtaggaggaagggtaggacgaaacgttggacgtacggttagggngttgtaagttcgttgtttaggtcttggtcgggaacgtaacggg

SEQ ID NO: 384837 - DNA, 547 bp, Homo sapiens
  misc_feature: GZ8MTXP01EF6IY.25.71.G05.1.454.CMB.2.raw
  modified_base (352)..(352): a, c, t, g, unknown or other
  modified_base (364)..(364): a, c, t, g, unknown or other
  modified_base (384)..(384): a, c, t, g, unknown or other
  modified_base (424)..(424): a, c, t, g, unknown or other
  modified_base (428)..(428): a, c, t, g, unknown or other
  modified_base (469)..(469): a, c, t, g, unknown or other
  modified_base (478)..(478): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtcgtgggggaggcctggtcaagccgtggggggtcccaagactctcttgtgcagcctctggattcaacttcaaaggctacagcatgaactggatccgcaggtctccggggaaggtctgcagtgattcatcattagtggtacttaagctagactaaatttngctagactcggngaacgcgtacactatctcanacgactaacgcgacgtacttactctttactagacaaagtnaacngactacagggacgccgagggacaggtctgtttattctggtncggagaggnggtacggacgaaagttggacgtcgttaggaggttgtgtgttcgtttgtacgttcggtcggaacgtaagg

SEQ ID NO: 384838 - DNA, 612 bp, Homo sapiens
  misc_feature: GZ8MTXP01EZ6UU.25.71.G05.1.454.CMB.2.raw
  modified_base (280)..(280): a, c, t, g, unknown or other
  modified_base (312)..(312): a, c, t, g, unknown or other
  modified_base (355)..(355): a, c, t, g, unknown or other
  modified_base (357)..(357): a, c, t, g, unknown or other
  modified_base (366)..(366): a, c, t, g, unknown or other
  modified_base (381)..(381): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggccgtggggggtcccgaagactctcttgtgcagcctctggattcaacttcaaaggctacagcangaactggatccgcaggccgtcggggaaggtcngcagtggattcatccattagtggtctaagcgtgactaatttangnagctacggnaacggtccgtcaccntcctcgagagactaacgccgacgtactttctctttctagtcaaagtacgaacactaccctcgaacgggacgacccggaacggacgtaaccgggtccttagtttatttccgttacgtgaccggtaggtagggaaggtacggggacgtaaaaacggttcggtacgtaccgttagggagggttgtaagttagttcgtttagtagtttccggtaacgggttaacccgtaaagggg

SEQ ID NO: 384839 - DNA, 704 bp, Homo sapiens
  misc_feature: GZ8MTXP01CD7XS.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcaggttggaggagtcgtgggggagcttgggtccgaggtccggggggtccctgacgctctcctgtcgcagcctgtggtattctagttttagctagtagtttggatggagcgtcgggtcccgccgacggccccggaggggacggggcgtgggtggtgggtacaccgaacagtacgaacggaagagtaggacggtagaagtaaactactagcggacggtaacttcgtgggtacggaacggggtcccgtacttcccgaaccctatacccgtaccgaacgggaaccctaaacctacccaaacctaaccgtacctaaggttaattaacttccgtagaacgtaaagtaggtaacgggttgggtaccgtaggaacggaccggtaccggagggaccgacggtcgttaggttagtttagtttccgtaaggtcggaacggtagaccggttaccgaccccgttaaacttccgttaacgttaaccgtaaccccgttgttccggtttgtttacgtaaggttaagggttccgggggg

SEQ ID NO: 384840 - DNA, 622 bp, Homo sapiens
  misc_feature: GZ8MTXP01AGMAE.25.71.G05.1.454.CMB.2.raw
  modified_base (377)..(377): a, c, t, g, unknown or other
  modified_base (532)..(532): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgcttattttagaaggtgtccagtgtgaggtggtgctgggtggagtcgtgggggagcctggtcaagccgtgggggtcccaagctctctgtgcagcctctggattcaacttcaaaggctacagcatgaactggactcccgccgaggccggtaccggggaaggtctgctaggtggtactttcagttcctagtttacgtggttacttaagcgttagaacttaaatttangacaaggacgtacgggacgaaccggtccggttacactactcacgagacaccgacgccgtacgtacctttcttctttacgtcgacctaaagtacaaacacgcctagaacgggacgtacggacgacgaggtcttgtttacttcgtgtggtacgaggnggtaaggtcgggaaacgaacgcggtaccgtcggacgggttggttgtaagttcgttctttggacgtttcgggtaacgggaacgttaacggg

SEQ ID NO: 384841 - DNA, 664 bp, Homo sapiens
  misc_feature: GZ8MTXP01AED5Y.25.71.G05.1.454.CMB.2.raw
  modified_base (325)..(325): a, c, t, g, unknown or other
  modified_base (361)..(361): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtgggctccgctgggttttcctgtcgctattttagaaggtgtccagtgtgaggtggtgctgggtggagtcgtgggggaggcctggtcaaggccgtggggggtcccgaagactctcttgtgcagcctctggattcaacttcaaaggctacagcatgaactggactccgcaggcgtccgggggaggtctgcgagtggatttnatccattgtggtacttagcgtagaactaattttacngcaagtacctaacgggtaaaaaccgggcccggttaacacctactcgtacccaggacgaccgaaccgacccgtacgtacctttcttcttactgactaagtacgaacacgacctacacgacgaccggggaggaaccgtacggtcgtttagtttacgtttctggttcgaggtaggtacgggtaggtaggggtaaccgaaaacgttcgggtacgttcggtaaccgggtaggttcgttagttcgtttaaccggttttggttaaccgtttcgggtaccggggttacgtaacggggttcgtttaaccggg

SEQ ID NO: 384842 - DNA, 711 bp, Homo sapiens
  misc_feature: GZ8MTXP01B6HXT.25.71.G05.1.454.CMB.2.raw
  modified_base (151)..(151): a, c, t, g, unknown or other
  modified_base (272)..(272): a, c, t, g, unknown or other
  modified_base (361)..(361): a, c, t, g, unknown or other
  modified_base (476)..(476): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtgggctccgctgggtttcctgtcgntatttagaggtgtccagtgtgaggtggtgctggtggagtcgtgggggagcctggtcaaggccgtggggggtcccaagctctcttgtgcagcctctggattcaacttcaaaggctacagcangaactggactccgccaggccgtacggggaggtctggcaggtggtatttcatccagtttagtggtacttaagcgtagtactaaattttgngacgtaggtacgtcgggtacgaaccgggtccggttacaccctatcctacgagacgaaccaccgtacccgacgttactttccttctttaccgtagtaactaaaacgtacgaaaccncgtaccgacgaacggggacggaccgggtaacggtaacccgtcggttaccgtttaggttttacgttcggttacggtacgggacggtaggggtaagggtaacggggtaacgggttaaacgggtaaacggttcgggtacccgttaacgggttaggggttcgggtttacgtggtttccggtttaacggttttacgggtacgggtttccgggggtaacgggggttaacccggtaaagggg

SEQ ID NO: 384843 - DNA, 713 bp, Homo sapiens
  misc_feature: GZ8MTXP01BVCKC.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggagcttggtccaggccggggggtcctgagactctcctgtgcagcctctggattcagttttagctagtattggatgagcgtgggtccgccgaggccccgaggggaaggggctgggtgtgggtagccaacactacgacggaagagtgggaggtcgaaggaaatacgtagtggaccgggtaacttccgtgttagggaaacggggtccgtaacgtttccgaaccaattccctacccgaaaggggaacccaaaccttacccaaaccaaacttacccaaaggttaattaaacgttccttaggaacctaaaaagtggtaaaagttcggggttacctaacgggaaggaacggacccgggaacggttaaccgaaacccgggggttcgttaggttacgtttacgtttcggtggtcggttacggtaacggttaccggtacccgtaaccccggttaacgttcccgttaacgttaacccgtacccttaagttcggttacgtttaggtaacgttcgggtaaggggg

SEQ ID NO: 384844 - DNA, 755 bp, Homo sapiens
  misc_feature: GZ8MTXP01BZDXA.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgcttattttagaaggtgtccagtgtgaggtgcagttggaggagccgtgggggagcttgggtccgagggcccggggggtcctggacgactcctccgtgtgcagcctctggtattctagttttagctagtagttggatgagcgtcgggtcccgccgacggccccgaggggacggggtctggggtggtagggtacaccaagatacgaacggaagaggtaggaggtagaaacgtaaatactagtgacggtaactcgtggtaggaacggggtcctagttcccaacgtactcccgtacccgaacgggaacccaaacccgttacaaaacctaaccgtactaaacggttaacttacctacgttaacggaaacctaaaagtacggtaaacggggttcgggttagtacgggaaacgggtaccggaacccggggaaacgggtaccggtaacccggggttcgttaagggtttaggtttaacgtttttcggaacgggtttcgggaccgggtaaaggggttaccgttacccggggaacccccttaaagttcccgttaacgttaacccgtaccgttaagtacggttccgtttttaagaacgtttgggttaaccggggg

SEQ ID NO: 384845 - DNA, 596 bp, Homo sapiens
  misc_feature: GZ8MTXP01E0RF7.25.71.G05.1.454.CMB.2.raw
  modified_base (269)..(269): a, c, t, g, unknown or other
  modified_base (354)..(354): a, c, t, g, unknown or other
  modified_base (356)..(356): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtgagtctggggagcctggtcaagcctggggggtcccaagactctcttgtgcagcctctggattcaacttcaaaggctacngcatgaactggatccgccaggctccgggggaagggtctgcagtggatttcatccatagtggtcttaagcgtgactaaattttacngnagctcggtacgaaccggtccgttacacctatctacagacgacaaccgaccgtacgtactttctctttctacgacaaatcgaacacgcctacgacgacgggccgacggacgacggcttgtttatttacgtgtgtcgaggagggaggtaacgggaacgaaacgtcggttcgtacgtaacgggaggttgttacgttggttcgttttgtacgtttcggttacggggtaaccgttaagggtaacg

SEQ ID NO: 384846 - DNA, 746 bp, Homo sapiens
  misc_feature: GZ8MTXP01D1TOI.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgcttattttagaaggtgtccagtgtgaggtgcagttggaggagtcgtgggggagcttgggtccagggcccgggggggttccctggagacttctcctgtgcagccttcgtcggtattcaggttttagcagtatttgatcgagcttgggtccgccgaggcccccgaagggggaggggctggggtggtgggtacgccaaacgattacgaacggaagtagtgggaaggttgaacgaaacttacgtatggaccggaaacttcgtggttagggaaacgggggtcccgtatttaccccaccaaacgttcccttacccgaacggggaaccaaacctacccaaactaaacctacgaagttactaacgtccttagaacctaaagttagaaagttcggtacgtaggaacgaggaccccggtaggaaccgtaaccggggtttcgttacggtttacgtttacgtttcggtaaggttacgggacggtacgggttaaccggtaccccggtaaccccgttaaaccgttacccgttaaaccgtttaacccgttaacccctttaaggtttaccgtttacgttttaacggtaacgttttaacgggttccgggg

SEQ ID NO: 384847 - DNA, 694 bp, Homo sapiens
  misc_feature: GZ8MTXP01AMYUI.25.71.G05.1.454.CMB.2.raw
  modified_base (387)..(387): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtgggctccgctgggttttccttgtcgctattttagaaggtgtccagtgtgaggtggtgctggtggagtcgtgggggagcctggtcaagccgtgggggtcccaagactctcttgtgcagcctctggattcaacttcaaaggctacagcatagaactggactcccgaccgaggccgtaccgggggaaggtctgcgtaggtggtactttcgattcctagtttacggttggttacttaaaggtcgtagtaaacttaaattttcgngacgagaccgtcgggtaacgaacccgggtccgttaccgacctacttccaccagacgaaccgaaccgcccgtacgtactttccttctttctacgactaaagtacgaaccacgtacctacgaacggacggggaccggaacggaccgtaccggttaccgtttgttttacgtttccgttaggtggaccggtaagggaagggtagggtaacgggaaaccgaaacgttcggaccgttacgggtaacgggttggttacgttagttcgttcgttttggtagtttccgggacggggtaacccgttaaggggtaacg

SEQ ID NO: 384848 - DNA, 708 bp, Homo sapiens
  misc_feature: GZ8MTXP01D5HG4.25.71.G05.1.454.CMB.2.raw
  modified_base (357)..(357): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggtttcctgtcgctattttagaaggtgtccagtgtgaggtggtgctggtggagtctggggggaggcctggtcaagccgtggggggtcccaagactctcttgtgcagcctctggattcaacttcaaaggctacagcatgaactggactccgcaggcgtccggggaaggtctgcagtgatttcatccatttggtggtcttaagcgtagactaaattttangcagtacgtcggtaagaaccggtcccggttacacccgtaagttccctaccgaagggtaacgaaccctaaacccggacccgtaaccggttacctttcctttacctttacgttaacggtacctaaaagttacgaaaccgtacgaccctacgaacggacggggacccggaacggggaaccctaccgggtaccgtttaggtttacgtttcgttggtcggtacggaggtaaggggtaacggttaacggggaaccgttaaaacgtcggttaccgttacggtaacggggttaggttggttagttcggttacgttttggttacgtttcggttacgggggtaaccgttaacggggtaacg

SEQ ID NO: 384849 - DNA, 593 bp, Homo sapiens
  misc_feature: GZ8MTXP01AV3CU.25.71.G05.1.454.CMB.2.raw
  modified_base (355)..(355): a, c, t, g, unknown or other
  modified_base (359)..(359): a, c, t, g, unknown or other
  modified_base (369)..(369): a, c, t, g, unknown or other
  modified_base (372)..(372): a, c, t, g, unknown or other
  modified_base (395)..(395): a, c, t, g, unknown or other
  modified_base (498)..(498): a, c, t, g, unknown or other
  modified_base (507)..(507): a, c, t, g, unknown or other
  modified_base (543)..(543): a, c, t, g, unknown or other
  modified_base (551)..(551): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggagcctggtcaagccgtggggggtcccaagactctcttgtgcagcctcgtggtattcaacttcgaaaggctacgagcatagaactgactccgccgaggcgtaccggggaggtctgcgaggtgtactttcatcctagttaggtggtacttaagngtanactaattttnganagcgtcgagaacggcccgtcacncgtcaccgagacgaccacgaccgtacgtactttcctcgtttacagtacaaagtcgaaccacgctacgacggacgtacccgaggactcgtcttgtttatcgtgngtacgaggnggtggcggacgaaacgttggtactacggttacgggngttacgtnttaggttcgtttgtacgttcggtaacgggttaaccgtaaggg

SEQ ID NO: 384850 - DNA, 660 bp, Homo sapiens
  misc_feature: GZ8MTXP01CIWQZ.25.71.G05.1.454.CMB.2.raw
  modified_base (281)..(281): a, c, t, g, unknown or other
  modified_base (368)..(368): a, c, t, g, unknown or other
tcagactgtacagtcacgaccggtgctcgattttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtgggggaggcctggtcaaggccgtggggggtcccaagactctcttgcgcagcctctggattcaacttcaaaggctacagcangaactggactccgcgaggcgtccgggaaggtctgcagtggtatttcatccatttagtggttacttaagcgtagaacttaaattttgngacgagtacgtacgggttacgaaccgggtcccgtttaccaacccgtagtaccctacccgaagaaccgaaccaaccggacccgtaaccgtacttttccttctttactagtaacaatacgaacacgacctcgaaggacgaccggaacgacgacggtccttagtttagtttccgtgttcggagaaggagggtaagggttacggaaacgtaaacgttcggtacgtcggttacgggttagggttcgtaagttggttcgttttggtacgtttcgggtaacggggttaacccgtaaggg

SEQ ID NO: 384851 - DNA, 647 bp, Homo sapiens
  misc_feature: GZ8MTXP01AR27G.25.71.G05.1.454.CMB.2.raw
  modified_base (236)..(236): a, c, t, g, unknown or other
  modified_base (242)..(242): a, c, t, g, unknown or other
  modified_base (248)..(248): a, c, t, g, unknown or other
  modified_base (271)..(271): a, c, t, g, unknown or other
  modified_base (351)..(351): a, c, t, g, unknown or other
  modified_base (353)..(353): a, c, t, g, unknown or other
  modified_base (433)..(433): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtcgtggggggagcctggtcaaggccgtggggggtcccaagctntctgtncagctngatcaacttcaaggctacagcangaactggatccgcgaggccgtcggggaaggtctgcagtgtatttcatcagttagtgtacttaagcgtagacttaaatttngnagtacgtcgggtacgaaccggtcgttacaccacttcaccgagaaacaccaaacgcccggtaacttactttcttctttacnctaactaaatcggaaaccacgtaccacgacggggaacgaccggaacgtaccgtacggttctttagtttacgtttacgtcggtacggtacggtacgggtaagggtaacgggtaacgggttaaacggtaaacggttacggtacgtacggttacgggttaggttacggtaagttgttcgtttcggttacggttacggtaacgggttaacggtaacgg

SEQ ID NO: 384852 - DNA, 584 bp, Homo sapiens
  misc_feature: GZ8MTXP01CP2OV.25.71.G05.1.454.CMB.2.raw
  modified_base (243)..(243): a, c, t, g, unknown or other
  modified_base (279)..(279): a, c, t, g, unknown or other
  modified_base (336)..(336): a, c, t, g, unknown or other
  modified_base (361)..(361): a, c, t, g, unknown or other
  modified_base (399)..(399): a, c, t, g, unknown or other
  modified_base (457)..(457): a, c, t, g, unknown or other
  modified_base (503)..(503): a, c, t, g, unknown or other
  modified_base (543)..(543): a, c, t, g, unknown or other
  modified_base (548)..(548): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgagactctcttgngcagcctctggattcaacttacaaaggctacagcangaactggatccgcaggcgtccggggaaggtctgcaggtggtatttcatccatttagnggtcttaagcgtgactaaattttangcagacgtcgggtacgaaccggtcccgggttcaacccntcctccagacgacaacgccgacgtactttctctttctgacaattagacacgacctacngggacgacgaggacgcgtcgttgtttactttcgtcgtggacgaggnggtaagggtgggacggaaacgttgtacgtacgttacgggngttgngtcgttcgtttgtcgtttcggtcgggcgtaacgggg

SEQ ID NO: 384853 - DNA, 751 bp, Homo sapiens
  misc_feature: GZ8MTXP01A1EMM.25.71.G05.1.454.CMB.2.raw
  modified_base (405)..(405): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgcttattttagaaggtgtccagtgtgaggtgcagttggaggagtcgtgggggagcgttgggtccgagggccgggggggtccctgagactctccgtgtgcagtcctcgtggtattcagttttagcagtattggatgagcgtcgggtcccgcgacgggccccgaagggggaaggggtctaggggtggtggggtaacgacccaaagataaacccgaggaagtagtggggaacggtagaaggaaaattacgttaagngaccggtaaactcgtcgtagggaaacggggcctattacccactaacgttcctaccgaagggaaccctaaaccgtaccaaaacctaaacttaccaaagttaactacgtaccttagaaaccgtaaattacggaaaagggttccggtttacgtaggaaacggacggtacccggaaacgggttaccgaaaccggttcgtacggtttaagtttacgtttcgttaagggttggttaccggtaaggaccggtacccgggtaaccccgttaaacgttccttaaaccttaacgggttaaacccccttaagttcccggtttacgtttttaaggaacggttggtttaacccgggggg

SEQ ID NO: 384854 - DNA, 678 bp, Homo sapiens
  misc_feature: GZ8MTXP01AF65P.25.71.G05.1.454.CMB.2.raw
  modified_base (236)..(236): a, c, t, g, unknown or other
  modified_base (243)..(243): a, c, t, g, unknown or other
  modified_base (365)..(365): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggagcctggtcaagccgtgggggtcccagactctnttgtgcngcctctggtattcaacttcaaaggctacagcatgaactgactccgccaggcgtcggggaaggtctggcaggtcggtatttcatccagtttacggtggtactttagcgtagacttaaattttngacacgtacgtacgggtagggtaaccggtcccggttaccactctccgaccaaggacaccgaacgccgtacgtacctttcttcttctacgactaaagacgaacacgtaccttacgaacgggtacgacgggacgaaccgtacggtcgtttagtttacgtttcgtggttcggacgggaaggtaggggtaaggtacgggggttaaccgtaaaacggttcggggtaccttaaccggttacggggttagggttagtaaggtttcgtttaacggttttaggtacggttttcggggtaacggggttaacccgggtaagggg

SEQ ID NO: 384855 - DNA, 671 bp, Homo sapiens
  misc_feature: GZ8MTXP01AP1UK.25.71.G05.1.454.CMB.2.raw
  modified_base (383)..(383): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtggaggtggtgcgtggtggagtcgtgggggagcctggtcaagccgtcgggggtcccaagctctctgtgcagcctgtgattcaacttacaaaggctacagcatgaactggactccgaccgaggccggtcggggaaggtctagcgtaggtggtatttacataccgtagtttagtggttaccgttaagcgttacgaacttaaacttttagngacagtacgtcgggtagaaccgggtccgtcactctctcaagacgaccacgcccgacgtactttctactttaccagactaaagtacgaactacggcctacgacggacggaccggtagaaccgtacggtctttacgttttagttacgtcggttggacgggtaacgaggggtaaggttacggggaaaccgtaaaacgttcgggtaccgttaaggttacggggttaggttagtaaggttccgtttcgttttaaggtcggtttacggtaacgggggttaaccggttaaacggg

SEQ ID NO: 384856 - DNA, 674 bp, Homo sapiens
  misc_feature: GZ8MTXP01BTDYA.25.71.G05.1.454.CMB.2.raw
  modified_base (362)..(362): a, c, t, g, unknown or other
tcagactgtacagtcacgaccggtgctcgatttagtgtcgtcgcaagagagagggccttagccctggattccaaggcctttccacttggtgatcagcactgagcaccgaggattcaccatggaagtgggctccgcttgggtttccttgtcgctattttagaaggtgtccagtgtgaggtggtgctggtggagtcgtgggggagcctggtcaagccgtgggggtcccaagctctcttgtgcagcctcgtggattcaacttcgaaaggctaacagcatgaactggactccgcgaggcgtaccggggaggtctgcagtgatttcatcctagttagtgtacttaagcgtagtaaacttaattttcngactaggtaccgttcgggtaacgaacccgggtcccggttacaaccgtactcctaccgaagacgaaaccgaccgtacccgtacgttactttccttcgttacaacgtactaaagtacgaaacacgtcctagacgacgggacccggtaggaccgtacggttactttcgttttacgttcggtcgtaggacggttaggaagggtcgggtaacgggaaaccgttaaacgtcggttaccgtaacgggtacggttaggttgttacgttggtttactttaagggttacgttcgggttacggggtaaccgttaagggttccg

SEQ ID NO: 384857 - DNA, 674 bp, Homo sapiens
  misc_feature: GZ8MTXP01BOHGW.25.71.G05.1.454.CMB.2.raw
  modified_base (503)..(503): a, c, t, g, unknown or other
  modified_base (625)..(625): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgcttattttagaaggtgtccagtgtgaggtggtgctggtggagtcgtgggggaggcctggtcaagccgtggggggtcccgaagactctcttgtgcagcctctggattcaacttacaaaggctacagcatgaactggactccgccgaggccgtaccgggggaaggtctggctaggttggtattttcattcctagtttaggtggttactttaagcgtagtaacttaaattttatgacgagtaccgtacgggtacggaaccgggtcccggttaccaccgtatcctacgagaacgaaccgaacccggcccgtaacgtaccttttccttcttttacgtacgactaaatacgaaacncgtaccctacgaaggggacggaccgaacggaccgtaccggtcgtttacgttttatttcggtgtcggacggaagggagggaaggtacgggaacggtaaacgttcgggtactcggttaaggggngttgtaagttgtcgttttgacgtttcgggaacggggttaacgtaacggg

SEQ ID NO: 384858 - DNA, 689 bp, Homo sapiens
  misc_feature: GZ8MTXP01DJCKN.25.71.G05.1.454.CMB.2.raw
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggtttcctgtcgctattttagaaggtgtccagtgtgaggtggtgctgggtggagtcgtgggggaggcctgggtcaaggccgtggggggtcccaaggactctcttgtgcagcctctggtattcaacttcaaaggctaacagcatgaactggactccgacaggcgtaccggggaaggtctgcaggtggtatttcatcctatttaggtcggtacttaaagcgttagaacttaaagttttgcgacaggtaccgtgggtaaacggaaccggttccggttaaccaccgtaacttccgaccgagacgaaacccacggacccgtaacgtacctttctacgtttcgagaacgtaaatacgaactacgcctacgacgacgggccggaaggtaccgacgggttccttagttttaacgttcgtacggtacggcggtaaggtaccgggtaagggtaaccggggaaacgttaaacggtcggacgttaccgggtaagggttggttacgttacgttgttaccgttttggtacgtttcgggacgggtaaccgttaaggggttaaccc

SEQ ID NO: 384859 - DNA, 666 bp, Homo sapiens
  misc_feature: GZ8MTXP01AV7BF.25.71.G05.1.454.CMB.2.raw
  modified_base (407)..(407): a, c, t, g, unknown or other
  modified_base (469)..(469): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttggtccaggccggggggtccctgagactctcctgtgcagcctctggattcagttttagcagatttggatgagcgtgggtccgccaggcccccgaggggaaggggctgggtggtggggtaagccgaaacgataacacggaagatgggaggtcgaagaaatacgtatgcggaactcgtgtaggaagggcccgattcaccgntctaccgaggacaactaccaacgaactacagtactactatacgactaaatcgaagtcggttntaggacgacggaccggaaagggaccgtaacggtcgttcgggttaagtttccgttttcggttaacgggtggttacgggtaaacggttacgggtaccccgtaccccgggttaaaccgttccgaaaccgttaacccggtaacccctttaagtaaccgggtttccttttagggttaaccgtttaacgggtttaacgggggg

SEQ ID NO: 384860 - DNA, 515 bp, Homo sapiens
  misc_feature: GZ8MTXP02GZ2I3.25.71.G05.1.454.CMB.2.raw
  modified_base (413)..(413): a, c, t, g, unknown or other
  modified_base (417)..(417): a, c, t, g, unknown or other
  modified_base (419)..(419): a, c, t, g, unknown or other
  modified_base (467)..(467): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggaggcttggtccagccggggggtcctgagactctcctgtgcagcctctggattcagtttagcagattttggatgagctgggtccgcaggccccagggaaggggctggtgtgggtagccaacatacacgaagatggaggtgagaaatactatgcggactctgtgaaagggccgattcaccatctccaggacaactcaaacaactcagtataanctananaatagaatagtgtagagagacgacgacgacgcgtgtgtattgtcgtgngacgagtacgaccgacgtacactaacgactactctcgttactatagtg

SEQ ID NO: 384861 - DNA, 523 bp, Homo sapiens
  misc_feature: GZ8MTXP02HLC41.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggaggcttgggtccaggccgggggggtccctgagactctcctgtgcagcctctggattcagttttagcagattttggatgagctgggtccgccaggccccagggaggggctggtgtgggtagccaacatacacgaagatggaggtgagaaatacatgcggactctgtgaaaggggccgattccaccatcctaccagggaccaactccaaacaactcaagtataatctagacaaatgaaatggtactgagagccgaggacacggctgtgtattctgtgcgagagtcgccccgaatccataacgcctatcgtctttgatagtggg

SEQ ID NO: 384862 - DNA, 565 bp, Homo sapiens
  misc_feature: GZ8MTXP02G2PTR.25.71.G05.1.454.CMB.2.raw
  modified_base (308)..(308): a, c, t, g, unknown or other
  modified_base (355)..(355): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtctgggggaggcctggtcaagcctggggggtcccaagactctcttgtgcagcctctggattcaacttcaaaggctacagcatgaactggatccgcaggctccggggaaggtcngcagtggatttcatccattagtggtcttaagcgtagactaaattttngcagactcggtagaccgggtccggttacaccatcctaccagacgacaacgccgacgactttctctttctcgacaaatcgaacacgcctcagacgccgaggacacggctgtttattctgtgcgagaggaggtgggacgaaaacgtggacgtacgtacgggaggtgaagttcgtacgttttggtacgtttcggtacggggaccgtaaagggg

SEQ ID NO: 384863 - DNA, 553 bp, Homo sapiens
  misc_feature: GZ8MTXP02HQ4L4.25.71.G05.1.454.CMB.2.raw
  modified_base (306)..(306): a, c, t, g, unknown or other
  modified_base (353)..(353): a, c, t, g, unknown or other
  modified_base (392)..(392): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggtttccttgtcgctattttagaaggtgtccagtgtgaggtggtgctggtggagtctgggggaggcctggtcaagcctgggggtcccaagactctcttgtgcagcctctggattcaacttcaaaggctacagcatgaactggatccgccaggctccggggaaggtcngcagtggatttcatccattagtggtcttaagcgtgactaaattttangcagactcggtagaacggccggttcaccatcctccaganacacgccgacgactttctctttctgacaaatgaacagcctcagagccgagacacggctgttattctgtgcgagaggagtgggacgaaaactcgggactacgtacgggaggtgtaagtgtcgttttaggtatttcggtcgggggtaccgtaaaggggtaacg

SEQ ID NO: 384864 - DNA, 618 bp, Homo sapiens
  misc_feature: GZ8MTXP02F7710.25.71.G05.1.454.CMB.2.raw
  modified_base (357)..(357): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagcctggggggtcccgaagactctcttgtgcagcctctggattcaacttcaaaggctacagcatgaactggatccgccaggctcggggaggtctgcagtggatttcatccattagtggtcttaaagcgtagactaaattttangacagtacgtcggtagaccgggtccgttacacctatcctacgagacgacaaccgaccgacgtactttcttctttctcgactaaatacgaaacacgacctacgagacgaccgacggaccgacggtcgttagtttactttcgtggtgacgaggagggtacggtacggggaacgtaaaacgtcggtaccgtacgtaacggggtaggtaggtaagttacggttcgttttacggttacgtttacggtacggggtaccgtaaacggg

SEQ ID NO: 384865 - DNA, 542 bp, Homo sapiens
  misc_feature: GZ8MTXP02JJQGK.25.71.G05.1.454.CMB.2.raw
  modified_base (355)..(355): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtgggggaggcctggtcaagcctggtggggtcccgaagactctcttgtgcagcctctggattcaacttcaaaggctacagcatgaactggatccgcaggctcggggaggtctgcagtggatttcatccattagtggtcttaagcgtgacctaaatttngcagactcggtgaaccggccggttcaccatctccagagacaacgccgacgactttctctttctgacaaatacgaacagcctacagagccgaggacacggctagtttattctgtgcgagaggaggtggggacgaaaacgtggactacgtaacggaggtgagtgtctttgactttcggtacgggaccgg

SEQ ID NO: 384866 - DNA, 567 bp, Homo sapiens
  misc_feature: GZ8MTXP02HA7V9.25.71.G05.1.454.CMB.2.raw
  modified_base (358)..(358): a, c, t, g, unknown or other
  modified_base (380)..(380): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtctgggggaggcctggtcaagccgtggggggtcccgaagactctcttgtgcagcctctggattcaacttcaaaggctacagcatgaactggatccgccaggctccggggaaggtctgcagtggatttcatcattagtggtcttaaagcgtgactaaaattttngcagactcggtgacggccgttnaccatcctcagacgacaacgccgacgtacttctctttctcgacaaatagaacacgcctacagacgccgaggacacggcttgttattctgtgcgagaggacggtagggacgaaaacgtggactacgtacgggaggtagtaagtcggtcgtttttacggtagtttcggtacggggtaccgtaaacgggg

SEQ ID NO: 384867 - DNA, 565 bp, Homo sapiens
  misc_feature: GZ8MTXP02GCV72.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccaggccggggggtccctggagactctcctgtgcagcctctggattctagttttagcagtatttggatgagcgtgggtcccgccaggccccgaggggaaggggctgggtggtggggtacgccgaaacatacgacggaaagagtgggaggtagaagaaatactaatgacggactctggtgaagggccgtattccaacatctaccgaggacaactaccaaacaactacagtaatatctagactaaatgaaagtggtactaggaaggacgaccggaggacgacggctgtagttattcgtgtgacgagagtcgacccgaatccaataacgaccctagtcgtctttgattagtcggg

SEQ ID NO: 384868 - DNA, 539 bp, Homo sapiens
  misc_feature: GZ8MTXP02IT8AU.25.71.G05.1.454.CMB.2.raw
  modified_base (354)..(354): a, c, t, g, unknown or other
  modified_base (468)..(468): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctgggggtcccgaagactctcttgtgcagcctctggattcaacttcaaaggctacagcatgaactggatccgccaggctccggggaaggtctgcagtggatttcatccatttagtggtcttaagcgtgactaattttngcagactcggtgaacggccggttcaccatcctccagagacaacgccgacgtacttctctttctgcaaatgaacagcctcagacgccgagacacggctgtttattctgtgcgagnggagtcgggacgaaaacgtggcgtctacgggaggtgatgtctttgtactttcgtggggacctaaggggtac

SEQ ID NO: 384869 - DNA, 534 bp, Homo sapiens
  misc_feature: GZ8MTXP02GO2C9.25.71.G05.1.454.CMB.2.raw
  modified_base (354)..(354): a, c, t, g, unknown or other
  modified_base (419)..(419): a, c, t, g, unknown or other
  modified_base (466)..(466): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctgggggtcccaagactctcttgtgcagcctctggattcaacttcaaaggctacagcatgaactggatccgccaggctccggggaaggtctgcagtggatttcatccattagtggtcttaaagcgtgactaaattttngcagactcggtgacggccggttcaccatcctccagacgaccaacgcccgacgactttctctttcngcaaatgaacagcctcagacgcccgaggacacggcttgtttatttcngtgcgagaggagtgggacaaacgtggctacgtacggagtgaagtgtctttgatttcggcgggtacagg

SEQ ID NO: 384870 - DNA, 605 bp, Homo sapiens
  misc_feature: GZ8MTXP02G5HOJ.25.71.G05.1.454.CMB.2.raw
  modified_base (362)..(362): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctggggaggcctggtcaagcctgggggtcccaagctctcttgtgcaggcctcgtggattcgaacttcaaaggctacagcatgaactggatccgccaggcctaccggggaaggtctgcagtggatttcatccattagtggtacttaaagcgtagactaaatttttagngacagtacgtcggtacgaccgggtccgttacacctatcctacgagacgacaccgccgacgtactttctcttcacgacaaatacgacacgacacgacgacgacgacggacgacgtacgttgtttactttcgtgtgtacgaggagggtacgggtacgggacggtaaacggtacggtacgtacggtacggtaggtaggtaagttcgttacgtttacgttacgtttacggtacgggtacggtaacgg

SEQ ID NO: 384871 - DNA, 604 bp, Homo sapiens
  misc_feature: GZ8MTXP02G8WPJ.25.71.G05.1.454.CMB.2.raw
  modified_base (359)..(359): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagccgtggggggtcccgaagactctcttgtgcagcctctggattcaacttcaaaggctacagcatgaactggatccgccaggctccggggaaggtctgcagtggatttcatccattagtggtcttaagcgtagactaaatttttangacagtacgtcgggtacggaccgggtcccggttacacctattcctaccgaagacgaaccgaaccgacccgtaaccgtacctttcttctttcgtacgactaaatacgaacacgcctacgacgacgaccgaggaccgacggtcttagtttattcgtgtgacgaggaggtacggtacgggacgaaaacgtggacgtacgtacggaggtagaagtgtcgtttagtagtttcggtacggggtacgtaagg

SEQ ID NO: 384872 - DNA, 544 bp, Homo sapiens
  misc_feature: GZ8MTXP02H4LN5.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccaggccgggggggtccctgagactctcctgtgcagcctctggattcagttttagcagattttggatgagctgggtccgccaggccccaggggaaggggctggtgtgggtagccaacatacacgaagatggaggtgagaaatactatgcggacttctgtgaagggccgattcaccatctccagggacaactccaaacaactacagtatatctgacaaatgaaatggtctagagagaccgaggacacggctagtgtatttctggttgacggagtaggtcgacccccgaattcccataacgacccctaattccgtattttcgattaagtgggg

SEQ ID NO: 384873 - DNA, 549 bp, Homo sapiens
  misc_feature: GZ8MTXP02IJOWA.25.71.G05.1.454.CMB.2.raw
  modified_base (312)..(312): a, c, t, g, unknown or other
  modified_base (358)..(358): a, c, t, g, unknown or other
  modified_base (397)..(397): a, c, t, g, unknown or other
  modified_base (421)..(421): a, c, t, g, unknown or other
  modified_base (433)..(433): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggtttccttgtcgctattttagaaggtgtccagtgtgaggtggtgctgggtggagtcgtggggggaggcctgggtcaagccgtggggggtccccgaagactctcttgtgcagcctctggattcaacttcaaaggctacagcatgaactggatccgcaggctccggggaggtcngcagtggatttcatccattagtggtcttaagcgtgactaattttangcagactcggtagacgggtccgttcacctatcctcaganacacgccgacgtctttctctttcngacaaatgaacngcctacgagacgcccgagacgacgtcttagtttattcgtgtgcgagaggaggtgggacgaaacgtggactcgtaacggtgtgaagtgtctttgagtttcggacgggtacgtaaagg

SEQ ID NO: 384874 - DNA, 396 bp, Homo sapiens
  misc_feature: GZ8MTXP02JJX95.25.71.G05.1.454.CMB.2.raw
  modified_base (391)..(396): a, c, t, g, unknown or other
tcagactgtacagtcacgaccggtgctcgatttagtgtcgtcgcaagagagaggggtgagggtttagaacctatgaacattctgtaggggccactgtcttctcacggtgctcccaaaactgtgatgtttggaaattctccgccctcagggatccctgaccgcttctctggctcgaagtctgggaccacagcctccctgactatctcggacctccagcctgaggacgaggctgattattactgttctacatgggactacagcgtcagtggtcatgtggttttcggcggaggcaccaagctcacgtcctaggtcagcccaaggctgcccctcggtcactctgttcccaccctcctccactgtacagtctgagcgggctggcaaggcgcatagnnnnnn

SEQ ID NO: 384875 - DNA, 543 bp, Homo sapiens
  misc_feature: GZ8MTXP02JWDHU.25.71.G05.1.454.CMB.2.raw
  modified_base (354)..(354): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctggggggtcccgaagactctcttgtgcagcctctggattcaacttcaaaggctacagcatgaactggatccgcaggctccggggaaggtctgcagtggatttcatccattagtggtcttaagcgtgactaaattttngcagactcggtgaacggccggttcaccatcctccagacacaacgccgacgactttctctttctgacaaatgaacagcctacagacgccgaggacacgggcttgtttattctgtgcgagaggaggtcgggacgaaacgtggactacgtacggaggtgagtgtctttgacgttcgcggggaccgagggtac

SEQ ID NO: 384876 - DNA, 622 bp, Homo sapiens
  misc_feature: GZ8MTXP02IC9QB.25.71.G05.1.454.CMB.2.raw
  modified_base (369)..(369): a, c, t, g, unknown or other
  modified_base (457)..(457): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtgggagtcgtggggggaggcctggtcaagccgtggggggtcccaagactctcttgtgcagcctctggattcaacttcaaaggctacagcatgaactggactccgccaggcgtccggggaaggtctgctaggtggatttcatcctatttagtggttactaagcgtagtaactaaattttcngacagtactggtacggaaccgggtccggttcaccatcctaccagacacaaccgccgacgtactttctctttctgactaaatgaaaccncgcctacgagacgacggagacgacggtctttagtttattcgtgtcggaggaggagggaggtacgggaacgtaaacggtcggtaccgtacggtacggggtaggttagtagttcgtttacgttttacggtacgtttaccggggtacggggtaaccgtaaggggtacg

SEQ ID NO: 384877 - DNA, 632 bp, Homo sapiens
  misc_feature: GZ8MTXP02ISX2F.25.71.G05.1.454.CMB.2.raw
  modified_base (356)..(356): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtgggggaggcctggtcaagccgtggggggtcccaagactctcttgtgcagcctctggattcaacttcaaaggctacagcatgaactggatccgcaggctcggggaggtctgcagtgattcatccattagtggtctaaagcgtagactaaatttttagngacagtacgtcggtacgaccggtccgttacacctactcctacaagacgaacaaccgaccgtacgtactttcttctttctacgaactaaatacgaaacacgtacctacgaacgacggaccgaacggtaaccgaccggtacgtttacgtttactttcgtacggtagacggtaaggaagggtaacggtacggggaaacgtaaaacgtcggtacgtacgtaacgggtaggtagtaagtcgttacgtttacgtacgtttacggtacggggtacgtaaaggg

SEQ ID NO: 384878 - DNA, 395 bp, Homo sapiens
  misc_feature: GZ8MTXP02GL59Z.25.71.G05.1.454.CMB.2.raw
  modified_base (392)..(395): a, c, t, g, unknown or other
tcagactgtacagtcacgaccggtgctcgatttagtgtcgtcgcaagagagaggggtgagggtttagaacctatgaacattctgtaggggccactgtcttctcacggtgctcccaaaactgtgatgtttggaaattctccgccctcagggatccctgaccgcttctctggctcgaagtctgggaccacagcctccctgactatctcggacctccagcctgaggacgaggctgattattactgttctacatgggactacagcgtcagtggtcatgtggttttcggcggaggcaccaagctgaccgtctaggtaagcccaaggctgccccctggtcactctgttccccgccctcctcacctgtacagtctgagcgggctggcaaggcgcatagnnnn

SEQ ID NO: 384879 - DNA, 550 bp, Homo sapiens
  misc_feature: GZ8MTXP02JD19R.25.71.G05.1.454.CMB.2.raw
  modified_base (413)..(413): a, c, t, g, unknown or other
  modified_base (524)..(524): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtctggggaggcctggtcaagcctgggggtcccgaagactctcttgtgcagcctctggattcaacttcaaaggctacagcatgaactggatccgtcaggctccggggaaggtctgcagtggattcatccattagtgtcttaagcgtgactaaattttatgcagtactcggtgaacggccggttcaccatctcagagacacgccgacgactttctctttcngcaaatgaacagcctacagagccgaggacacgggctgtttattcgtagtgcggagaggaggtcgggacgaaaacgtcggctacgttacgggaggtgaagtgtacgttttgntttacggtcgggaccgtaaggggtac

SEQ ID NO: 384880 - DNA, 544 bp, Homo sapiens
  misc_feature: GZ8MTXP02HO78G.25.71.G05.1.454.CMB.2.raw
  modified_base (349)..(349): a, c, t, g, unknown or other
  modified_base (411)..(411): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctggggggtcccgaagactctcttgtgcagcctctggattcaacttcaaaggctacagcatgaactggatccgccaggctcggggaaggtctgcagtgattcatccattgtgtcttaagcgtgactaaatttngcagactggtgaacggccggttcaccatcctaccagacacacgccgacgtacttctctttcngacaaatgaacagcctacagacgcgaggacacggtctagtttattctgtgcgagagggaggtcgggacgtaaaactgggctacgtacggaggtgagtgtctttgtacgtttcgtcggggtacctaagggtacg

SEQ ID NO: 384881 - DNA, 523 bp, Homo sapiens
  misc_feature: GZ8MTXP02IACHV.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggagcttggtccaggccggggggtcctgagactctcctgtgcagcctctggattcagttttagcagattttggatgagctgggtccgcacggccccaggggaaggggctggtgtgggtagccaacatacacgaagatggaggtgaagaaatactatgcggactctgtggaaagggcccgattccaccatctcccagggacaactccaacaactcagtatatctgacaaatgaatggtctagagagcgaggacacggctgtgtatttctgtgcgagagtcgacccgatccataacgaccctagtcgtcttttagacttagtggg

SEQ ID NO: 384882 - DNA, 560 bp, Homo sapiens
  misc_feature: GZ8MTXP02JPGLJ.25.71.G05.1.454.CMB.2.raw
  modified_base (311)..(311): a, c, t, g, unknown or other
  modified_base (357)..(357): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccaagactctcttgtgcagcctctggattcaacttcaaaggctacagcatgaactggactccgcaggcgtccggggaaggtcngcagtggatttcatccattagtggtctaagcgtagactaaattttngcagactcggtagaccgggtccgttacaccgtatcctaccgagacgaccaacgccgacgtactttctctttctgactaaatgaaacacgcctacagacgccgaggacacggtcttgtttattctgtgcgagaggtaggtgggacgaaacgtggactcgacggaggtgaagtgtctttagacgtttcggacggggacgtaaggg

SEQ ID NO: 384883 - DNA, 641 bp, Homo sapiens
  misc_feature: GZ8MTXP02GV8YE.25.71.G05.1.454.CMB.2.raw
  modified_base (356)..(356): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtctgggggaggcctggtcaagcctggggggtcccaagactctcttgtgcagcctctggattcaacttcaaaggctacagcatgaactggatccgccaggctccggggaaggtctgcagtggatttcatccattagtggtcttaaagcgtagactaaattttangacagtacgtcggtacgaccggggtccgttacacctatcctaccgaagacgaaccaaccgacccgtaaccgtactttccttcctttctacgactaaagtacgaaacacgacctacgaacggacgaccggacggacgtaccggtcttagtttactttcgtcgtcggacgtaggagggtacgggtacggggaacggtaaaacgtcgggtacgttacggtacgggtagggtacgtaagttcggttacgttttacggtacgtttacggtacgggggtaccgtaacgggg

SEQ ID NO: 384884 - DNA, 533 bp, Homo sapiens
  misc_feature: GZ8MTXP02IHTTM.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggaggcttgggtccaggccggggggtccctgagactctcctgtgcagcctctggattcagttttagcagattttggatgagctgggtccgccgacggcccccgaggggaaggggctggtggtggggtagccaacatacgacgaagagtggaggtgagaaaatactatgcgactctgtgaaggccgatccacatctcaggacactcaacaactcagtatatctagacaaatagaatggtactaggagacgccgaggacgacggctgtgtatttcgtagtgacgagtacgcgaccccgaatccataacgaccctatcgtactttgattagtcggg

SEQ ID NO: 384885 - DNA, 569 bp, Homo sapiens
  misc_feature: GZ8MTXP02JZGQY.25.71.G05.1.454.CMB.2.raw
  modified_base (353)..(353): a, c, t, g, unknown or other
  modified_base (416)..(416): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggagcctggtcaagcctggggggtcccaagactctcttgtgcagcctctggattcaacttcaaaggctacagcatgaactggatccgccaggctccggggaaggtctgcagtggatttcatccattagtggtcttaagcgtgactaaatttangcagactcggtgacggtccggttcacctatctccagagacaacgccgacgtactttctcttcngacaaatgtaacagcctacagagccgaggacgacggcttgtttattctgtgtcgaggaggtacggtagggacgaaaacgtcgggactaccggtacggtaagggtgaagttggtcgttttaggtacgtttcggtacgggggacctaaacggggg

SEQ ID NO: 384886 - DNA, 654 bp, Homo sapiens
  misc_feature: GZ8MTXP02IIOLA.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccaggccgggggggtccctggagactctcctgtgcagcctctggattcagttttagcagtattttggatgagcgtgggtccgccgaggcccccgaggggaaggggtcgtggggtgggtagggtacgaccgaaactacgtaacgaacgaaagaggtagggaggtagaaagtaaaatacgtagtacggacgtacgttcgtgggtaaggacgggacgtacgtaccacgtacttccacgacggaaccaactaccaaacactacagtatactacgtagaactaaagtagtaaagtcggttagaggaaggacgacggaaggaccgacggtcttagttacgtttacgttcgttggacggtacggaacggtcgttacccggaccctacgtaccaacgtaaccgttaacctaggtttaccgttagtttacgaagttttacgggtcggggg

SEQ ID NO: 384887 - DNA, 580 bp, Homo sapiens
  misc_feature: GZ8MTXP02HXEXB.25.71.G05.1.454.CMB.2.raw
  modified_base (355)..(355): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctggggggtcccaagactctcttgtgcagcctctggattcaacttcaaaggctacagcatgaaactggatccgccaggctccggggaaggtctgcaggtggatttcatccattagtggtctaagcgtgactaaattttngcagctcggtgaccgggcgttcacctatctccagacgacaacgccgacgtacttctctttctgacaaatacgaacacgcctacgagacgaccgaggacgacggtcttgtttatttcgtgttgacgaggtaagggaggtagggacggtaaaacgtgggactacgtacgggaggtaggtaagtcggttcgttttacgtagtttcggtacgggggtaccgtaaagggg

SEQ ID NO: 384888 - DNA, 615 bp, Homo sapiens
  misc_feature: GZ8MTXP02GPJ5U.25.71.G05.1.454.CMB.2.raw
  modified_base (353)..(353): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtgggctccgctgggtttccttgtcgctattttagaaggtgtccagtgtgaggtggtgctggtggagtcgtgggggagcctggtcaagccgtggggggtcccaagactctcttgtgcagcctctggattcaacttcaaaggctacagcatgaactggatccgcaggctccggggaatggtctgcagtggatttcatccattagtggtctaagcgtagactaaattttngcagtactcggtagaccgggtccgttacacctatcctacagacgacaacgccgacgtacttctctttctgacaaatacgaacacgacctacagacgaccgaaggaccgtacggtacttaggtttactttcgtacggtggtacggaggtaagggtacgggtacggggaaccgtaaaacggtcgggtacgtaccggtaacgggtaagggttagtaagttggttcgttttaggtacgtttcggtacgggggtaccgtaaaggggg

SEQ ID NO: 384889 - DNA, 645 bp, Homo sapiens
  misc_feature: GZ8MTXP02H8E2Q.25.71.G05.1.454.CMB.2.raw
tcagactgtacagtcacgaccggtgctcgatttagtgtcgtcgcaagagagaggagccttagccctggactccaaggccctttccacctggtgatcagcactgagcacagaggactcaccatggaattggggctgagctgggttctccttgttgctattttagaaggtgtccagtgtgaggtgcagttggaggagtcgtgggggagcttgggtccagggcccgggggggtccctggagactctcctgtgcagcctctggattctagtttagcagtattttggatgagcgtgggtccgcgacggccccgaggggaacggggctgggtggtggggtacgaccgaaacgagtaacgaacggaaagagtaggggaggtagaaacgaaaattacgtagtggacggtacttcgtgtagggaaacggggccgtagtttccaacctaatcccgtacccgaaacggggaaacccaaacctacccaaaaccaacctacaagtataatcctagaacaaatgtaaagttcggttataggacgacgaccggaaggaccgacggtcgttggttagttagtttcgtgtcggcggagtacggtaccgaccccgaatccaagtaaccgaccctagtcgtacgttttagagtttacgtcgggg

SEQ ID NO: 384890 - DNA, 548 bp, Homo sapiens
  misc_feature: GZ8MTXP02GP2PS.25.71.G05.1.454.CMB.2.raw
  modified_base (353)..(353): a, c, t, g, unknown or other
  modified_base (414)..(414): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctggggggtcccaagactctcttgtgcagcctctggattcaacttcaaaggctacagcatgaactggatccgccaggctccggggaaggtctgcagtggatttcatccattagtggtcttaagcgtgacaaattttngcagactcggtgaccggcgttcaccatctccagacgacaacgccgacgactttctctttcngactaaaatcgaaacacgacctcaagacgaccgaggacgacggcttgtttatttctgtgcgagaggaggtgggacgaaaacgtggactcgtacggaggtgaagtgtactttgatttcgtcggggacctaaaggg

SEQ ID NO: 384891 - DNA, 546 bp, Homo sapiens
  misc_feature: GZ8MTXP02JVYTF.25.71.G05.1.454.CMB.2.raw
  modified_base (357)..(357): a, c, t, g, unknown or other
  modified_base (443)..(443): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagccgtggggggtcccgaagactctcttgtgcagcctctggattcaacttcaaaggctacagcatgaactggatccgcaggctccggggaaggtctgcagtggatttcatccattagtggtcttaaagcgtgactaaattttangcagactcggtgaccgggtccggttcacctatctccagacgacaacgccgacgtactttctctttctgacaaatcgaacagacctnagacgccgagacacggtctgtttacttctgtgcgagaggaggtagggacgaaaacgtggactcgtacggagtgaagtgtctttgatttcgtgggacctaaggg

SEQ ID NO: 384892 - DNA, 547 bp, Homo sapiens
  misc_feature: GZ8MTXP02I3ORN.25.71.G05.1.454.CMB.2.raw
  modified_base (353)..(353): a, c, t, g, unknown or other
  modified_base (391)..(391): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctggggggtcccaagactctcttgtgcagcctctggattcaacttcaaaggctacagcatgaactggatccgcaggctccggggaaggtctgcagtggatttcatccattagtggtcttaagcgtgactaaattttngcagactcggtgaacggccggttcaccatcctccaganacaacgccgacgactttctctttctgacaaatgaacagcctacgagacgccgagacacggctgtttattctgtgcgagaggagtcgggacgaaacgtggacgtacgtacgggaggtgagttgtactttgtactttcgacggggtacctaaggtacg

SEQ ID NO: 384893 - DNA, 583 bp, Homo sapiens
  misc_feature: GZ8MTXP02IADAJ.25.71.G05.1.454.CMB.2.raw
  modified_base (274)..(274): a, c, t, g, unknown or other
  modified_base (353)..(353): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtctgggggaggcctggtcaagccgtggggggtcccaagactctcttgtgcagcctctggattcaacttcaaaggctacngcatgaactggatccgcaggctccggggaaggtctgcagtgattcatccattagtgtctaagcgtagactaaattttangacagactcgggtgaccgggtccggttacaaccgtatcctaccgagacgaccaacgcccgacgtactttctctttctagactaaatgaacagacctcacgacgaccgaggacacggtcttagtttatttcgtgtgacgtaggaggtaggtagggacgaaaacgtggacgtacgtacggtaggtagtaagtgtcgttttagtacgtttcggacggggtaccgtaaacgggg

SEQ ID NO: 384894 - DNA, 599 bp, Homo sapiens
  misc_feature: GZ8MTXP02G9P0C.25.71.G05.1.454.CMB.2.raw
  modified_base (254)..(254): a, c, t, g, unknown or other
  modified_base (334)..(334): a, c, t, g, unknown or other
  modified_base (359)..(359): a, c, t, g, unknown or other
  modified_base (427)..(427): a, c, t, g, unknown or other
  modified_base (432)..(432): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggtttccttgtcgctattttagaaggtgtccagtgtgaggtggtgctggtgggagtcgtgggggaggcctggtcaagccgtggggggtcccgaaagactctcttgtgcagccctntggattcaaacttcaaaggctacagcatgaactggatccgcaggcgtcggggaaggtctgcagtgatttcatccattagnggtctaagcgtagactaaaattttngcagactggtgaacgggccgttcacctatctaccagacgacaaacgccgaacgtactttctctttcanacaanaagaacacactacacgacgacgacgacgacgtacgttagtttagttacgtgtcggacggaagggaagggaagggtacgggaacggaaaacgtacggtacgtacggtacggtacggtagtagtgttacgtttacgttacgttacggtacgggtacggtaacggtaacg

SEQ ID NO: 384895 - DNA, 597 bp, Homo sapiens
  misc_feature: GZ8MTXP02F15IF.25.71.G05.1.454.CMB.2.raw
  modified_base (306)..(306): a, c, t, g, unknown or other
  modified_base (327)..(327): a, c, t, g, unknown or other
  modified_base (355)..(355): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtctgggggagcctggtcaagcctgggggtcccaagctctctgtgcaggcctcgtggattcaacttcaaaggctacagcatgaactggactccgccaggctccggggaaggtcngcagtgatttcatccattagnggtcttaagcgtgaactaaatttttcgngacagtacgtcggtacgaccgggtccgtacacctatcctacgagacgaacgacgccgtacgtactttcttcttacacgactaatacgaacacgtacctacgacgacgaccgacggtacgacgtcttgtttacttcgtgtgacgaggaggtacggtacgggaacgtaaacggtcggtacgtacggtacggtaggtagtaacgttcgttacgtttacggtacgtttcggacgggtacgtaacgg

SEQ ID NO: 384896 - DNA, 552 bp, Homo sapiens
  misc_feature: GZ8MTXP02ICJ02.25.71.G05.1.454.CMB.2.raw
  modified_base (307)..(307): a, c, t, g, unknown or other
  modified_base (385)..(385): a, c, t, g, unknown or other
  modified_base (407)..(407): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctggggggtcccaagactctcttgtgcagcctctggattcaacttcaaaggctacagcatgaactggatccgcaggctccggggaaggtcngcagtggatttcatccattagtggtctaagcgtgactaatttatgcagactggtgaacggccgttcacatctccaganacacgcgactacttctctttcngacaaatgaacagcctacagacgcgaggactacgggcttggtttattcgtgtggacgagaggaggtagggacggaaacgtaggtacgtcgtacggtacggtaggtagtgtcgtttcgttagttcgtcggtacggaacggtaacgg

SEQ ID NO: 384897 - DNA, 532 bp, Homo sapiens
  misc_feature: GZ8MTXP02FQ884.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccaggccgggggggtccctgagactctcctgtgcagcctctggattcagttttagcagtattttggatgagctgggtccgccaggccccaggggaaggggctgggtgtggggtagccaacatacgacgaagatggaggtgagaaatactatgcggactctgtgaagggccgattcacatctccagggacaactcaacaactcagtatatctagacaaatgaaatggtactggagagaccgaggacacggctgtgtatttctggtgcgagagtcgaccccgtaatccataacgaccctatcgtctttgacttagtcgggg

SEQ ID NO: 384898 - DNA, 570 bp, Homo sapiens
  misc_feature: GZ8MTXP02GGMS4.25.71.G05.1.454.CMB.2.raw
  modified_base (327)..(327): a, c, t, g, unknown or other
  modified_base (351)..(351): a, c, t, g, unknown or other
  modified_base (379)..(379): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtgggctccgctgggttttccttgtcgctattttagaaggtgtccagtgtgaggtggtgctggtggagtctgggggagcctggtcaagcctgggggtcccgaagactctcttgtgcagcctctggattcaacttcaaaggctacagcatgactggatccgcaggctccggggaaggtctgcagtggatttcatccatttagnggtcttaagcgtgactaaattttngcagtactggagacggccgtcacatccncagacgacacgccgacgtacttctcttctgactaatagaacacgcctacgagacgaccgacggacgacggtacttacgtttacttcgtgtcgacgaggaggtaggtacgggacgtaaacgtcggtacgtacgtacgggtaggtgtagtgttcgtttacgttacgtttcggtcgggtaccgtaacgggtacg

SEQ ID NO: 384899 - DNA, 647 bp, Homo sapiens
  misc_feature: GZ8MTXP02F9XJM.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttggtccaggccggggggtccctgagactctcctgtgcagcctctggattcagttttagcagtatttggatgagctgggtccgccgaggccccgaggggaggggctgggtggtgggtagccaacatacacggaagatggaggtgaagaaatactaagtgacggtactcgtggtaggaaacggggtccgtaattccaacctattccctacccgaaaggggtaacccaacctaccaaacctaactacaagttactactctagactaaaagtgaaattcgggtactaggaaggacgaccggaagggactacgggtcttaggtagtttaatttcgtaggttcggacggtaaggtacggttcccggacccccgtaaataccccgtaagtaacccggtaaccccttaagttcgttaccgtttttacggaacttaggtttacggggg

SEQ ID NO: 384900 - DNA, 796 bp, Homo sapiens
  misc_feature: GZ8MTXP02GXRH4.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttggtccaggccgggggggtcctggagactctcctgtgcagcctctggattcagttttagcagtattttggatgagctgggtccgccaggccccgaggggaacggggctggggtggtggggtacgccaaacataacgacggaaagagtggggaagggtagaaggtaaaataccgtaagtcggaccgggtaaccttcgtgggtacgggaaacgggggtccccgtaatttacccgaaccctaaattccccgttacccgaaacgggggaaaccctaaaccctacccgaaaaacccaaaaccctttacccgaaaacggtttaaattaaacgtttacccttaggaaacctaaaaaagttcgggtaaaaactttgggggtttacccgtaagggaaacgggaacggacccccggggaaaggggaacccggtaaccggggtaccgttggtttagggtttaaacttttccggttagggtcggtaccggtaagggtacggttaccgggaaccccccgtaaaattcccccgtaaaagttaaccggtaacccccttaagttcggtttaccgtttttacgggaactttaacggtttcgggggg

SEQ ID NO: 384901 - DNA, 534 bp, Homo sapiens
  misc_feature: GZ8MTXP02HJL3L.25.71.G05.1.454.CMB.2.raw
  modified_base (253)..(253): a, c, t, g, unknown or other
  modified_base (472)..(472): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccaggccgggggggtccctgagactctcctgtgcagcctntggattcagttttagcagtattttggatgagcgtgggtccgccgaggcccccgaggggaaggggctggggtgtggggtagccaacatacacgaagatgggaggtgaacgaaatactatgcggactctggtgaaagggccgattcacatcctcgaggacaactccaaacaactcagtactatctagactaaatgaatggtctagagagccgagacacggntgtgtattcgtagtgcgagagtcgacccgatccataacgacctatcgtctttagatagtggg

SEQ ID NO: 384902 - DNA, 557 bp, Homo sapiens
  misc_feature: GZ8MTXP02GWBH2.25.71.G05.1.454.CMB.2.raw
  modified_base (351)..(351): a, c, t, g, unknown or other
  modified_base (467)..(467): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggagcctggtcaagcctgggggtcccaagactctcttgtgcagcctctggattcaacttcaaaggctacagcatgaactggatccgcaggctccggggaaggtctgcagtggatttcatccattagtggtcttaagcgtagactaaatttntgcagactcggtgaacggccgttcaccatctccagagacaacgccgacgacttctcttctgacctaaatacgaacacgcctacagagcccgaggacacggctgtttattctgtcgngagtagggagtcgggacgtaaaacgtggacgtcgtaccggaggtgtagtcgtcgttttagacgtttcgtcgggggtaccaaggggtaccg

SEQ ID NO: 384903 - DNA, 601 bp, Homo sapiens
  misc_feature: GZ8MTXP02IHW5F.25.71.G05.1.454.CMB.2.raw
  modified_base (309)..(309): a, c, t, g, unknown or other
  modified_base (355)..(355): a, c, t, g, unknown or other
  modified_base (428)..(428): a, c, t, g, unknown or other
  modified_base (443)..(443): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtgggggtcccgaagactctcttgtgcagcctctggattcaacttcaaaggctacagcatgaactggatccgcaggctccggggaaggtcngcagtggatttcatccattagtgtcttaagcgtagactaattttangcagactcggtacgaccgggtccgttacaccctatcctccagacgaacacgcccgacgtactttctactttcncgacaaatcgaaacncgacctacagacgaccgaggacaaccgggtcttagtttactttcgtggtcgtacggaggagggtaggtggggaacgaaaaccttgggcttacggtaacggtaggtagtaacgttggttcgttttagtacgtttccggtagggggtaccgtaaacgggg

SEQ ID NO: 384904 - DNA, 559 bp, Homo sapiens
  misc_feature: GZ8MTXP02JFI92.25.71.G05.1.454.CMB.2.raw
  modified_base (360)..(360): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccaagactctcttgtgcagcctctggattcaacttcaaaggctacagcatgaactggatccgccaggctaccggggaaggtctgcaggtggatttcatccattagtggtacttaagcgtagactaaattttngcagactcggtgacgggtccgttcaccatctaccagacgacacgcccgacgtactttctcttctgacaatcaacacgacctcagacgccgaggaccgacgtcttgtttattcgtgtgacgaggaggaggtaggacgaaaacgtggacgtcgtacgggagtgaagttgtcgtttgtacgtttcggtcgggacgtaaaggg

SEQ ID NO: 384905 - DNA, 565 bp, Homo sapiens
  misc_feature: GZ8MTXP02F7N06.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccaggccgggggggtccctgagactctcctgtgcagcctctggattcagttttagcagtatttggatgagctgggtccgccgaggccccgaggggaggggctggtgtggggtagccaacatacacgaagagtggaggtgaagaaatactatgcggactctgtgaaggggccattccacatcctacccgaggaaccaactaccaaacaactcagttactatctagacaaaagtgaaagttggtactgaaggagacccggaggaccgacgggcgttgtacgttatttcgtggttgacgaggacgtcgaccccgtaatccaataacgaccctagttctactttgattagtcgggg

SEQ ID NO: 384906 - DNA, 557 bp, Homo sapiens
  misc_feature: GZ8MTXP02IYXRI.25.71.G05.1.454.CMB.2.raw
  modified_base (355)..(355): a, c, t, g, unknown or other
  modified_base (396)..(396): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctggggggtcccgaagactctcttgtgcagcctctggattcaacttcaaaggctacagcatgaactggatccgcaggctccggggaaggtctgcagtggatttcatccattagtggtcttaagcgtgaactaaattttngcagactcggtagaacggccggttacacctatcctccaganaccaacgccgacgactttctctttctagacaaatgaaacacgcctacagacgaccggagacacgggcttgtttattctgtgcgaggaggagtacgggacgaaaagtcggactacgacggaggtgtatgtctttgtactttcgacgggaccgtaacgggtag

SEQ ID NO: 384907 - DNA, 566 bp, Homo sapiens
  misc_feature: GZ8MTXP02F8U05.25.71.G05.1.454.CMB.2.raw
  modified_base (356)..(356): a, c, t, g, unknown or other
  modified_base (423)..(423): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtctgggggaggcctggtcaagcctggggggtcccaaagactctcttgtgcagcctctggatccaacttcaaaggctacagcatgaactggatccgcaggctccggggaaggtctgcagtggatttcatccattgtggtcttaagcgtagactaaattttangcagactcggtagacgggtccgttcaccgatcctaccagagacaacgccgacgtactttctctttcngacaaatgaaacagacctacagacgcgagacgacgtcttgtttacttcgtgtgcgagaggaggtgggacgaaaacgtggactacgtacggaggtagaagttcggtcttttaggtacgtttcggtacggggtaccgtaaagggg

SEQ ID NO: 384908 - DNA, 589 bp, Homo sapiens
  misc_feature: GZ8MTXP02JC58V.25.71.G05.1.454.CMB.2.raw
  modified_base (354)..(354): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttggtccaggccgggggggtccctgagactctcctgtgcagcctctggattcagttttagctagtattttggatgagcgtcggggtccgccgacggccccgaggggaaggggctggggtggtgggtacgccaacatacgacgaaagngtaggaggtgaagaaatactatggacggtactcgtggtaggaacggggaccgtattccgacctatccgtaccgagggaccaacgtaccaaacaactacagtatatctagacaaatgaaagtggtactaggaggacgaccggaaggacgacgggtctaggttagttactttcgtgtcgaggacgacgtccgacccgatcccaataacgaccctatcgtctttagacttagtcgggg

SEQ ID NO: 384909 - DNA, 576 bp, Homo sapiens
  misc_feature: GZ8MTXP02G7HQY.25.71.G05.1.454.CMB.2.raw
  modified_base (353)..(353): a, c, t, g, unknown or other
  modified_base (412)..(412): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtggggaggcctggtcaagcctgggggtcccgaagactctcttgtgcagcctctggattcaacttcaaaggctacagcatgaactggatccgccaggctccggggaaggtctgcagtggattcatccattagtggtctaagcgtagactaaatttangcagactcggtagacggccgttcacatctcagacgacacgccgacgactttctctttcncgacaatgaacagacctcagacgccgagacgacggtcttagtttattctgtcgacgtaggaggtaggtaggggacgtaaaacgtggacgttaccgtaacgggaggttagtaagttcggttacgtttttaggacgttttacggtacgggggaaccgttaaagggg

SEQ ID NO: 384910 - DNA, 540 bp, Homo sapiens
  misc_feature: GZ8MTXP02JGVI6.25.71.G05.1.454.CMB.2.raw
  modified_base (308)..(308): a, c, t, g, unknown or other
  modified_base (356)..(356): a, c, t, g, unknown or other
  modified_base (367)..(367): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtggggaggcctggtcaagcctggggggtcccaagactctcttgtgcagcctctggattcaacttcaaaggctacagcatgaactggatccgccaggctccggggaaggtcngcagtggatttcatccattagtggtacttaagcgtagactaaattttngcagactcggngacggccgtcacatctcagcacacgccgacgacttctcttctgcaaatgaacagacctcacgagccgagacgacgcttgtttattctgtgtcgagaggaggtgggacgtaaaacgtggacgtacgtacggagtgaagttgtcgtttagacgtttcgtcggggtaccgtaaggg

SEQ ID NO: 384911 - DNA, 560 bp, Homo sapiens
  misc_feature: GZ8MTXP02HCLOK.25.71.G05.1.454.CMB.2.raw
  modified_base (357)..(357): a, c, t, g, unknown or other
  modified_base (476)..(476): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagccgtggggggtcccaagactctcttgtgcagcctctggattcaacttcaaaggctacagcatgaactggactccgccaggcgtcggggaaggtctgcagtggatttcatccattagtggtcttaagcgtagaactaatttangcagactggtgaacggccgttcacatcctccagacacaaccgccgacgtactttctcttctagacctaaatcgaaacacgcctacgagacgccgaagacacgggtcttgtttatttcgngtgacgtagagggacgtagggacaaagtcggactacgtacggagtgtagtgtgtttagacgtttcgcggggaccgtaagggtac

SEQ ID NO: 384912 - DNA, 543 bp, Homo sapiens
  misc_feature: GZ8MTXP02J2Y4X.25.71.G05.1.454.CMB.2.raw
  modified_base (347)..(347): a, c, t, g, unknown or other
  modified_base (358)..(358): a, c, t, g, unknown or other
  modified_base (408)..(408): a, c, t, g, unknown or other
  modified_base (471)..(471): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctggggggtcccaagactctcttgtgcagcctctggattcaacttcaaaggctacagcatgaactggatccgccaggctccggggaaggtctgcagtggattcatccatagtgtctagcgtgactaatttngcagactcggngaacgccggtacaccatctccagacacaacgccgacgtactttctctttngcaaatgaacagcctagagacgcgagacacgggtcttgttatttcgagtcgacgaggacgggngttacggggacgaaaacgtcgggacttacgtacgggagtgatgtctttgacgtttcgcggggtacaggtacg

SEQ ID NO: 384913 - DNA, 712 bp, Homo sapiens
  misc_feature: GZ8MTXP02FZPOF.25.71.G05.1.454.CMB.2.raw
  modified_base (254)..(254): a, c, t, g, unknown or other
  modified_base (257)..(257): a, c, t, g, unknown or other
  modified_base (269)..(269): a, c, t, g, unknown or other
  modified_base (279)..(279): a, c, t, g, unknown or other
  modified_base (549)..(549): a, c, t, g, unknown or other
  modified_base (663)..(663): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggaggcttgggtccaggccgggggggtccctgagactctcctgtgcagccctgngtntcgttagttcanagttgttagngtggacgtcggtcgggtcccgaccggaccgggaccccgggaagggggacggggtcggttggggtggggtaggggtaccgaacccgaactaacgtaacgaaacggaaagtagggtaggggtagggtagaaaacgtaaacttacgtaggtcgggacgtaccgttggttggaacgggggaacgggccgttactacccaaccttactacccgtaccggggaaacggtaaaccctaaaccctaaccaaaacctaactacgaattactactacganaaactaaagtagaaaggttcggtagaggaaacggcggaaccgggaggaaaccggtccgttgtggttatttacgttcgttggacggacggaaggtcggtaccccgaacccgtacnccgtaagtaaccgtacctagttcgtttactttaagacttggtacggggg

SEQ ID NO: 384914 - DNA, 528 bp, Homo sapiens
  misc_feature: GZ8MTXP02FKACS.25.71.G05.1.454.CMB.2.raw
  modified_base (347)..(347): a, c, t, g, unknown or other
  modified_base (358)..(358): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggaggcttgggtccaggccgggggggtccctgagactctcctgtgcagcctctggattcagttttagcagtatttggatgagctgggtccgccaggccccagggaaggggctggtgtgggtagccaacatacacgaagatggaggtnagaaatactangcgactctgtgaagggccgatcacatctacaggacaactaccaacaactcagtatatctagacaaatagaaatcggtactgaagagaccgaggacacggctgtgtattcgtgtgcgtagagtcgacccgaatccaataacgacccttagtacgtcttttagatagtgggg

SEQ ID NO: 384915 - DNA, 555 bp, Homo sapiens
  misc_feature: GZ8MTXP02G4A21.25.71.G05.1.454.CMB.2.raw
  modified_base (360)..(360): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtgggggaggcctggtcaagccgtggggggtcccgaagactctcttgtgcagcctctggattcaacttcaaaggctacagcatgaactggatccgccaggctccggggaaggtctgcagtggatttcatccattagtggtcttaagcgtagactaaattttangcagtactcgggtagaccgggccggttacacctatcctaccagacgacaacgcccgacgtactttctcttctgacaaatgaacagcctcagacgcgagacacggctgtttattctgtgcgagaggaggtgggacgtaaaacgtggactacgtacggagtgaagtgtacgtttgagtttcggtgggaccgtaaagg

SEQ ID NO: 384916 - DNA, 528 bp, Homo sapiens
  misc_feature: GZ8MTXP02GBU11.25.71.G05.1.454.CMB.2.raw
  modified_base (423)..(423): a, c, t, g, unknown or other
  modified_base (428)..(428): a, c, t, g, unknown or other
  modified_base (430)..(430): a, c, t, g, unknown or other
  modified_base (433)..(433): a, c, t, g, unknown or other
  modified_base (435)..(435): a, c, t, g, unknown or other
  modified_base (476)..(476): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccaggccgggggggtccctgagactctcctgtgcagcctctggattcagttttagcagtatttggatgagctgggtccgccaggccccgaggggaaggggctggtggtgggtagccaaacatacacgaagatggaggtgaacgaaatactatgcggactctgtgaagggccgattcaccatctacaggacaactacaaacaactcagtanatcananaananatagtagagagagacgagacgacgcgtgtagtattgtgtgngacgagtacgaccgactacactaacgtactactacgtattacgtagtagtgg

SEQ ID NO: 384917 - DNA, 544 bp, Homo sapiens
  misc_feature: GZ8MTXP02F0AAT.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggaggcttgggtccaggccggggggtccctggagactctcctgtgcagcctctggattcagttttagcagtattttggatgagcgtgggtccgccaggcccccgaggggaaggggctggtggtgggtagccaacatacacgaagatgggagtgagaaatactatgcggactcgtgtgaagggccgattcaccatctccaggtacaactaccaacaactcagtatatctagacaaaagtgaaatggtactgaacgagcccgaggacacggatgtgtattcgtggtgcgtagacgttcgaccccgtaatccataacgacccctagtcgtctttagaactagtgggg

SEQ ID NO: 384918 - DNA, 622 bp, Homo sapiens
  misc_feature: GZ8MTXP02H25D2.25.71.G05.1.454.CMB.2.raw
  modified_base (311)..(311): a, c, t, g, unknown or other
  modified_base (358)..(358): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtcgtggggaggcctggtcaagccgtggggggtcccgaagactctcttgtgcagcctctggattcaacttcaaaggctacagcatgaactggatccgcaggccgtccggggaaggtcngcagtggattcatcattagtggtctaaagcgtagaactaaattttcngtacaggtacgttcgggtaggaaccgggtcccggttacaacctactcctaccaaggacaaccgaaaccgacccgacgtactttctacttctagacaaatgaaacacgacctacgagacggacgaaggacacgggtcttagtttaacttgttaggcgacggaggacgggtaggtacgggaaacgtaaacggtcggtacgtacggtaacgggacggtgaagttcgttacgtttacggtacgttcggtacggggacgtaagggtacg

SEQ ID NO: 384919 - DNA, 681 bp, Homo sapiens
  misc_feature: GZ8MTXP02I5XBP.25.71.G05.1.454.CMB.2.raw
  modified_base (250)..(250): a, c, t, g, unknown or other
  modified_base (259)..(259): a, c, t, g, unknown or other
  modified_base (271)..(271): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattgggctgagctgggttctccttgttgctattttagaaggtgtccagtgtgaggtgcagttggaggagtcgtggggagcttggtccagccgggggtccctgagactctcctgtgcagcctgtgtntgttagttnacgtattgttgntgatcggtcggccgcgaccgccggagggacggtcgtggtggtaggtacacctaagtactacgacgagtgtaggtagtacgaacgtactacgtagacgacgtactgtggtacgacggtacgtactacgactcgtaccgtacggagtaaccctacgaaccaactcgtacgagttactaacgttcgaacgaaagttaaacggtcgtaaacgttccgggtagaacgggttaacgggaccccgttaaccggggtacgaaacccggttccggtttagttcggttaaagttttccccgtcggtaggtccggaaacggttaaacggtccggttacccccgaaacgtttaaccgctaaaacggttcccgtaacccgttagtccgggttttacctaaggacggtttacggtacccggggg

SEQ ID NO: 384920 - DNA, 613 bp, Homo sapiens
  misc_feature: GZ8MTXP02HO3WZ.25.71.G05.1.454.CMB.2.raw
  modified_base (291)..(291): a, c, t, g, unknown or other
  modified_base (469)..(469): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtggggagcttggtccaggccggggggtcctgagactctcctgtgcagcctctggtattctagttttagcagtattttggatgagcgtgggtccnccgacggccccgaggggaacggggctggggtggtggggtacgccaaacagtaccgaaggaaagagtgggaggtagaacgtaaaatactagtgcggactcgtggtagaacgggccgtattaccgacatcccgtaccgaagggacctaactaccaaacaactacaagtaatactcgtaanaataaagtagtaagttgtagtagacggacgacgaggacgacgtcgttagttagttattcgtgtacgacggtacgtacgtaccgacccgtaactaccaacgtaaccgtaccttagttcgttacgtttacgtagtttacggtcggg

SEQ ID NO: 384921 - DNA, 561 bp, Homo sapiens
  misc_feature: GZ8MTXP02ITPMQ.25.71.G05.1.454.CMB.2.raw
  modified_base (352)..(352): a, c, t, g, unknown or other
  modified_base (364)..(364): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggtttcctgtcgctatttagaaggtgtccagtgtgaggtggtgctggtggagtctgggggaggcctggtcaagcctggggggtcccaagactctcttgtgcagcctctggattcaacttcaaaggctacagcatgaactggatccgccaggctccggggaaggtctgcagtggatttcatccattagtggtcttaagcgtagactaaatttangcagactcggtnacgggtccgttacaccgtattccacagacacaacgccgacgacttctctttctacgacaaatacgaacacgacctacgacgacgccgaggaccgacggtcttaggtttactttcgtagtgacgagaggacgtgggacgaaaacgtggactcgtacggagtggaatgtctttagtagtttcgtacgggaccgtaaggg

SEQ ID NO: 384922 - DNA, 553 bp, Homo sapiens
  misc_feature: GZ8MTXP02IDXSK.25.71.G05.1.454.CMB.2.raw
  modified_base (309)..(309): a, c, t, g, unknown or other
  modified_base (312)..(312): a, c, t, g, unknown or other
  modified_base (349)..(349): a, c, t, g, unknown or other
  modified_base (372)..(372): a, c, t, g, unknown or other
  modified_base (411)..(411): a, c, t, g, unknown or other
  modified_base (461)..(461): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccaagactctcttgtgcagcctctggattcaacttcaaaggctacagcatgaactggatccgcaggctccggggaaggtcngcngtgattcatcattagtggtctaagctagactaatttngcagactggtgaacggccgttanacatcctaccagacacaacgccacgtactttctctttcngacaaatcgaacagcctagagacgcgaagacacggtcttgtttacttcgngttgacgtaggaggtagtcggggaactaaacgtcggactacgtacggaggtgagtgtcgttttagactttacggacgggtacctaaagggtc

SEQ ID NO: 384923 - DNA, 538 bp, Homo sapiens
  misc_feature: GZ8MTXP02FKEUS.25.71.G05.1.454.CMB.2.raw
  modified_base (326)..(326): a, c, t, g, unknown or other
tcagactgtacagtcacgaccggtgctcgatttagtgtcgtcgcaagagagaggagccttagccctggattccaaggcctttccacttggtgatcagcactgatcaccgaggattcaccatggaagtggggctccgttgggttttccttgtcgctattttagaaggtgtccagtgtgaggtggtgctggtggagtctggggagcctggtcaagcctgggggtcccaagactctcttgtgcagcctctggattcaacttcaaaggctacagcatgaactggatccgcaggctccggggaaggtctgcagtggatttcatccattagnggtcttaagcgtgaactaatttatgcagactcggtgaacggccggttcacctatcctccagacgacaacgccgacgtactttctcttctgcaaatgaacagcctcagagccgagacacggcttgtttattctgtgcgagaggagtgggacgaaaagtggactcgtacgggagtgagtgtcgttttgacgtttcgtggggtaccaagggtacg

SEQ ID NO: 384924 - DNA, 610 bp, Homo sapiens
  misc_feature: GZ8MTXP02GSZDW.25.71.G05.1.454.CMB.2.raw
  modified_base (361)..(361): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtctgggggaggcctggtcaagcctggggggtcccaagactctcttgtgcagcctctggattcaacttcaaaggctacagcatgaactggatccgccaggctccggggaaggtctgcagtggatttcatccattagtggtcttaaagcgtagaactaaaatttttangacagacgtcgggtagaccgggtccgttacaacctatcctacgaagacgaacaacgaccgacgtactttctcttctacacaaatagaacacgacctacgacgacgacgacggacgacgtcgttagtttactttcgtgtgacggaggtagggtacgggtacgggaaacggtaaaacgtcggtacgtacggtaacggtaggtagtaagtcgttacgtttacgtacgtttacggtacggggtaacgtaaggg

SEQ ID NO: 384925 - DNA, 565 bp, Homo sapiens
  misc_feature: GZ8MTXP02FPSZI.25.71.G05.1.454.CMB.2.raw
  modified_base (328)..(328): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttggtccaggccgggggggtccctgagactctcctgtgcagcctctggattcagttttagcagattttggatgagctgggtccgccaggccccagggaaggggctggtgtgggtagccaanatacacgaaagatggaggtgaagaaatactagtgcggactcgtggtgaaaggggccgattccaaccatcctccgagggacaacgtaccaaacaactacagtaatatctagactaaaatgaaatggtactggagagcccgaaggacacggtctgtgttattcgtgttggacgaggacgtcgacccccgaaatcccgaataaccgacccttaagtcgtcttttagactagttacggggg

SEQ ID NO: 384926 - DNA, 566 bp, Homo sapiens
  misc_feature: GZ8MTXP02JYBER.25.71.G05.1.454.CMB.2.raw
  modified_base (354)..(354): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctggggggtcccgaagactctcttgtgcagcctctggattcaacttcaaaggctacagcatgaactggatccgccaggctccggggaaggtctgcagtggatttcatccattagtgtctaagcgtagactaaatttangcagactcggtagacgggccgttcacctatctaccagacgacaacgccgacgtacttctcttctgacaaatcgaacacgcctcacgacgccgaggacgacgtcttagtttattcgtgtgcgtagaggtaggtacgggacgtaaaacgtcggactcgtacggaggtagaagtcgttacgtttagtacgtttcggtacggggtacgtaacgggg

SEQ ID NO: 384927 - DNA, 636 bp, Homo sapiens
  misc_feature: GZ8MTXP02IU1XF.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccgaggcccggggggtccctggagactctcctgtgcagcctctggattcagtttagcagtatttggatgagcgtgggtcccgccgacggccccgaggggaaggggtcgtggtggtgggtacgaccaaacgacgtaacgaacggaagagtagggaaggtagaagtaaaatacgtagtacggcggaacttcgtggtaggaacggggtccctaattccgaacctacttacccgtaccgaacgggaaccaaaccctaccaaaacctaaacctactaacgtaatactactacgaactaaaagtgaaagttcggtagtgaaggacgaccggagacgacggctgtagtatttcgtgtcgaggacgtacgtaccgacccgtaaactccaagtaacctacccgtagtaccgttgtttacgagttagtcgggg

SEQ ID NO: 384928 - DNA, 642 bp, Homo sapiens
  misc_feature: GZ8MTXP02IR53T.25.71.G05.1.454.CMB.2.raw
  modified_base (362)..(362): a, c, t, g, unknown or other
  modified_base (433)..(433): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggactccgccaggcgtaccggggaggtctgcagtgatttcatccattagtgtactaagcgtagtaactaaagttttangactagtacgtcggtacgaccggtccgtacacctatccacagacgacaacgccgacgtctttctcttctanaactaaagtacgaactacgacctacgaacggacggaccggaacggaccgtacggtccgtttaggttttacgtttcgtggtacggtacggaaagggtagggtaacgggtacggggaaacggtaaaacgtcgggtacgtacggtaacgggtaggtacgtaagttggtttacgttttacggtacgtttccgggtacggggtaaccgtaaggg

SEQ ID NO: 384929 - DNA, 543 bp, Homo sapiens
  misc_feature: GZ8MTXP02G9V57.25.71.G05.1.454.CMB.2.raw
  modified_base (357)..(357): a, c, t, g, unknown or other
  modified_base (429)..(429): a, c, t, g, unknown or other
  modified_base (437)..(437): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctggggggtcccgaagactctcttgtgcagcctctggattcaacttcaaaggctacagcatgaactggatccgccaggctccggggaaggtctgcagtggatttcatccattagtggtcttaaagcgtgactaaattttangcagactcggtgacggccgttcaccatctcagagacaacgccgacgtactttctctttctgacaaatgaacngcctcagngccgagacacgcttgtttattctgtgcgagagggagtgggacgaaaacgtggactcgtacgggaaggtgaagtgtcttttgagtttcgtcggggaccgtaaagggg

SEQ ID NO: 384930 - DNA, 639 bp, Homo sapiens
  misc_feature: GZ8MTXP02J2189.25.71.G05.1.454.CMB.2.raw
  modified_base (333)..(333): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttggtccagggcccggggggtcctgagactctcctgtgcagcctctggtattctagttttagctagtattttggatgagcgtgggtcccgcgacggccccgaggggaaggggctgggtgtgggtacnccaacatacacgaagatggaggtagagaaatacgtatggcgactcgtggtaggaaacgggccgtattccgacctagtccctaccgaacgggaccaaacctacccaaaacactactaagtaactataccgtagaacaaagtgtaaagtcgggtactaggaaggacggaccggaaggaccgacgggtacgttggttagttaacgttttcgtaggttcggaccggtaaggtacgttacccggaccccgtaacgtccctaaacgtaaccgtacccttagtcggttaccttttacgaacgtttgtcggggg

SEQ ID NO: 384931 - DNA, 632 bp, Homo sapiens
  misc_feature: GZ8MTXP02JEG7J.25.71.G05.1.454.CMB.2.raw
  modified_base (366)..(366): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggactccgccgaggcgtaccgggggaaggtctgcaggtggatttcatccattagtggtacttaagcgtagaactaaattttngcagtactcggtacgaccgggtccggttacacctatctaccagacgaacacgaccgacgtactttctcttctcgtactaaatacgaacacgtaccctacaaggacgacccggaaggaccgaacggtcgttagtttattcgtggtaggacgaggacgggtagggtacggggaaacgtaaaaacggtcggtaccgtacggtaaccgggtagggtagtaacgttgttacgttttaggtacgtttcggtacgggggtaacgtaaacgggg

SEQ ID NO: 384932 - DNA, 707 bp, Homo sapiens
  misc_feature: GZ8MTXP02FY8ZW.25.71.G05.1.454.CMB.2.raw
  modified_base (267)..(267): a, c, t, g, unknown or other
  modified_base (370)..(370): a, c, t, g, unknown or other
  modified_base (651)..(651): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggtttcctgtcgctattttagaggtgtccagtgtgaggtggtgctggtggagtcgtgggggagcctggtcaagccgtgggggtcccaagctctcttgtgcagcctctggattcaacttcaaaggctanagcatgaactggactccgccgaggccgtaccggggaaggtctgcaggtggtatttcgatcctatttaggtggttacttaaagcgtagtaactaaatttttagngactaaggtacgttacggtacggaccgggtcccggttacaacctactacctaccgaagacgaaaccgaacccgtacccggtaaccgttaccttttaccgttccttttacgtacgtaactaaacgtacggaaaacctacgacccgttacgaacggaaccggaccggaacgggaccgtaaccggttccgtttaggttttacttacgttggttacgaacgggtaagggtagggtaacgggttacgggaaaccgtaaaacggtcggtaccgtacggttaacgggnggttagtaagttgttacgttttaggtacgtttcgggacggggtacgttaaacgggg

SEQ ID NO: 384933 - DNA, 565 bp, Homo sapiens
  misc_feature: GZ8MTXP02FP0DC.25.71.G05.1.454.CMB.2.raw
  modified_base (353)..(353): a, c, t, g, unknown or other
  modified_base (419)..(419): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggatccgcaggctcggggaggtctgcagtgattcatccattagtggtacttaagcgtagactaatttangcagactcggtagacgggtccgttcacatcctaccagacacaacgcccgacgtactttctctttcngtacaaatgaaactgcctcagacgccgaggacgacggtcttagtttacttcgtagtgcgagaggacggtagggacggaaacgtaacggtcgtacgtacggaggtagtaagtgtacgtttgttagttcgtacgggaccggtaacggg

SEQ ID NO: 384934 - DNA, 568 bp, Homo sapiens
  misc_feature: GZ8MTXP02IFEFY.25.71.G05.1.454.CMB.2.raw
  modified_base (313)..(313): a, c, t, g, unknown or other
  modified_base (357)..(357): a, c, t, g, unknown or other
  modified_base (553)..(553): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctggggggaggcctggtcaagccgtggggggtcccaaggactctcttgtgcagcctctggattcaacttcaaaggctacagcatgaactggatccgcaggctccggggaaggtctgcngtgatttcatccattagtggtcttaaagcgtagactaaatttangcagactcggtgacgggtccgttacaccgtatcctccgagacgacaacgccgacgtactttctctttctgacaaatacgacagcctacagacgccgaggaccgacggtcttgtttatttcgtaggttgacggagaggaggtagggacgaaaacgtggactcgacggtagtagaagttgtcttttggattttccggnggggaccgtaaaggg

SEQ ID NO: 384935 - DNA, 666 bp, Homo sapiens
  misc_feature: GZ8MTXP02H8NBQ.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttggtccaggccggggggtcctgagactctcctgtgcagcctctggattcagttttagcagtattttggatgagcgtgggtccgccacggcccccgaaggggacggggctgggtggtggggtagccaaacatacacgaagagtgggaggtgaacgaaaatactagtacggcggtacttcgtggtaggaaacgggggcccgtaattccaccctatcccgtacccgaaggggacccaacctacccaaaactaaacctacaagttatactactagactaaaatgaaatggttactaggaaggacggacccggagggaaccgtacgggtacttggttagtttaacgttttcgtgggttggtaccgggtaagtacgggttacccgacccccggtaaacttccccggaaattaacccggtaccccttaagttacggttcctttttaggactttaacggttcggggg

SEQ ID NO: 384936 - DNA, 517 bp, Homo sapiens
  misc_feature: GZ8MTXP02FLMF2.25.71.G05.1.454.CMB.2.raw
  modified_base (412)..(412): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggaggcttggtccagccggggggtccctgagactctcctgtgcagcctctggattcagttttagcagattttggatgagctgggtccgccaggccccagggaggggctggtgtgggtagcaacatacacgaagatggaggtgagaaatactatgcggactctgtgaagggcgattcacatctccagggacaactccaacaactcagtatatntagacaaatgaaatggtctgagagccgaggacacggctgtgtattctgtgcgagagtcgaccccgaatcccaataacgaccctatcgtcttttagatattcgggg

SEQ ID NO: 384937 - DNA, 588 bp, Homo sapiens
  misc_feature: GZ8MTXP02JKWU0.25.71.G05.1.454.CMB.2.raw
  modified_base (353)..(353): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtctgggggaggcctggtcaagcctggggggtcccaagactctcttgtgcagcctctggattcaacttcaaaggctacagcatgaactggatccgccaggctccggggaaggtctgcagtggatttcatccattagtggtcttaagcgtgacaaattttangcagtctcggtagaccggtccgttacaccatcctacagacgaacacgccgacgtacttctcttctgacaaatacgaacacgacctacagacgaccgacggacgacgtcgttagtttatttcgtgtgacgtaggaggtacgggtacgggaacgtaaaacggtcggtacgtacgtacgggtaggtagtaacgttcggttacgtttaggtacgtttcggtacggggtacgtaaacggg

SEQ ID NO: 384938 - DNA, 615 bp, Homo sapiens
  misc_feature: GZ8MTXP02G1AOM.25.71.G05.1.454.CMB.2.raw
  modified_base (586)..(586): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtgggctccgctgggtttcctgtcgctatttagaaggtgtccagtgtgaggtggtgcgtggtggagtcgtgggggaggcctggtcaaggccgtggggggtcccaagactctcttgtgcagcctctggattcaacttcaaaggctacagcatgaactggatccgcaggccgtaccggggaaggtctgcgtagtggtatttcatccagttagtggtacttaagcgtagaacttaaatttatgacagtacgtcggtagaacgggtccggttacaaccgtatcctaccaagacgaaccaaaccgccgtaaacgtactttctcctttctacgactaaaatacgaaacacgacccgtacgaagacggaccggtaaggaccgtaacgggtcttagtttaattcgtgtcgaggaaggaggtaagggtacgggaaacgtaaaacgtgacgttacgacgggagtgagtgtntttagagttcggacgggtaccaagggtac

SEQ ID NO: 384939 - DNA, 633 bp, Homo sapiens
  misc_feature: GZ8MTXP02HSRVO.25.71.G05.1.454.CMB.2.raw
  modified_base (372)..(372): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtgggggaggcctggtcaagccgtggggggtcccaagactctcttgtgcagcctctggtattcaacttcaaaggctaacagcatgaaactggactccgcaggccgtaccggggaaggtctgcaggtggtatttcatcctattaggtgtacttaaagcgtagtaacttaaatttancgacaagtacgttcggggtacgaccgggtccggttacaaccctattccacgaagaacgaaccgaaccgaccgtacgtacctttcctctttctagaactaaataacgaacacgacctacgagaacggaccggaaggacgacggtattagtttattcgtgtcgaggaggaaggtagggacgggaaacgaaaacgtcggacgtacgtacgggaggtagtaagttgtacgttttgtacgtttcgggtacgggtaaccgaaagggg

SEQ ID NO: 384940 - DNA, 648 bp, Homo sapiens
  misc_feature: GZ8MTXP02JO0SU.25.71.G05.1.454.CMB.2.raw
  modified_base (335)..(335): a, c, t, g, unknown or other
  modified_base (520)..(520): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcaggttggaggagtcgtgggggaggcttggtccgaggcccgggggggtccctggagactctcctgtgcagcctctggattctagttttagcagtatttggatgagcgtgggtccgcacggccccgagggaggggctggtgtgggtacgccaanatacgacgaagagtgggaggtgaacggaaatacgtagtggacggacttcgtggtagggaacgggtcctacgttaccaacctactccctaccgaagggtaacccaaacctaccaaactaacgtactaataatactactagaactaaaatgaaagtgtacgtagaagacggaccggaggacgacggnttaggttagttacgtttcgtggttcggccggaaggtacggtacccgtacccccggtaaactccccgtaacgtaaccgttaacccccgttaattgggttacctttttagacgtttaggtttcccggggg

SEQ ID NO: 384941 - DNA, 572 bp, Homo sapiens
  misc_feature: GZ8MTXP02ISESI.25.71.G05.1.454.CMB.2.raw
  modified_base (290)..(290): a, c, t, g, unknown or other
  modified_base (322)..(322): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttggtccaggccggggggtccctgagactctcctgtgcagcctctggattcagttttagcagtattttggatgagctgggtccncgacggccccgagggagggctggtgtgggtanccaacatacgacgagagtggaggtgaagaaatacagtcgcggtactctggtagaagggccgtattaccacatcgtaccgagggaaccaactaccaaactaactacagtaacttatctagactaaatgaaagttcggtactaggaggaacgccggaaggaccgacgggtctggttattattcgtggtagcggagtcgtacgaccccgaataccgataacgaccctagtcgtacgttttagattacgtgggg

SEQ ID NO: 384942 - DNA, 573 bp, Homo sapiens
  misc_feature: GZ8MTXP02JAKBS.25.71.G05.1.454.CMB.2.raw
  modified_base (351)..(351): a, c, t, g, unknown or other
  modified_base (387)..(387): a, c, t, g, unknown or other
  modified_base (411)..(411): a, c, t, g, unknown or other
  modified_base (423)..(423): a, c, t, g, unknown or other
  modified_base (447)..(447): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggtttccttgtcgctatcttagaaggtgtccagtgtgaggtggtgctggtggagtcgtgggggaggcctggtcaagccgtggggggtcccaagctctcttgtgcagcctctggattcaacttcaaaggctacagcatgaactggactccgccaggcgtccggggaggtctgcagtgattcatccattagtgtctaagcgtagactaaatttngcagactcggtgacggtccgtacaccatcctcaganacacgccgacgtactttctcttcngacaatcgaacncgctacacgcgacgagacgacgtnttgtttattcgtgtgaggaggaggggacggtacgggaaacggtaaacgtcggtacgtacggtaggggtaggtagtaagttcgtttacgtttacggtacggtttacgggacggggtaacgtaacggg

SEQ ID NO: 384943 - DNA, 830 bp, Homo sapiens
  misc_feature: GZ8MTXP02IML4A.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccaggccggggggtcctgagactctcctgtgcagcctctggattctagttttagcagtattttggatggagcgtcgggtccgccgacggccccggaggggacggggtcgtggggtggtggggtacgaccaacgtaacgtacgaacggaaaggtagtggggaaggtacggaaagtaaactacgtaagtcggacggtaaccgttgtagggtacgggaacggggacccgttacttaccgaacctacgttaccccgtaacccgggaaacggggtaaaccctaaacccgttaaccccaaaaacccgtaaacccgttacccgtaaacgtttaaacgttaactttaccgaacggtaaaacctaaaagttacggtaaaagtttcggggttaccgtaacgggtaagggtaaacccgggaacccggggtaacgggaaacccggtacccgggggttcgtttacgggttttaaaggtttacgtttttaccggttggggttacgggaccggtaaagggttaccggttaccccggaaccccggttaaaactcccgtaaaacgttaacccggtaaacccctttacggttacccgtttcgttttaacggtacgtttaacgggtttccgggggg

SEQ ID NO: 384944 - DNA, 603 bp, Homo sapiens
  misc_feature: GZ8MTXP02F84KG.25.71.G05.1.454.CMB.2.raw
  modified_base (360)..(360): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggccgtggggggtcccaagactctcttgtgcagcctctggattcaacttcaaaggctacagcatgaactggactccgccaggcgtccggggaaggtctgcagtggatttcatccattagtgtcttaagcgtagaactaaatttcngcagacgtcggtagaacggtccggttacaccgatcctaccagacgaacaacgccgtacgtactttctctttctagactaaatgaacacgcctacgagacgaccgagaccgacggtcttgtttactttcgtggtacgcgaaggagggtaaggtacggggaacgtaaaacggtcggtacgtacggtacgggaggtgtaagtgttacgttttgtacgtttcgggtacggggtaccgaaagggtacg

SEQ ID NO: 384945 - DNA, 570 bp, Homo sapiens
  misc_feature: GZ8MTXP02FH3TL.25.71.G05.1.454.CMB.2.raw
  modified_base (328)..(328): a, c, t, g, unknown or other
  modified_base (353)..(353): a, c, t, g, unknown or other
  modified_base (416)..(416): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtctgggggagcctggtcaagcctggggggtcccaagactctcttgtgcagcctctggattcaacttcaaaaggctacagcatgaactggatccgccaggctccggggaaggtctgcagtggatttcatccatagnggtcttaagcgtgacaaatttttangcagactcggtagaccggccgtcacatctcagacgacaacgccgtactactttctcttacganaaaatgaaacacgcctacagacgccgaggacacggtcttagtttattcgttgtgcgagaggaggtacgggacggaaacgtacggtacgtacgtacggtacggtaggtagtgttcgtttacgttacgtttacggtacgggtacggaacggtaacg

SEQ ID NO: 384946 - DNA, 601 bp, Homo sapiens
  misc_feature: GZ8MTXP02IEU5R.25.71.G05.1.454.CMB.2.raw
  modified_base (356)..(356): a, c, t, g, unknown or other
  modified_base (444)..(444): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtggggggaggcctggtcaagccgtggggggtcccaagactctcttgtgcagcctctggattcaaacttcaaaggctacagcatgaactggatccgcaggcgtccggggaggtctgcagtggatttcatccattagtgtctaagcgtagactaatttangcagactcggtagaccgggtccgttacaccctatcctccgagaacgaccaacgccgtacgtacctttctctttctgacaaatcgaacncgcctacgaggacgaccggacggacgacggtcttagttttacttcgtggtgacgtaggaggtaggtaggggacgtaaaacgtcgggacttaccggacgggtaggtagtaagttcggttcgtttttggtacgttttcggacgggggtacgtaaacggg

SEQ ID NO: 384947 - DNA, 567 bp, Homo sapiens
  misc_feature: GZ8MTXP02JHBGA.25.71.G05.1.454.CMB.2.raw
  modified_base (312)..(312): a, c, t, g, unknown or other
  modified_base (334)..(334): a, c, t, g, unknown or other
  modified_base (358)..(358): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtcgtgggggaggcctggtcaagccgtggggggtcccgaagactctcttgtgcagcctcgtggattcaacttcaaaggctacagcatgaactggactccgcaggcgtccggggaaggtcngcagtgtattcatccatttagngttactaagcgtagactaaatttngacagtacgtcggtagaccgggtccgttcaccatctacagacgaacacgccgactactttctcttctacgacaaagtacgaactacgacctacagacgaccgaggaccgacggtcttagtttacttcgtgtgcgagacggaggtaggacgaaacgtggactacgtacggagtgaagtgtactttaggtactttcggacgggacgtaagg

SEQ ID NO: 384948 - DNA, 555 bp, Homo sapiens
  misc_feature: GZ8MTXP02HG804.25.71.G05.1.454.CMB.2.raw
  modified_base (310)..(310): a, c, t, g, unknown or other
  modified_base (356)..(356): a, c, t, g, unknown or other
  modified_base (368)..(368): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggatccgccaggctccggggaggtcngcagtgattcatccattagtggtcttaagcgtagactaaattttangcagactcgggngacgggtccgttcaccatcctccagacgacaacgaccgacgtactttactcttctgacaaatagaacagcctcagacgccgaggacacggctgtttattctgtgcgagaggaggtgggacgaaaacgtggacgtacgtacggaggtgaagtgtcgtttacgtagtttcggtaggggaccgtaagggg

SEQ ID NO: 384949 - DNA, 620 bp, Homo sapiens
  misc_feature: GZ8MTXP02H3JV9.25.71.G05.1.454.CMB.2.raw
  modified_base (377)..(377): a, c, t, g, unknown or other
  modified_base (517)..(517): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggccgtgggggtcccaagactctcttgtgcaggcctcgtggattcaacttcaaaggctacagcatgaaactggatccgccaggccgtaccggggaaggtctggcaggtggtacttcatccgaatttaggtggtacttaaagcgtagtaactaaatttttagngacacgtacgtcggtacggaccgggtccgttacacctatcctaccgaagacgaccaaccgtccgtacttacctttcttctttcgagactaaatcgactacgcctagacgacgaccgacggacgcgtcttgtttatttcgngtacggacgagaggtaggtagggtacggtaaacgtacggtacgtacgtacggtaggtagtaagtcgttacgtttacgttacgttacggtacggtacggtacgg

SEQ ID NO: 384950 - DNA, 550 bp, Homo sapiens
  misc_feature: GZ8MTXP02H6V48.25.71.G05.1.454.CMB.2.raw
  modified_base (246)..(246): a, c, t, g, unknown or other
  modified_base (253)..(253): a, c, t, g, unknown or other
  modified_base (255)..(255): a, c, t, g, unknown or other
  modified_base (262)..(262): a, c, t, g, unknown or other
  modified_base (271)..(271): a, c, t, g, unknown or other
  modified_base (274)..(274): a, c, t, g, unknown or other
  modified_base (321)..(321): a, c, t, g, unknown or other
  modified_base (331)..(331): a, c, t, g, unknown or other
  modified_base (415)..(415): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctggggggagcttggtccagccgggggggtccctgagactctcctgtgccngctctgntntagttantagtattgntgngcgtcggcgcgacggccgagggagggcgtggtggtggtacgacacanacacgagagnggaggagagaatactatgcgacgtgtgtaggacggacgtactacacactctccgacgacactacaacaactacatatatactanacaatagtagtagtcgtagagacgacgacggacgacgtcgtgtagttagttcgtcgtgaggtacgtacggtaccgtacccgtaccgtacctacgtaaccgtaccgtacgttacgttcgtttacgtacgtacgtgg

SEQ ID NO: 384951 - DNA, 554 bp, Homo sapiens
  misc_feature: GZ8MTXP02GSXLD.25.71.G05.1.454.CMB.2.raw
  modified_base (353)..(353): a, c, t, g, unknown or other
  modified_base (382)..(382): a, c, t, g, unknown or other
  modified_base (388)..(388): a, c, t, g, unknown or other
  modified_base (408)..(408): a, c, t, g, unknown or other
  modified_base (413)..(413): a, c, t, g, unknown or other
  modified_base (431)..(431): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctggggggtcccaagactctcttgtgcagcctctggattcaacttcaaaggctacagcatgaactggatccgcaggctccggggaggtctgcagtggatttcatccattaggtggtcttaagcgtgtacaaattttngcagactcggtgacggccgttcaccatcnccaganacacgccgacgtactttctntttcngacaaatgaacagcctanagcgaccgaggacacggtcttagtttattctggtgcggagagggagtacggggacaaaacgttggacgtccgtaacgggagtgaagttcgtcgttttagtgtttcggtcggggactaaagggg

SEQ ID NO: 384952 - DNA, 597 bp, Homo sapiens
  misc_feature: GZ8MTXP02F4UG0.25.71.G05.1.454.CMB.2.raw
  modified_base (357)..(357): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttcctgtcgctattttagaaggtgtccagtgtgaggtggtgctggtggagtctgggggaggcctggtcaagcctgggggggtcccaagactctcttgtgcagcctctggattcaacttcaaaggctacagcatgaactggatccgccaggctccggggaaggtctgcagtggatttcatccattagtggtcttaaagcgtgactaaaattttangcagactcggtagaacggtcgtacacatcacagacacaacgcgactacttctcttctcgacaaatagaaacacgacctacgaagaacggaccggaaggtacgacgggtcttacgtttatttcgttgtcggacggaggtagggtaggtacgggacggaaaacgtaacggtacgtacgtacggtacggtagtagtaagttcgtttagttacgtttacgttacgggtacggtaacgggtaacg

SEQ ID NO: 384953 - DNA, 657 bp, Homo sapiens
  misc_feature: GZ8MTXP02JM9H0.25.71.G05.1.454.CMB.2.raw
  modified_base (250)..(250): a, c, t, g, unknown or other
  modified_base (336)..(336): a, c, t, g, unknown or other
  modified_base (353)..(353): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagccgtggggggtcccaagactctcttgtgcagcctntggattcaacttcaaaggctacagcatgaactggactccgccaggcgtccggggaaggtctgcagtggatttcatccattagtgtntagcgtagactaatttngcagactggagacggccgtcacatctaccagacacaaccgccgtaacgtactttccgtctttcgtagaccaaaattcgaaactacgacccgtacaacggtacgcccggaacggaccgacggggtccttaggttttacttaccgtggttacggaccggttaagggtacggggaagggttacgggggaaccgtaaaaacggttcgggtacgttaaccgggtaccggggtaaacggggttcgtaagttggttacgtttttacggacggtttttaccggtacgggggacccgtaaagggggtaacccg

SEQ ID NO: 384954 - DNA, 576 bp, Homo sapiens
  misc_feature: GZ8MTXP02HTBFU.25.71.G05.1.454.CMB.2.raw
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagccgtggggggtcccgaagactctcttgtgcagcctctggattcaacttcaaaggctacagcatgaactggatccgccaggcgtccggggaaggtctgcagtggatttcatccattagtggtcttaaagcgtgactaaattttatgcagactcggtagaccgggccgttcaccgattccaccagacacaacgcccgacgtactttctcgtttctcgacaaatacgacacgacctcgagacgaccggagaccgtacggtcttagtttactttcgtcgtgacgagagggtagtaggggacgaaaacgtggactacgtacggagtgaagttcgtacttttgtacgtttcgacggggtactaaggg

SEQ ID NO: 384955 - DNA, 583 bp, Homo sapiens
  misc_feature: GZ8MTXP02GTJDD.25.71.G05.1.454.CMB.2.raw
  modified_base (352)..(352): a, c, t, g, unknown or other
  modified_base (437)..(437): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggatccgccaggctccggggaggtctgcagtgattcatccattagtgtctaagcgtgactaaattttngcagactcggtgacgggccggttcacctatcctccagagacaacgcccgacgtactttctctttctgacaaatcgaacacgcctnacggacgaccgagggaccacggtcttaggttttattcgtagtgcgtagagggtaagtggggaacgtaaaacgtgggacttcggtaacgggtaggtaggtaagttgttacgttttaggagtttacggtcgggggtacctaaaggggg

SEQ ID NO: 384956 - DNA, 617 bp, Homo sapiens
  misc_feature: GZ8MTXP02HLHZ7.25.71.G05.1.454.CMB.2.raw
  modified_base (374)..(374): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtgggggaggcctggtcaagccgtggggggtcccaagactctcttgtgcagcctctggattcaacttcaaaggctacagcatgaaactggactcccgccaggcgtaccggggaaggtctgcaggtggtatttcatccaatttaggtggttacttaaagcgtagtaactaaattttangacagtacgtcgggtacgaccgggtccgttacaaccgtatcctaccagacgacaaccgccgacgtactttctctttcagactaaatacgaacacgacctacaagacgacgacgaccgacgtcttagtttacttcgtgtgacgtaggaggtaggtagggaacgtaaaacgtcggtactacggtacgggaggttagaagttgttacgttttagtacgtttcggtacggggtaaccgtaaacgggg

SEQ ID NO: 384957 - DNA, 591 bp, Homo sapiens
  misc_feature: GZ8MTXP02I714Y.25.71.G05.1.454.CMB.2.raw
  modified_base (362)..(362): a, c, t, g, unknown or other
  modified_base (445)..(445): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtgggggaggcctggtcaagccgtggggggtcccgaagactctcttgtgcagcctctggattcaacttcaaaggctacagcatgaactggactccgccaggcgtccggggaaggtctgcagtggatttcatccattagtggtctaagcgtagaactaaattttangcagactcggtgaccgggtccgttcaccatctcagacgacaacgccgacgtactttctctttctgactaaatgaacagcctanagacgccgaggacacggtcttagtttattcgtagtggacgtaggagggtaggtaggggactaaaacggtcggacgttacggtaacggggtggtacggtaagttgttacgttttggacgtttaccggacgggggtaccctaaagggg

SEQ ID NO: 384958 - DNA, 878 bp, Homo sapiens
  misc_feature: GZ8MTXP02FQLPJ.25.71.G05.1.454.CMB.2.raw
  modified_base (364)..(364): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccagggccggggggtccctgagactctcctgtgcacgcctcgtggtattctagtttgctagtatttggatgagtcgtcgggtccgccgacggccccggaaggggacggggtcgtgggtggtcgggtacgaccaacataacgacggaaaggngtaggggaaggtaggaaagtaaaatacgtagtacggacggtaaccttcggttgggacgggtaaaccggggccgtaactttacccgaaccttacgttacccgtaacccggaaacgggttaaacccaaaccgttaaccccgaaaactaaacctacgtaaagttaacttaacttaccgaaggtaacctaaaaaggtttaacggaaagtttacgggggtttaaaccctaggggtaaaacgggtaacccggggtaaaccccggggaaacggggaaacccccggtaaagggggttacccgttcggggttttaaagtttacccggttttttccggaaaggggtttccgggaaacccggggttaaagggtttacccggaacccgggtaaacccccccggtaaaaactttccccggtaaaaccggggttaacccccgtttaaaaaccccttttcggttaaacccccgggtttttcggtttttaaaacggtaaggttttaaccgggggtttaaacccggggggg

SEQ ID NO: 384959 - DNA, 671 bp, Homo sapiens
  misc_feature: GZ8MTXP02JXBWF.25.71.G05.1.454.CMB.2.raw
  modified_base (252)..(252): a, c, t, g, unknown or other
  modified_base (308)..(308): a, c, t, g, unknown or other
  modified_base (349)..(349): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctgggtggagtcgtgggggaggcctggtcaaggccgtggggggtcccaagactctcttgtgcagcctntggattcaacttcaaaggctacagcatgaactggatccgcaggctcggggaggtcngcagtgattcatcattgtgtctaagcgtagactaaattttngacagacgttcggtaggaccggggtccggttacaaccctagttccctaccgaaggacgaaacccgaaaccggcccgaaccgttaccttttccttctttcgtacgactaaaatcggaaacacgtccctacgaacggacgaccggaacgggaacctaccggggtactttaggtttttacgtttcgtaggttacggacggaagggtagggtacgggtacggggaaacgtaaaaccggtcgggtacctacggtaacggggtaggtgtaagttcggtttcctttttagggtaacgtttttccgggacgggggtaaccttaaaggggg

SEQ ID NO: 384960 - DNA, 573 bp, Homo sapiens
  misc_feature: GZ8MTXP02HO25B.25.71.G05.1.454.CMB.2.raw
  modified_base (248)..(248): a, c, t, g, unknown or other
  modified_base (351)..(351): a, c, t, g, unknown or other
  modified_base (438)..(438): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtctggggggagcctggtcaagccgtgggggtcccaagactctcttgtgcagcctntggattcaacttcaaaggctacagcatgaactggactccgcaggcgtccggggaaggtctgcagtggattcatccattgtggtctaagcgtagactaaatttngacagtactgggacgaccggtccgttacacctatctacagacacaacgccgactacttctctttctagacaaatacgaacagacctnagacgacgagacgacgtcttagtttacttcgtgtcgacgaggaggtaggtacgggacggaaaacgtgggtactacgtacgggaggtagtaagttgttcgtttaggtacgtttcggtacggggaccgtaaacgggg

SEQ ID NO: 384961 - DNA, 582 bp, Homo sapiens
  misc_feature: GZ8MTXP02JTOUJ.25.71.G05.1.454.CMB.2.raw
  modified_base (359)..(359): a, c, t, g, unknown or other
  modified_base (423)..(423): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggccgtggggggtcccgaagactctcttgtgcagcctctggattcaacttcaaaggctacagcatgaactggatccgccaggcgtccggggaggtctgcagtggatttcatctattagtggtcttaagcgtagactaatttacngcagactcggtagaaccggccgttcacatctacagacaccaacgccgacgtactttctctttcngacaaatgaacacgcctacagacgccggagacgacggtacttgtttacttcgtgtcgcgaggagggaggtacgggaacgaaaagtcgggacttacggtacgggaggtagtagtggttcgttttacggtagtttcggacgggggtaccgtaaaggggtac

SEQ ID NO: 384962 - DNA, 639 bp, Homo sapiens
  misc_feature: GZ8MTXP02F8804.25.71.G05.1.454.CMB.2.raw
  modified_base (249)..(249): a, c, t, g, unknown or other
  modified_base (545)..(545): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttggtccaggccggggggtcctgagactctcctgtgcagcctntggtattctagttttagctagtatttggatgagcgtgggtccgccgacggccccgaggggacggggctgggtggtgggtacaccaaagactacgaacgaaagagtgggaggtagaacgtaaatacgtaagtcggacggtactcgtgggtacggaacggggtccgtattccgacctaactcccgtaccgaagggaacccaaacctaccaaactaactcgagttatactctagaactaaagtgaagtcggtactaggacgacgaccggaggacgacggtcgtgttagttacgtttcgnggttacgacggacggtacgacccggtacccgtaacgtcctaagtaaccgtaacccgttagttcgtttacgtttacgtagttacggttacggggg

SEQ ID NO: 384963 - DNA, 712 bp, Homo sapiens
  misc_feature: GZ8MTXP02ICFNT.25.71.G05.1.454.CMB.2.raw
  modified_base (343)..(343): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcaggttggaggagtcgtgggggaggcttggtccagggccggggggtccctggagactctcctgtgcagcctctggattcgtagttttagctagtattttggatgagcgtcgggtcccgccgacggccccgaggggaaggggctgggtgtgggtagaccaanatacacgaaagagtgggaggtgaacgtaaatactagtggacggtacttcgtggtcggaaacggggtaccctaacgttccaaccgtactcccgtacccgaaggggaaaccctaaaccctacccaaaaccctaaacttaccgaaagttaaacttacgttacctaggtaaaccaaaaagttcggtaaaacgttcgggggtacctaggggtaaacgggaacggggtaccccggaaaggggtaacccgaacgggtccgttaggtttagtttacgtttcgtaggtcggtacggaagggtacgttacccggaccccgtaaacttcccaagtaaccgaacccgttatccggtttatttacgaagttggttacggggg

SEQ ID NO: 384964 - DNA, 695 bp, Homo sapiens
  misc_feature: GZ8MTXP02IY02S.25.71.G05.1.454.CMB.2.raw
  modified_base (245)..(245): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttggtccaggccggggggtccctgagactctcctgtgcngcctcgtggattctagttttagcagtattttggatgagcgtgggtcccgccacggccccgaggggaacggggctggtggtggggtacgccaacatacgacgaaagagtggaggtgaagaaatactatggacggacttcgtggtaggaacggggccgtatttccaaccgtacttcccgtacccgaacggggaaccaaaccgtacccaaaactaaacctaccgaacgttaaatacttacctagaacctaaaagtagaaagttcgggtactaggaagaacggcccggaaagggacccgaacgggtccgttaggttagttaacttttccgtggtttacggacggtacggtaacggttcccggaaccccccggtaaatacccccggtaaattaaccccggtaacccctttaaagttcggttacctttttaacggaactttaacggtttcgggggg

SEQ ID NO: 384965 - DNA, 546 bp, Homo sapiens
  misc_feature: GZ8MTXP02FZWTC.25.71.G05.1.454.CMB.2.raw
  modified_base (308)..(308): a, c, t, g, unknown or other
  modified_base (327)..(327): a, c, t, g, unknown or other
  modified_base (351)..(351): a, c, t, g, unknown or other
  modified_base (407)..(407): a, c, t, g, unknown or other
  modified_base (463)..(463): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggtttcctgtcgctattttagaaggtgtccagtgtgaggtggtgctggtggagtcgtggggggaggcctggtcaaggccgtggggggtcccaagactctcttgtgcagcctctggattcaacttcaaaggctacagcatgaactggatccgcaggctcggggaaggtcngcagtgattcatcattagnggtctaagcgtagactaaattttngcagctcggtgacggcgtcacatctcagacacaacgccgacgactttctactttcngacaaatgaaacagcctacagacgccgaggaccacggcttagtttattcgtgtcgngaggaggagtggggacgtaaaacgtggacgtcgtacggaggtgaagttgtcgttttagagtttcggtcggggtactaaagggg

SEQ ID NO: 384966 - DNA, 563 bp, Homo sapiens
  misc_feature: GZ8MTXP02F9EVU.25.71.G05.1.454.CMB.2.raw
  modified_base (355)..(355): a, c, t, g, unknown or other
  modified_base (421)..(421): a, c, t, g, unknown or other
  modified_base (473)..(473): a, c, t, g, unknown or other
  modified_base (513)..(513): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtctgggggaggcctggtcaaggcctggggggtcccaagactctcttgtgcagcctctggattcaacttcaaaggctacagcatgaactggatccgccaggctccggggaaggtctgcagtgatttcatccattagtggtcttaagcgtagactaaattttangcagactcggtgaccgggtccgttcaccgatcctccagagacaacgccgacgtactttctctttcngacaaatcgaaacagcctacagacgccgaggaccacggcttgtttacttcgngtgcgagaggagtagggacaaaacgtggactcgtacgggngtagaagttcggtacttttagacgttttcggacgggggacctaaaggggg

SEQ ID NO: 384967 - DNA, 636 bp, Homo sapiens
  misc_feature: GZ8MTXP02H57PF.25.71.G05.1.454.CMB.2.raw
  modified_base (353)..(353): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtgggggagcctggtcaagccgtgggggtcccaagactctcttgtgcagcctctggattcaacttcaaaggctacagcatgaactggactccgcaggcgtaccggggaagtctgcagtgtattcatcagttagtgtctaagcgtagactaaatttngcaagtcgtcggagaccggtccgttacaccgtattccaccgaagacgaaccaaccgaccgtacgtacctttctcctttactacgtaactaaagtacgaaacacgtacctacgaaacggacgtacccggaaggaccgacggttactttagtttaacttcgtaggttacgacggtaaggaacgggttaggtacggggaaacgtaaaacgtcgggtaccgtacggtacgggtaaggtagtaacgttgttacgttttagtacgttttcggacggtaccgtaaacggg

SEQ ID NO: 384968 - DNA, 695 bp, Homo sapiens
  misc_feature: GZ8MTXP02G4GZA.25.71.G05.1.454.CMB.2.raw
  modified_base (368)..(368): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtgggggaggcctggtcaagccgtggggggtcccaagactctcttgtgcagcctctggattcaacttcaaaggctacagcatgaactggactccgccaggctaccgggggaaggtctgcgaggtggtatttcatcctattagtggtcttaaagcgtagaactaaattttangtacagtaccgtcgggtacgaccggggtccggttaccacctaacttcctaccgaaaggaccgaaaccgaaaccgacccgtaacgttaacctttccgttccttttactacggaactaaaacgtacggaaaacctacgtacccttacgaaggaccggaccggaacgggaccgtaccggtactttagtttacgtttcgtaggttcgacggtaaggagggtaggtacgggacgtaaaacggtggtaccgtacggttaacgggaggttaggtaacgttcggttacgtttttaggtaacgttttccggggtacgggggtaccgttaaacgggg

SEQ ID NO: 384969 - DNA, 772 bp, Homo sapiens
  misc_feature: GZ8MTXP02GFNVU.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttggtccaggccggggggtcctgagactctcctgtgcagcctctggattcagttttagctagtattttggatgagcgtgggtccgccgacggccccgaggggaacggggtctgggtggtggggtacgccgaacatacgacggaaagagtgggaggtagaagtaaatacgtagtcggacggtaacttcgtgggtacgggaaacgggggtccgtaacgtttacccgaacccgtacgttacccgtacccgaagggggtaaacccctaaacccttaaccccgaaaaccctaaaccctacccgtaaagttaaacgttaacttaccgttacgtaaaccgtaaaaagttacggtaaaagtttcggggttaaccgttagggaaacgggtaaccgggacccgggaaacggggaaccgtaaccggggtaccgttaggttacggtttaacgttttcggtaggtttcggaccgggtaagggtaccggttccggaaccccccgtaaatccccgtaaacgttaaccggtaacccccttaaggttcgtttaccgttttacgacgtttaacggtttcggggg

SEQ ID NO: 384970 - DNA, 774 bp, Homo sapiens
  misc_feature: GZ8MTXP02GZSVB.25.71.G05.1.454.CMB.2.raw
  modified_base (313)..(313): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctcgctgggttttcctgtcgctattttagaaggtgtccagtgtgaggtggtgctggtggagtcgtgggggagcctggtcaagccgtggggggtcccgaagactctcttgtgcagcctctggattcaacttcaaaggctacagcatgaactggactccgcaggcgtccggaagggtacgtcgngacgtaggtagtacttacgtactacgttaagttaggttacgttaacgtaaggtacgtaagtaaaaccttttaaagtttagacgtacgtaacgtaccggttacgggtaccggtaacccgggttcccggtaaccctaacccgtacttaccgaccgaaacgaaaccgaaacccaacccggtacccggttaaacgtttcctttacccgttttccttacgtaacgtaaaacttaacgaaaccgaactaccgtaccctaaggaaacggtcccggaaccggaaaccggaacggtacccgttagttttacgtttactttacggtggtaaccgggtaggtaaagggaaggggttaacgggaaccggggtaaaaccgtaaacgggttcggaaccggttacgggtaacggtaaggtaagttacgttacgtttacgttagtttacggtacgggggttaccgggtaaaaccggg

SEQ ID NO: 384971 - DNA, 572 bp, Homo sapiens
  misc_feature: GZ8MTXP02F772E.25.71.G05.1.454.CMB.2.raw
  modified_base (164)..(164): a, c, t, g, unknown or other
  modified_base (270)..(270): a, c, t, g, unknown or other
  modified_base (294)..(294): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtgggctccgctgggttttcctgttgctgttttaaaggngtccaatgtgaggtgcaactgggtggagtcgtggggggaggcttgggtacagccagggcccggtccctgacactctcctgcacagccttccggactcacctttggngagcatgctatcgacctgggtccnccaggctccgaggggaaggtctggagtggcttgggttcagttagagcgaagcctagtgggtggggccaacgacaatccgccgcgttactaggtaaaaggctaagacttcgacgtccctactacaagagatagattaccaaaagcatcgacctatctgcacatgagcagcctagagagcgaggactcgagtccgtagttattacgttcgtttacttacttacgtcgttaggaaggtaagttaggttacggtttaatttactttaacccttatttaaacc

SEQ ID NO: 384972 - DNA, 544 bp, Homo sapiens
  misc_feature: GZ8MTXP02JCEDQ.25.71.G05.1.454.CMB.2.raw
  modified_base (310)..(310): a, c, t, g, unknown or other
  modified_base (350)..(350): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggatccaccaggctccggggaggtcngcagtgattcatccattgtgtctaagcgtgactaattttngcagctcggtgacggcgttcaccatctcagagacacgccgacgtacttctcttctgactaaatgaacacgacctacacgacgccgaggaccgacggtctagtttattctgttgcgagaggaggtgggacgaaaacgtcgacgtacgtacggaggtgaagtcgtcgtttcgtagtttcgtcggggtacgtaaggg

SEQ ID NO: 384973 - DNA, 605 bp, Homo sapiens
  misc_feature: GZ8MTXP02FUKJX.25.71.G05.1.454.CMB.2.raw
  modified_base (306)..(306): a, c, t, g, unknown or other
  modified_base (327)..(327): a, c, t, g, unknown or other
  modified_base (356)..(356): a, c, t, g, unknown or other
  modified_base (433)..(433): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtcgtgggggagcctggtcaagccgtgggggtcccaagactctcttgtgcagcctctggattcaacttcaaaggctacagcatgaactggatccgcaggctaccggggaggtcngcagtgtattcatccattagnggttacttaagcgtagaactaaatttttngacagtacgtcggtagaccgggtccgttacaccgtatcctaccgagacgaccaacgccgacgtactttctctttacngacaaatcgaaacacgacctagacgacgccgaacgaccgacggtattagtttacttcgtagtcgagaggagggtacggtagggaacgtaaaacgtggtacttacgtaacgggaggtagtaagttcggttcgttttaggtacgtttttacgggacggggtaccgtaaacgggg

SEQ ID NO: 384974 - DNA, 600 bp, Homo sapiens
  misc_feature: GZ8MTXP02HPP90.25.71.G05.1.454.CMB.2.raw
  modified_base (376)..(376): a, c, t, g, unknown or other
  modified_base (379)..(379): a, c, t, g, unknown or other
  modified_base (449)..(449): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtggggggaggcctggtcaaggccgtggggggtcccgaagactctcttgtgcagcctctggattcaacttcaaaggctacagcatgaactggactcccgccagggccgtccgggggaaggtctggcaggtggattttcattcctatttagtggtacttaagcgtagtaactaaattttanganagtactcgggtagaccgggtccgttacacctatcctaccagacgacaacgccgacgtacttcttctttcngactaaatgaaaccagacctcgaacgacgaccgaggacctacggtctttgtttacttcgtgtgcgaggtagggagtaggggacgaaacgtggtactacgtacggaggtgtaagtgttacttttacgagttttcggcggggtaacgtaaggg

SEQ ID NO: 384975 - DNA, 664 bp, Homo sapiens
  misc_feature: GZ8MTXP02JH4M2.25.71.G05.1.454.CMB.2.raw
  modified_base (356)..(356): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggtttccttgtcgctattttagaaggtgtccagtgtgaggtggtgctggtggagtctgggggagcctggtcaagcctggggggtcccaagactctcttgtgcagcctctggattcaacttcaaaggctacagcatgaactggatccgcaggctccggggaaggtctgcagtggatttcatccattagtggtcttaagcgtgaactaaatttttacgngacagtacgtcggtacggaccgggtccgttacacctactccacgagacgaacccgaaccgcccgtaaccgttacctttccttctttcgtacgtaactaaagtacgaaactacgacctacgacggacgaccggacggtaccgtacgggttactttagttttactttcgtggtacggacggtaagggtagggtacgggtacggggaaaccgtaaaacggtcgggtaccgttaccggtaacggggtacggttagtagttcggttacgtttttacggtacgtttcgggtacgggggtaccgtaacgggtacg

SEQ ID NO: 384976 - DNA, 557 bp, Homo sapiens
  misc_feature: GZ8MTXP02GXRII.25.71.G05.1.454.CMB.2.raw
  modified_base (310)..(310): a, c, t, g, unknown or other
  modified_base (354)..(354): a, c, t, g, unknown or other
  modified_base (422)..(422): a, c, t, g, unknown or other
  modified_base (544)..(544): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtggggaggcctggtcaagccgtggggggtcccaagactctcttgtgcagcctctggattcaacttcaaaggctacagcatgaactggactccgccaggctccggggaaggtcngcagtggattcatccattagtgtcttaagcgtagacaaattttngcagtactcgggtgaccgggtccgttacaccatcctcagacgaacacgccgacgtactttctctttcncgacaaatcgaacacgcctacagacgccgaggacacggcttgtttacttctggtgcgagtaggaggtaggggacaaaacgtggacttccgaacggtggtagaagttgtactttgatttcggngggaccgtaaggg

SEQ ID NO: 384977 - DNA, 634 bp, Homo sapiens
  misc_feature: GZ8MTXP02HJEDP.25.71.G05.1.454.CMB.2.raw
  modified_base (363)..(363): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctgggtggagtcgtgggggaggcctggtcaagccgtggggggtcccaagactctcttgtgcagcctctggattcaacttcaaaggctacagcatgaactggactccgccaggcgtaccggggaaggtctgcagtggtatttcatccattagtggtacttaagcgtagtactaaattttngcagtactgggtacgaccgggtccggttacaccgtatcctaccgaagtacgaaccaaccgcccgtaacgtactttccttctttctgactaaatacgaacacgtaccctacaacggacgccggaacggtacgacggtcttgtttactttcgtagtggacgaggtacggtacgggtacgggaacggtaaaacgtgggaccttaccgggtacgggaggttagtaagttcggttcgttttagtacgttttccggacgggggtaaccgtaaagggg

SEQ ID NO: 384978 - DNA, 647 bp, Homo sapiens
  misc_feature: GZ8MTXP02GXK9Z.25.71.G05.1.454.CMB.2.raw
  modified_base (363)..(363): a, c, t, g, unknown or other
  modified_base (439)..(439): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggccgtggggggtcccaagactctcttgtgcagcctctggattcaacttcaaaggctacagcatgaactggatccgcaggcgtccggggaaggtctgcagtggtatttcgatccattagtggtcttaaagcgtagaactaaattttangcagtacgtcggtagaccgggtcccggttcaccgatccgtacagacgacaacgccgtacgtactttctactttcanacaaatcgaacacgcctacgaaggacgacccggaggaccgaacggtccgtttagtttacgtttcgtaggttggacggaagggtaagggacggttacgggggaacgtaaaacggttcgggaccgttacggtaaccggggtaggttacgtaaggttcggtttacgttttagggtacttttacggggtccgggggaaccgttaaacggggg

SEQ ID NO: 384979 - DNA, 811 bp, Homo sapiens
  misc_feature: GZ8MTXP02IVFVF.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtggggggaggcttgggtccaggcccggggggtcctgagactctcctgtgcagcctctggattcagttttagcagtattttggatgagcgtgggtccgccgacggccccgaaggggaagggggtctggggtggtggggtacgaccgaaactataaccgaacggaaagaagttggggaacggttaggaaaggaaaaaattacgtaagtacggacggggaacctttcgtggggtagggaaaacgggggtcccgtaaagtttacccgaaaccctaacgttacccttacccgaaacgggggtaaaccctaaaaccttaaccccaaaaactaaaacccttaacccgaaacggtttaaaattaaccttacgttacgaacctaaaaaagttacggtaaaaagtttcggggtttaagaccgggaaagggaaaccggacccccgggaaaggggtaaccgaaccggggtaaccgtttaacgggtttgttaaaagtttttccgttacggggttggaacccggtaaggtaaacgggtccggtaccccccggtaaaattccccgaaagttaaacgaacccccgtttaaattccgggtacttttttacggaactttaacgtttcggggg

SEQ ID NO: 384980 - DNA, 604 bp, Homo sapiens
  misc_feature: GZ8MTXP02JSYGA.25.71.G05.1.454.CMB.2.raw
  modified_base (380)..(380): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccaggcccgggggggtccctggacgactcgtcctgtgcagcctcgtggattcgtagttttagctagtattttggatgagctgggtccgccacggccccgaggggaggggtctaggtgtgggtagccaaagactacgacgaagagtgggaggtgaacgtaaatcgtangcggatcgtggtagacggggcctattcaccgatcctaccgaaggactaacctaccaaacactacagtatactctagactaaatgtaaatggtactaggagacgcgaacgacgacgcttaggtcgttacgttctcggtgacggacgacggttccgaacccgtaacttacccggaataaccggtaacccttagtacggtctttttacggaacgttaggttcggggg

SEQ ID NO: 384981 - DNA, 560 bp, Homo sapiens
  misc_feature: GZ8MTXP02JKHM0.25.71.G05.1.454.CMB.2.raw
  modified_base (275)..(275): a, c, t, g, unknown or other
  modified_base (311)..(311): a, c, t, g, unknown or other
  modified_base (353)..(353): a, c, t, g, unknown or other
  modified_base (385)..(385): a, c, t, g, unknown or other
  modified_base (413)..(413): a, c, t, g, unknown or other
  modified_base (471)..(471): a, c, t, g, unknown or other
  modified_base (479)..(479): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtcgtggggggaggcctggtcaagccgtggggggtcccgaagactctctgtgcagcctctggattcaacttcaaaggctacngcatgaactggatccgccaggcgtcggggaaggtcngcagtggatttcatccattagtgtcttaagctgactaatttngcagctcggtagacgcgtcacatcctccaganacaacgtccgacgtactttctcgtttcngacaaatgaaacacgtcctagagacgccgagaccacgggtcttgtttacttctgtcgngagagggnggtacgggacgaaacgtcgtacgtacggtacggacgtgtagtcgttagtttacgtacgttcggtacgggtacgtaggtacg

SEQ ID NO: 384982 - DNA, 611 bp, Homo sapiens
  misc_feature: GZ8MTXP02HCEUY.25.71.G05.1.454.CMB.2.raw
  modified_base (298)..(298): a, c, t, g, unknown or other
  modified_base (343)..(343): a, c, t, g, unknown or other
  modified_base (522)..(522): a, c, t, g, unknown or other
  modified_base (527)..(527): a, c, t, g, unknown or other
  modified_base (540)..(540): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgcttattttagaaggtgtccagtgtgaggtgcagttggaggagtcgtgggggaggcttgggtccaggccggggggtcctgagactctcctgtgcagcctcgtggattctagtttagctagtattttggatgagtcgtcgggtcccncgacggccccgaaggggacggggctgggtggtgggtacgaccaanatacgacgaaagagtgggaggtagaagtaaatacgtagtggacggtaacttcgtggtagggaaacggggtcccgtaattcccgaactactaccgtacccgaagggaacccaactacccaaacaactacagtactatctagactaaaagtgaaagtggtactagaggacgaccgaggacncggtnttgtgttattcgngtcgagagcgtaccgaccctaactccaacgtaaccgtaccttagtcgttacgtttagtacgtacggtcggg

SEQ ID NO: 384983 - DNA, 588 bp, Homo sapiens
  misc_feature: GZ8MTXP02H92S7.25.71.G05.1.454.CMB.2.raw
  modified_base (255)..(255): a, c, t, g, unknown or other
  modified_base (514)..(514): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagtcttgggtccgaggccgggggggtccctggagactctcctgtgcagcctntggattcagtttagcagtattttggatgagcgtgggtcccgcgacggccccgaggggaacggggtctgggtcggtaggggtacgaccgaaaactagtaaaccgaacggaaagagtaggggaggtagaaacggaaaatactagtggacggtactcgtgtaggaaagggccctattccaccatccaccgaggaactaactaccaaacaactacagtaatactctgaacaaatgaaatggtacagagagccgaggacacggntgtagtacttctgtagcgaagcgtcgaccccgatcccagtaacgaccctagtacgtctttagacttagtcgggg

SEQ ID NO: 384984 - DNA, 554 bp, Homo sapiens
  misc_feature: GZ8MTXP02I05EB.25.71.G05.1.454.CMB.2.raw
  modified_base (330)..(330): a, c, t, g, unknown or other
  modified_base (353)..(353): a, c, t, g, unknown or other
  modified_base (385)..(385): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtgggggtcccaagactctcttgtgcagcctctggattcaacttcaaaggctacagcatgaactggatccgcaggctccggggaaggtctgcagtggattcatccatttagnggtctaagcgtagactaaatttngcagactcggtagacgggtccgttcaccatcnccagacgacaacgccgacgtacttctctttctgacaaatgaacacgcctacagagccgagacacgctgtttacttctgtgcgagaggaggtgggacgaaaacgtgggcttacgaacgggaggtgtaagtggttacttttaggacgtttcggtacggggacctaaagggg

SEQ ID NO: 384985 - DNA, 666 bp, Homo sapiens
  misc_feature: GZ8MTXP02HW3IY.25.71.G05.1.454.CMB.2.raw
  modified_base (311)..(311): a, c, t, g, unknown or other
  modified_base (314)..(314): a, c, t, g, unknown or other
  modified_base (329)..(329): a, c, t, g, unknown or other
  modified_base (339)..(339): a, c, t, g, unknown or other
  modified_base (349)..(349): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggccgtggtcaagccgtggggggtcccaagactctcttgtgcagcctctggattcaacttcaaaggctacagcatgaactggactccgcaggcctcggggaaggtcngcngtgattcatcattgngtctagcgtnactaatttcngccagctggtagaaccggtccggttacacgtactcctacagtacgaccgaacgccggaactactttcttacgtttctagacctaaaagtcgaaacacgtacctagacggacggaccccggaaggtaccgaacccggggtttcgtttacgttttacgttacggtaggtacggtaacgggtaagggtaaggggtacgggtacggggtaaaccgtaaacgggtcggtaccggttaacggtacgggggtacggttagtacgttaacggtttcgttttacggtacggtttaccggggaccggggtaaccggtaacgggtacc

SEQ ID NO: 384986 - DNA, 549 bp, Homo sapiens
  misc_feature: GZ8MTXP02G3HA7.25.71.G05.1.454.CMB.2.raw
  modified_base (328)..(328): a, c, t, g, unknown or other
  modified_base (351)..(351): a, c, t, g, unknown or other
  modified_base (440)..(440): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctggggggtcccaagactctcttgtgcagcctctggattcaacttcaaaggctacagcatgaactggatccgcaggctccggggaaggtctgcagtgatttcatccattagnggtcttaagcgtgactaaatttngcagactcggtagacggtccgttacaccgatcctccaagacgaacaacgacccgacgtactttctctttctgacaaatgaaacagcctnacgacgccgaggacacggcttgtttattcgtgtgcgagaggagtagggactaaaacgtggactacgtacggaggtgaagtgtactttgatttcggcgggaccgtaaggg

SEQ ID NO: 384987 - DNA, 615 bp, Homo sapiens
  misc_feature: GZ8MTXP02IYAO7.25.71.G05.1.454.CMB.2.raw
  modified_base (305)..(305): a, c, t, g, unknown or other
  modified_base (541)..(541): a, c, t, g, unknown or other
tcagactgtacagtcacgaccggtgctcgatttagtgtcgtcgcaagagagaggagccttagccctggactccaaggccctttccacctggtgatcagcactgagcacagaggactcaccatggaattggggctgagctgggttctccttgttgcttattttagaaggtgtccagtgtgaggtgcagttggaggagtcgtgggggagtcttggtccgagggcccggggggtcctggagactctccgtgtcgcagcctcgtggtattcgtagttttagctagtatttggatgagcgtcgggtcccncgacggccccgaggggaacggggctaggggtggtgggtacgaccaaaacataaccgaacggaaagagtgggaaggtagaaacgaaaatacgtagtcggacggtaacttcgtggtagggaaacggggcctacttccgaacctatccctaccgaacgggaccaaacctaccaaacaactacaagtatacgtctagaactaaagtgaaagtggtccaggaagacgacgacgacgacgtntgtagttattcgtagtgacgtagacgtcgaccccgatccgaataaccgacctagtcgtactttgaatgtacggg

SEQ ID NO: 384988 - DNA, 564 bp, Homo sapiens
  misc_feature: GZ8MTXP02H3GFN.25.71.G05.1.454.CMB.2.raw
  modified_base (328)..(328): a, c, t, g, unknown or other
  modified_base (346)..(346): a, c, t, g, unknown or other
  modified_base (385)..(385): a, c, t, g, unknown or other
  modified_base (422)..(422): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggtttccttgtcgctattttagaaggtgtccagtgtgaggtggtgctggtggagtctgggggagcctggtcaagcctgggggtcccaagactctctgtgcagcctctggattcaacttcaaaggctacagcatgaactggatccgcaggctccggggaggtctgcagtggatttcatccattagtggtntaagcgtgactaaatttngcagactcggtagaacggtcgttcaccgatctaccaganacaacgccgacgtactttctcttctagacaatgaacncacacgagacgacgagacgtacgtcttagtttacttcgtgtcgacgaggacggtaggtacgggaacgtaaacgtcgacgtacgtacgggtacgtagtagttgttacgtttacgtacgttacggtacgggtacgtaacggtcg

SEQ ID NO: 384989 - DNA, 650 bp, Homo sapiens
  misc_feature: GZ8MTXP02GSIR5.25.71.G05.1.454.CMB.2.raw
  modified_base (256)..(256): a, c, t, g, unknown or other
  modified_base (339)..(339): a, c, t, g, unknown or other
  modified_base (346)..(346): a, c, t, g, unknown or other
  modified_base (482)..(482): a, c, t, g, unknown or other
  modified_base (505)..(505): a, c, t, g, unknown or other
  modified_base (525)..(525): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattgggctgagctggttctccttgttgcttattttagaaggtgtccagtgtgacggtgcagttggaggagtcgtgggggagcgttggtccagggcccggggggtccctgagtactctcctagtgcagccctntgggtacttcgagttttagctagttatttaggatgagtcgtgggtcccgccgaggccccgaggggaacggcgtggtgtggtanccgtaanacgtacgaacgaagagtcggaaggtagaaccgtaaaatcgtaagtcggacgacgttcgttggacggaaagggtcccgtagttaccaacgtactcgtacccgaaggtaaccaacgtaccaactaacgtacagtatanctagactaaagtgaaatcggtanagaagacgacgagacacggngtacgtagttaaccgttcgtaggtacgaccgggtagtacggttaccgacccccggtaaatccccggtaataacccggttaaccctagttacggtacctttttacggacgtttaggttaaccgggg

SEQ ID NO: 384990 - DNA, 603 bp, Homo sapiens
  misc_feature: GZ8MTXP02ID5G1.25.71.G05.1.454.CMB.2.raw
  modified_base (352)..(352): a, c, t, g, unknown or other
  modified_base (562)..(562): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtctggggggaggcctggtcaagccgtggggggtcccaagactctcttgtgcagcctctggtattcaacttcaaaggctacagcatgaactggatccgcaggctccggggaggtctgcagtgattcatcattgtgtcttaagcgtgactaaattttangcagacttcgggtagaccgggcccggttacacccgtattcctaccgaagacgaaccgaaccgcccgtacgtactttctcgtttctgactaaatcgaaactacgcctacacggacgaccgacggaccgaacggtcgttagttttacgtttctggttgacgtaggaggtaggtagggacgaaaacgttcggacgttacgacgggtaggtagngtagttcgttttgacgttttcggaggggtaccgtaaagggg

SEQ ID NO: 384991 - DNA, 555 bp, Homo sapiens
  misc_feature: GZ8MTXP02J08WQ.25.71.G05.1.454.CMB.2.raw
  modified_base (312)..(312): a, c, t, g, unknown or other
  modified_base (360)..(360): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggactccgcaggcgtccggggaaggtcngcagtggatttcatccattagtggtacttaagcgtgaactaaatttangacagactcggtgaccggccggttcaccatcctcagacgacaaccgaccgacgtactttctctttcagactaaatagaacagcctacacggacgaccgaggaccgacggtcttagtttattcgtgtgacgagaggagtgggacaaacgtggactcgacggagtgaagtgtctttgtagtttcgtcgggactaagg

SEQ ID NO: 384992 - DNA, 679 bp, Homo sapiens
  misc_feature: GZ8MTXP02F9AEC.25.71.G05.1.454.CMB.2.raw
  modified_base (273)..(273): a, c, t, g, unknown or other
  modified_base (335)..(335): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgcttattttagaaggtgtccagtgtgaggtgcagttggaggagtcgtgggggagcttggtccagggccggggggtccctgagactctcctgtgcagcctcgtggattcagttttagcagtntttggatgagcgtggtccgccgacggccccgaggggaggggctggtggtggtacgccgaaanacgtacaacggaagagtgggaaggtacgaagaaaatactagtcggacggtacttcgtgggtacggaaacggggtccgtaacttccgaaacctacttacccgtacccgaaacggggaaaccctaaaacccgtacccaaaaccgtaaacctaccgtaaacgttaattaactacgtacgaaactaaaagttacgtaaagttcgggtactaggaaacggacggaaccggaacggaccgacgggtcttaggtacgtttacgtttcgtggtaggacggtagtaacggtccgacccccgtaaatcccgaaagtaaccgtacccttagtcgtctttacgacgttagtcgggg

SEQ ID NO: 384993 - DNA, 594 bp, Homo sapiens
  misc_feature: GZ8MTXP02FQTK6.25.71.G05.1.454.CMB.2.raw
  modified_base (291)..(291): a, c, t, g, unknown or other
  modified_base (328)..(328): a, c, t, g, unknown or other
  modified_base (340)..(340): a, c, t, g, unknown or other
  modified_base (449)..(449): a, c, t, g, unknown or other
  modified_base (494)..(494): a, c, t, g, unknown or other
  modified_base (511)..(511): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttggtccaggccggggggtccctgagactctcctgtgcagcctcgtggattcagttttagcagtatttggatgagcgtgggtccnccgaggccccgagggaggggctggtgtggtagccaanatacgacgaagngtaggaggtagaagtaaaatactagtggacggacttcgtggtcggaaggggcctattccgactactctaccgagggaaccaactacccaaacactacaagtatatctanactaaatagtaaatggtactagacgacggccgtaggacgacggtntcgtagttacgtttcgnggtgacggagtacgtccgtacccgaactccgaagtaacccgtaccgttagttcgttacgttttagacgttaggttaccggggg

SEQ ID NO: 384994 - DNA, 574 bp, Homo sapiens
  misc_feature: GZ8MTXP02H1YWR.25.71.G05.1.454.CMB.2.raw
  modified_base (351)..(351): a, c, t, g, unknown or other
  modified_base (471)..(471): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggccgtggggggtcccgaagactctcttgtgcagcctctggattcaacttcaaaggctacagcatgaactggactccgcaggcgtccggggaggtctgcaggtgattcatcattgtgtactagcgtgactaatttngcagctggtacgacgggccgttacacctatcctaccagacgaccacgccgacgtactttctctttctgacaaatgaacacgcctacagacgtaccgaggacgacgtctagtttactttcngtgtagagaggtaggtagggacgtaaaacgtcggacgtacgtacgggaggtagtaagttcggttcgttttacgtagtttcggtacggggtaccgtaaacgggg

SEQ ID NO: 384995 - DNA, 645 bp, Homo sapiens
  misc_feature: GZ8MTXP02G7YT9.25.71.G05.1.454.CMB.2.raw
  modified_base (366)..(366): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtgggggaggcctggtcaagccgtgggggtcccaagctctcttgtgcagcctcgtggattcaacttcaaaggctacagcatgaactggatccgcaggcgtaccggggaaggtctgcaggtggtatttcgatccatttagtggtacttaaagcgtagaactaaattttangcagacgtcggtagaccggtccgttacaccatcctacaagacgacaacgccgacgtactttctctttcagacaaatacgaaacacgacctacgaagacgaccgaacggaaccgaacggtccgtttaggtttaactttcgtgtacggagaaggagggtagggtacggggaaacgaaaaacggtcgggtaacgtaccggtaacgggtaagggttacggtaaagttggttaccgtttttacggtaagttttccggtacgggggtaacccggtaaaacggggg

SEQ ID NO: 384996 - DNA, 552 bp, Homo sapiens
  misc_feature: GZ8MTXP02G2BJI.25.71.G05.1.454.CMB.2.raw
  modified_base (304)..(304): a, c, t, g, unknown or other
  modified_base (324)..(324): a, c, t, g, unknown or other
  modified_base (350)..(350): a, c, t, g, unknown or other
  modified_base (455)..(455): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtctgggggagcctggtcaagcctggggggtcccaagctctcttgtgcagcctctggattcaacttcaaaggctacagcatgaactggatccgccaggctccggggaggtcngcagtggattcatcattagnggtctaaagcgtagtactaaattttngacagactcgcgtgaacggccggttacacctatctaccagacgacaacgccgacgtactttctcttctgacaaatgaacacgcctcacgagccgagggacacggnttcgtttattctgtgcgtaggacggaggtacggacgaaacgtggtactacgtaggaggttaagacttcggttctttagtacgtttcggacgggtacg

SEQ ID NO: 384997 - DNA, 582 bp, Homo sapiens
  misc_feature: GZ8MTXP02IM3T2.25.71.G05.1.454.CMB.2.raw
  modified_base (436)..(436): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccgaggcccgggggggtccctggagactctcctgtgcagcctctggattcagttttagcagattttggatgagctggggtccgccgacggcccccgaggggaacgggggctggggtggtgggtagccaacatacacgaagagtgggaaggtgaagaaaatactatgcggactctggtgaagggccgattccacatcctacgaggaccaactaccaacaacctnagtatatctagactaaatagaaagtggtactaggagacgccggaaggacgacggtctggtacgttatttcgtggtgaccggaggtacggtcgaccccgaagtcccaataaccggtaacccttatcgtactttcgatacgttcgggg

SEQ ID NO: 384998 - DNA, 694 bp, Homo sapiens
  misc_feature: GZ8MTXP02G6FBM.25.71.G05.1.454.CMB.2.raw
  modified_base (377)..(377): a, c, t, g, unknown or other
  modified_base (635)..(635): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccaagactctcttgtgcagcctctggattcaacttcaaaggctacagcatgaactggactccgcaggcgtccggggaaggtctgcaggtggtatttcagttcctagtttaggtggttacttaaaggtcgtagtaactaaacgtttttangactagacgttcggggtagaccgggtccggtttacaaccgtatcctaccaagacgaccaacgcccgacgtacctttctctttcacgactaaagtcgaaacacgtaccctacgaacggacggtacccggaacgggtaaccgtaccggggtaccctttagggtttttaactttccggtaggttaccggacgggtaaggaacggggtaacggggttacggggaaaccgtaaaacggttcgggacgttacgggtaaacgggnggttagtaagttcggtttacgtttggtaacgttttcggacgggggtacgttaaacgggg

SEQ ID NO: 384999 - DNA, 708 bp, Homo sapiens
  misc_feature: GZ8MTXP02J3O8I.25.71.G05.1.454.CMB.2.raw
  modified_base (356)..(356): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgcttattttagagtgtccagtgtgaggtgcaggttggaggagtcgtgggggagtcgttgggtccagggcccgggggggttccctggacgacttcctccgtgtcgcagtcctcgtggtattctagttttagctagtagttttggatgagtcgtcgggtccgccgacggccccggaggggacggggctgggtgtgggtacaccaanatacacggaagagtagggaggtagaagaaactacgtagtcggacggtacttcgtgggagggaaaccggggtcctattccaaccttaacgtcccgtaacccggaaaccggggaaaccctaaacccgttaaccccaaaaccctaaaccttaccggtaaagttaacttactaccgttacggaactaaagtagtaaacgtggtacagggaacggacggtaccggaacgggtaaccgcggtacgttaggttagtttacgtttcgtaggtcggacggtaaacggccgttacccggacccgaactcctaaacgtaaccggtacccttagtcgtttacgtttacgacgttaggtcggggg

SEQ ID NO: 385000 - DNA, 548 bp, Homo sapiens
  misc_feature: GZ8MTXP02GBZOK.25.71.G05.1.454.CMB.2.raw
  modified_base (319)..(319): a, c, t, g, unknown or other
  modified_base (348)..(348): a, c, t, g, unknown or other
  modified_base (405)..(405): a, c, t, g, unknown or other
  modified_base (424)..(424): a, c, t, g, unknown or other
  modified_base (500)..(500): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggatccgcaggctccggggaggtctgcagtgattnatcatgtgtcttaagcgtgactaaatttngcagctcggagacggccgtcaccatctcagacacacgccgacgtactttctctttcngactaatgaacacgcctanagacgacgaggacacgtcttagtttattcgtgtgacgagaggaggtcgggacgtaaaacgtcggactcgtacgggngtagtaagttgtacgttttgtacgtttcggtacggggacctaaagggg

SEQ ID NO: 385001 - DNA, 658 bp, Homo sapiens
  misc_feature: GZ8MTXP02I6K4M.25.71.G05.1.454.CMB.2.raw
  modified_base (332)..(332): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttggtccaggccgggggggtccctgagactctcctgtgcagcctctggtattctagttttagcagtattttggatgagcgtggtccgccgacggccccgaggggaggggcgtggtggtgggtacnccgaacagtacgacgaaagagtgggaggtagaagtaaatacgtagtggacggacttcgtggtagggaaacggggtccgtactttccaaccgtatcccgtaccgaacgggaacccaaacgtacccaaacgtaacctacctaagttaactacttaccgtagaactaaagttagaaagtggttacgtaggaacgggaccggaccggaagggaaccgacgggtcgttgttagttagtttcgtggtacgtcggacggtacgtaccggaccccgtaactccctaagtaaccgtacccttagttcgttacgtttacgacgtttaggttcgggg

SEQ ID NO: 385002 - DNA, 645 bp, Homo sapiens
  misc_feature: GZ8MTXP02FRITO.25.71.G05.1.454.CMB.2.raw
  modified_base (327)..(327): a, c, t, g, unknown or other
  modified_base (353)..(353): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttcctgtcgctattttagaaggtgtccagtgtgaggtggtgctggtggagtctgggggagcctggtcaagcctgggggtcccaagctctcttgtgcagcctctggattcaacttcaaaggctacagcatgaactggatccgcaggctccggggaaggtctgcagtggatttcatccatttacgngtcttaaagcgtagactaaattttangcagtactcgggtacgaacgggccgttcaccgattcctccgaagacgtaaccaacgccgtaacgtactttctctttctagactaaaagtcgaaacgacgtacccttacgaacggacgcccggaaggacccgtaaccggggtcctttagttttacttttccgaggtttcgacggtaagggtacgggaaggttacgggggaaacgaaaacgttcggggtacttaccggtaacggggtaggtacgtacgtgttacgttttgtacgttttcggtacgggggaccgtaaggggtacg

SEQ ID NO: 385003 - DNA, 559 bp, Homo sapiens
  misc_feature: GZ8MTXP02HHO8K.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggaggcttggtccaggccggggggtccctgagactctcctgtgcagcctctggattcagttttagctagattttggatgagctgggtccgccaggccccaggggaaggggctggtgtgggtagccaacatacacgaagatggaggtgaagaaatactatggcgactctggtagaagggccgtattcaccgatcctaccgagggaccaaacgtccaaacaactaccagtatactactagacaaaagtgaaagtggtactaggagagccgaggacacggctgtagttatttcgtgtagcgagacggtacgacccccgtaagtcccaataacggaccctagtcgtctttaggacttagtggg

SEQ ID NO: 385004 - DNA, 607 bp, Homo sapiens
  misc_feature: GZ8MTXP02JBHZQ.25.71.G05.1.454.CMB.2.raw
  modified_base (230)..(230): a, c, t, g, unknown or other
  modified_base (238)..(238): a, c, t, g, unknown or other
  modified_base (245)..(245): a, c, t, g, unknown or other
  modified_base (253)..(253): a, c, t, g, unknown or other
  modified_base (257)..(257): a, c, t, g, unknown or other
  modified_base (259)..(259): a, c, t, g, unknown or other
  modified_base (262)..(262): a, c, t, g, unknown or other
  modified_base (286)..(286): a, c, t, g, unknown or other
  modified_base (291)..(291): a, c, t, g, unknown or other
  modified_base (306)..(306): a, c, t, g, unknown or other
  modified_base (331)..(331): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtctgggggagcctggtcaaggctggggtccaagctcncttgtgcnggcctgngatcactnaagnangcntgactggatcgcagctcggagtcngcagngattcatccattagnggtcttaagcgtagactaaattttncgacgagtacgtcggtacgaccgggtccgttacacctatcctacgagacgaaccaaccgccgtacgtacctttcttctttcgacgaactaaatacgacgacgtacgtacgacgacgacgacggacgtacgtacgttacgtttacgtttcgttcgtacggtacggtacggtagggtacggtacgggtaacggtaaacggtacggtacgtacggtacggtacggtcgtaacgttacgttacgtttacgttacgtttacggttacgggtacggtaacgg

SEQ ID NO: 385005 - DNA, 621 bp, Homo sapiens
  misc_feature: GZ8MTXP02FOE90.25.71.G05.1.454.CMB.2.raw
  modified_base (361)..(361): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtcgtgggggagcctggtcaagccgtggggggtcccaagactctcttgtgcagcctctggattcaacttcaaaggctacagcatgaactggactccgccaggcgtaccggggaaggtctgcagtggtatttcatccattagtggtactaagcgtagaactaaattttangacagtactcggtacgaccgggtccgttacaccgatcctacagacaaccgaacgccgacgtactttctctttcacgactaaaagtgaaacacgacctacgagaccgacggtacggaaccacggtccttagttttacttcgtggtacgtacggaagggagggtaaggttacggggaaacgtaaaaccggtggtaccgtacggtaacgggtaggtagaagttgttcgttttagtacgtttcggtacgggggacgtaaacggg

SEQ ID NO: 385006 - DNA, 646 bp, Homo sapiens
  misc_feature: GZ8MTXP02I6DTR.25.71.G05.1.454.CMB.2.raw
  modified_base (317)..(317): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtgggggaggcctggtcaagccgtggggggtcccgaagactctcttgtgcagcctctggattcaacttcaaaggctacagcatgaaactggactccgccgaggcgtaccggggaaggtcngcagtggtattcgatccattagtggttctaaagcgtagaactaaaattttgagacaagtacgtcgggtacgaaccggggtccggttacaaccctacgtcctaccgaagtaacgaaccaaaccgacccgtaacgtaacctttctactttctacgaactaaactacgaaacacgtacctacgaacgaacggaccgaaggaccgacggtacttaggtttacttcgtgttaggacggtaggaggtagggtacggaacgtaaaacgtcggacgtacgtaacgggaggtagtaagtgttctttaggtacgtttcggttacggggacgtaaacggg

SEQ ID NO: 385007 - DNA, 570 bp, Homo sapiens
  misc_feature: GZ8MTXP02I26UH.25.71.G05.1.454.CMB.2.raw
  modified_base (351)..(351): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctggggggtcccaagactctcttgtgcagcctctggattcaacttcaaaggctacagcatgaactggatccgcaggctccggggaaggtctgcagtggatttcatccattagtgtcttagcgtgactaaattttngcagactggtacgaacggccgttcaccatcctccagagaccaacgccgacgtacttactctttctgacaaatcgaacacgcctacagacgaccggagacgacggtcttgtttattctgtgcgagagggaggtagggacgtaaaacgtcggtacgtacgtacgggacggtagtagttgtcgttttgtacgtttcggtacggggtaccgtaaggggtaacg

SEQ ID NO: 385008 - DNA, 592 bp, Homo sapiens
  misc_feature: GZ8MTXP02HCVHO.25.71.G05.1.454.CMB.2.raw
  modified_base (472)..(472): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattgggctgagctgggttctccttgttgctattttagaagtgtccagtgtgaggtgcagttggaggagtcgtgggggaggcttggtccaggcccgggggggtccctggagacgtctcctgtgcagcctctggatttcagttttagcagtatttggatggagcgtcggtccgccgacggccccgaggggaacggggctgggtcggtgggtacgccaaacatacgacgaaagatagggagtgaacgaaatactatcggacgtactcgtggtagaaacggggcctaagttccgacctaattcccgtaccgacggaaccaactaccgaaacaactacagtaatactctaganaaatagtaagtagtgtagagacgacgacggacgaacggcgtgtgttagttgttcgtggagacgacgtacgacgacgtaacgtactaacgtacgtacgtacttagttacgttacgtagtag

SEQ ID NO: 385009 - DNA, 622 bp, Homo sapiens
  misc_feature: GZ8MTXP02FH9PE.25.71.G05.1.454.CMB.2.raw
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggtttccttgtcgctattttagaaggtgtccagtgtgaggtggtgctggtggagtcgtgggggaggcctggtcaagccgtggggggtcccaagactctcttgtgcagcctctggattcaacttcaaaggctacagcatgaactggatccgcaggcgtccggggaaggtctgcaggtggatttcatccattagtggtacttaagcgtagtaactaaatttatgcagtactcgggtagaacgggtccggtacacctatcctccagacgacaacgccgacgtactttctctttctgactaaatgaacacgcctacgagaacggacccggaagggaccgaaccgggtcttacggttttaactttcgtggttggacggtaagggaggggaggtacgggggaacgtaaaacgtcggacttacggtaacgggagggtgtagtgttcgtttttaggacgttttcggtacgggggtaccgtaaggggtaacg

SEQ ID NO: 385010 - DNA, 712 bp, Homo sapiens
  misc_feature: GZ8MTXP02G1QZA.25.71.G05.1.454.CMB.2.raw
  modified_base (374)..(374): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccaagactctcttgtgcagcctctggattcaacttcaaaggctacagcagtgaactggactccgccaggcgtaccggggaaggtctgctaggtggtatttcatcctagtttaggtgttacttaagcgtagtaactaaatttttagngtacaggtaccgttcggtacggaccggggtcccggttacaacccgtatcctaccgagacgaaccgaccgaccgtacgtactttctcgtttctacgactaaagtacgaaacacgacctacgaaacggacgaccggaacgggaaccgtaaccgggtcttttacggtttaacgtttccgtaggttaccggacggaaacgggtacggggtaagggttacgggggaaaccgtaaaacggtcgggtaacccgttaacgggttaaccggggtaggttacgtaagtttcgtttaaccgttttaggtaaccgttttcgggaccgggggtaaccgtttaaaacggggg

SEQ ID NO: 385011 - DNA, 573 bp, Homo sapiens
  misc_feature: GZ8MTXP02JXKVD.25.71.G05.1.454.CMB.2.raw
  modified_base (477)..(477): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggagcttgggtccaggccgggggggtcctgagactctcctgtgcagcctctggattcagttttagcagtatttggatgagctgggtccgcaggccccaggggaaggggctggtgtggggtagccaacatacacgaagagtgggaggtgagaaatactatgcggactctgtggaacgggccgattccaccatcctaccgagggacaactaccaaacaactcagtatatctgacaaatgaaatgggtctagacggagacccggaaggacgaaccgggtntaggttgttaagtttccgtggtagccgaggacggtcggacccccggaattcccaagtaaccgtaacccttatcggtcttttcgacttagtcggggg

SEQ ID NO: 385012 - DNA, 571 bp, Homo sapiens
  misc_feature: GZ8MTXP02HJ531.25.71.G05.1.454.CMB.2.raw
  modified_base (204)..(204): a, c, t, g, unknown or other
  modified_base (246)..(246): a, c, t, g, unknown or other
  modified_base (383)..(383): a, c, t, g, unknown or other
  modified_base (451)..(451): a, c, t, g, unknown or other
  modified_base (454)..(454): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgcttattttagaaggtgtcagtgtgaggtgcagttggaggagtgtggggagnttggtccaggccggggggtcctgagactctctgtgcagcctntggattcagtttagcagtatttggatgacgcgtggtccgccgacggccccgaggggaggggcgtggtgtgggtacgaccaaagataacgaacgaaagtagtggaaggtagaaagtaaaactaagtataggcgtactntggagaaacggccgtattacaccattccacgaggaactaaccaccaaactaatacaatataatctaanaanaaataagtagtagtgtagagagacgacgacgacgacgtgtagtagttgtcgtagagacgtacgtacgaccgtactactacgtaacgtactacgtacgtacgttacgtacgtagtcgg

SEQ ID NO: 385013 - DNA, 592 bp, Homo sapiens
  misc_feature: GZ8MTXP02JO4VW.25.71.G05.1.454.CMB.2.raw
  modified_base (249)..(249): a, c, t, g, unknown or other
  modified_base (355)..(355): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtcgtgggggaggcctggtcaagcctggggggtcccaagactctcttgtgcagcctntggattcaacttcaaaggctacagcatgaactggatccgcaggctccggggaaggtctgcagtgatttcatccattagtggtcttaagcgtagtactaaatttttngcagtacgtcggtagacgggtccgttacacctatctcagagaccgaaacgcccgacgtacttctctttctcgctaaatcgaacacgaccctcaagacggacccggaagggaccaacgggtcttaggtttaactttctgttggacgaaggaggtaggtcggggtacgaaaacgtgggacttacgaccgggtggagtaagttgtacttttggagttttcggacggggtacgtaaacggg

SEQ ID NO: 385014 - DNA, 566 bp, Homo sapiens
  misc_feature: GZ8MTXP02JWV67.25.71.G05.1.454.CMB.2.raw
  modified_base (356)..(356): a, c, t, g, unknown or other
  modified_base (437)..(437): a, c, t, g, unknown or other
  modified_base (452)..(452): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggtttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggatccgcaggctccggggaaggtctgcagtggatttcatccattagtggtcttaagcgtgactaaattttangacagactcgggtgaccgggtccgggttacacctatcctcccgaaagacgaaccaaccgccgaacgtacctttctctttcncgaccaaatgaaacngacctcagacgccgaggaccgacggtcttgtttattctgtgacgtaggaggtgtacgggacgaaacgtggctacgtacggagtgaatgtactttgatttcgaggggactaaggg

SEQ ID NO: 385015 - DNA, 643 bp, Homo sapiens
  misc_feature: GZ8MTXP02IY6EN.25.71.G05.1.454.CMB.2.raw
  modified_base (315)..(315): a, c, t, g, unknown or other
  modified_base (373)..(373): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtgggggagcctggtcaagccgtggggggtcccaagactctcttgtgcagcctctggattcaacttcaaaggctacagcatagaactggactccgccgaggcgtaccggggaaggtcngctagtggtattcactcctagttagtggttacttaaagcgtagtaacttaaatttttnagtcagtacgtcggtacgaccggggtcccgttacaccgtatcctacgagacgaacaccgaccgtaacgtctttcgttactttctacgaactaaagtacgaaacacgtcctacgagacgcgaacggacgacggtcttagtttactttcgtcggtcgtacggaaggacggtagggtacgggaaacgtaaacggtcggacgttaccggtaacggtaggtagtaagttgttacgttttaggtagtttaccggtacggggtaacggttaaacggg

SEQ ID NO: 385016 - DNA, 668 bp, Homo sapiens
  misc_feature: GZ8MTXP02JGPOX.25.71.G05.1.454.CMB.2.raw
  modified_base (642)..(642): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaggtgtccagtgtgaggtgcaggttggaggagtcgtgggggaggcttcggtccgagggcccggggggtccctggagactctcctgtgcacgcctcgtggtattctagttttagcagtattttggatggagcgtcgggtcccgccgacggcccccgaggggacggggtctggtggtgggtacgccgaaacagtaaccgacggaaagagtggaggtagaacgtaaatacgtatcggcggtacttcgtggtaggaaacggggcctattccgacctatccctaccgaagggaaccaaccgtaccaaataaacctcaagttactactcgtacgaactaaagtagtaaagttcggttacgtaggaagacggacccgaagggaccgacgggtcgttggttagtttagtttccgtggtggacggtacggtagtcccgtaccccggtaaaactcccgtaaagtaaccgtaaaccccttagtaccgtttntttaggtaacgtttaggtttcggggg

SEQ ID NO: 385017 - DNA, 660 bp, Homo sapiens
  misc_feature: GZ8MTXP02G6YDC.25.71.G05.1.454.CMB.2.raw
  modified_base (368)..(368): a, c, t, g, unknown or other
  modified_base (474)..(474): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggccgtggggggtcccaagactctcttgtgcagcctctggattcaacttcaaaggctacagcatagaactggactccgccaggcgtaccggggaaggtctgcaggtggtatttcatcctattaggtgtacttaagcgtagtaactaaattttnagcagtacgtcgggtacgaccgggtccgttacaaccgtctcctaccgaagaccgaacaaccgacccgtacgtactttcttctttactacgaactaaatacgaaacncgtaccctacgaaggaccggaccgaacgggaaccgtaccggtactttagtttacgtttcgtaggtcggtacggagggtagggtacgggtacggggaaacgtaaaaccggtggtaccgtaccggtaacgggaggtacgtaagtcggttacgttttagtacgtttacggtacggggtaccgtaaaggg

SEQ ID NO: 385018 - DNA, 736 bp, Homo sapiens
  misc_feature: GZ8MTXP02JZ7GO.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttggtccgaggccgggggggtccctgagactctccgtgtgcagcctctggtattctagttttagctagtattttggatgagtcgtgggtcccgccacggccccgaggggaggggcgtggtggtgggtagccaaacatacacgaagagtgggaggtagaagaaatacgtagtcggacggactcgtggtagggaacgggtaccgtattaccaacctagtcccgtacccgaacggggaaacccaaacccgttacccaaaactaaacccgtacgtaaagttaactaagtaccgttagaaactaaaagtacggtaaagttcgggttacgttagggaaacgggtaccggacccggggtaaacgggaccgtaaccgggtcgtttagggttagttttaaacgttttccgtagggttcgggtaccggtaacggggtacggtaccccggtaacccccggtaaacttaccccgaaacgttaacccggttaaccccttaagttccgtttacgtttttaggaccgtttaagggttccggggg

SEQ ID NO: 385019 - DNA, 643 bp, Homo sapiens
  misc_feature: GZ8MTXP02F8YAI.25.71.G05.1.454.CMB.2.raw
  modified_base (557)..(557): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagtcttggtccaggccggggggtcctgagactctcctgtgcagcctctggattctagtttagcagtgtttggatggagcgtcgggtccgccgaggcccccgaaggggaacggggtcgtggggtggttggggtaacgaccgaaaacgaacgtaacgaaccggaaaggagtaggggaaggtagaaacggtaaaatacgtagtacggcggtaacttcgtgggtaggaacggggaccgtaacttccgaactactcctaccgaagggaacctaaacctaccaaaacaactacgaagttatacttacagaactaaagtagaaagttcgggttacaggaagacgaccgaacggacgtacgngttatgtattcgtagtgacgacggtagtccgacccgtaaactccaagtaaccgtacctattcggtactttagaatttcgtcggggg

SEQ ID NO: 385020 - DNA, 675 bp, Homo sapiens
  misc_feature: GZ8MTXP02JKZIK.25.71.G05.1.454.CMB.2.raw
  modified_base (569)..(569): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtgggctccgctgggttttccttgtcgctattttagaaggtgtccagtgtgaggtggtgctggtggagtcgtggggaggcctggtcaagccgtgggggtcccgaagactctcttgtgcagcctctggattcaacttcaaaggctacagcatgaactggactccgccgaggccgtaccggggaaggtctgcgtaggtggtatttcacttccgtaagtttaggtcggttacttaaaggtccggttagtaaacttaaaatttttgtacgtacgtaaggtaccgttacggggtacgtaccggggtcccgggttaccaacccgtactccgtaccgaagaaccgaaccgaaccgacccgtacccgttactttccttctttctacgtaactaagtacgaacgacgtacctacgacgacgaccggaggacgtacgtcttagtttcttcgtgngtacgagaggtacggtaggaacgtaaacgtcggacgttaccggtaacgggtaggttagaacgttgtttacgtttaggtcgtttcggacggggtaccgttaaacggg

SEQ ID NO: 385021 - DNA, 659 bp, Homo sapiens
  misc_feature: GZ8MTXP02JUC7P.25.71.G05.1.454.CMB.2.raw
  modified_base (334)..(334): a, c, t, g, unknown or other
  modified_base (366)..(366): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttggtccaggccggggggtcctgagactctcctgtgcagcctctggattcagttttagcagtattttggatgagcgtgggccgccgacggccccgaggggaaggggcgtgggtgtggggtagccaanatacacgaagatggaggtagaagaaatactanggacggtactcgtggtaggaaacggggtcctaagttccaacctattcccgtacccgaagggtaacccaaacctacccaaacaactacctagtaacttactctagactaaaagtgaaagttcggtactaggaggaacgacccggaaggaacccggaacggggtcttaggttagtttaacgtttcgtggtacgggtacggaaggtacggttacccggaccccgtaaacgttacccaacgttaaccggtaaccccttaagtcgtttaccgttttacgaacgtttacggttcggggg

SEQ ID NO: 385022 - DNA, 588 bp, Homo sapiens
  misc_feature: GZ8MTXP02G0ILV.25.71.G05.1.454.CMB.2.raw
  modified_base (355)..(355): a, c, t, g, unknown or other
  modified_base (370)..(370): a, c, t, g, unknown or other
  modified_base (383)..(383): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctggggggtcccaagactctcttgtgcagcctctggattcaacttcaaaggctacagcatgaactggatccgcaggctccggggaaggtctggcagtggatttcatccattgtggtcttaagcgtagaactaaattttngacagactcgggtanaccgggtccgttnaccatctacagacgacaacgccgacgtactttctctttctagctaaaatcgaaacagcctacagacgccgaggacacggtcttgtttacttcgtagtgcgtagacggaggtacgggacgtaaaaccgtggtactaccggtaacgggaggttagaagttcggtacgtttttggaacgttttcggacgggggtacctaaaacggggg

SEQ ID NO: 385023 - DNA, 552 bp, Homo sapiens
  misc_feature: GZ8MTXP02FE3GB.25.71.G05.1.454.CMB.2.raw
  modified_base (478)..(478): a, c, t, g, unknown or other
tcagactgtacagtcacgaccggtgctcgatttagtgtcgtcgcaagagagaggagccttagccctggactccaaggcttttccacctggtgatcagcactgagcacagaggactcaccatggaattggggctgagctgggttctccttgttgctattttagaaggtgtccagtgtgaggtgcagttggaggagtcgtgggggaggcttgggtccaggccggggggtccctgagactctcctgtgcagcctctggatcagttttagcagtatttggatgagctgggtccgccaggccccgagggaaggggctggtgtgggtagccaacatacacgaaagatggaggtgagaaatactatggcgactctgtgaagggcgattcacatctcagggacaactcaaacaactcagtatatctagacaaaatcgaaatggtactgaggagcccgaggacacggctgtcgttatttcgtgtcgngtacggacgtcgacccccggtaatcccaagtaaccggtaccccttagtcgtctttttagaacttgttacggggg

SEQ ID NO: 385024 - DNA, 645 bp, Homo sapiens
  misc_feature: GZ8MTXP02I2UDO.25.71.G05.1.454.CMB.2.raw
  modified_base (351)..(351): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggagcctggtcaagcctgggggtcccaagactctcttgttcagcctctggattcaacttcaaaggctacagcatgaactggatccgcaggctccggggaaggtctgcagtggatttcatccattagtggtcttaagcgtagactaatttangcagctcggtgaacgggccggttcaccatcctccagacgacaaacgccgacgtactttactctttctagacctaaatcgaaacacgccctacgaacggagacccggaaggtacccgacgggtccctttaggtttactttcgtggttaggcggtaaggaagggtagggttacggggaaccggtaaaacgttcggggtaccttacggttaaccgggggtacggttacggtaagttaacggttccgtttttaggtaacgttttacggttcgggggtaccctaaaagggggtttaccg

SEQ ID NO: 385025 - DNA, 542 bp, Homo sapiens
  misc_feature: GZ8MTXP02GMWMU.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttggtccaggccgggggggtccctgagactctcctgtgcagcctctggattcagttttagcagtattttggatgagctgggtcccgccgaggccccgaggggaacggggctggtgtggggtagccaaacatacgacgaagagtggaggtgaagaaatactatgcgactcgtgtgaagggccattcaacatctccaggacaactaccaaacaactcagtatatctagactaaatgaaatggtctaggagacgaccgaaggacacggctgtgtattcgtgtgcgagcgtacgcccgaaatccaataacgaccctagtcgtactttgactagtcgggg

SEQ ID NO: 385026 - DNA, 624 bp, Homo sapiens
  misc_feature: GZ8MTXP02G0NER.25.71.G05.1.454.CMB.2.raw
  modified_base (358)..(358): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtcgtgggggaggcctggtcaagccgtggggggtcccaagactctcttgtgcagtctctggattcaacttcaaaggctacagcatgaactggatccgcaggctccggggaggtctgcagtggattcatccattagtggtcttaaagcgtagtaactaaattttagngtacagtacgttcggtacgaccggtccgttacacctactactacgagacgacaacgacccgtacgtacctttcttctttacgtacgactaaagtacgaacacgtacctacgaagacgacggagaccgacgtcgttacgtttattcgtggtcgacggaggagggtaggtagggaaacgtaaacggtcggtacgttaccggtaacggtaaggttagtaacgttcgtttacgttttcgtacgtttccgggacggggtaaccgtaaacgg

SEQ ID NO: 385027 - DNA, 622 bp, Homo sapiens
  misc_feature: GZ8MTXP02ICOVW.25.71.G05.1.454.CMB.2.raw
  modified_base (251)..(251): a, c, t, g, unknown or other
  modified_base (354)..(354): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggccgtgggggtcccaagactctcttgtgcagcctntggattcaacttcaaaggctacagcatgaactggactccgccaggccgtaccggggaggtctgcagtgatttcatccattagtgtactagcgtgactaatttngcagtcgtcggtacgaaccggtccggttcacctatcctcaagacgacaaccgcacgtacttctcttctgactaatacgaacacgcctacagacgaccggaggaccgtacgggtaccttaggttttactttcgttggttcggacggtaagggtagggtacgggttacgggaaccggtaaaacggtcgggtaccgtaccggttacgggacggttagtaagttgttacgttttaggttacgtttcggtacggggtacgtaacggggtaacg

SEQ ID NO: 385028 - DNA, 730 bp, Homo sapiens
  misc_feature: GZ8MTXP02FH91O.25.71.G05.1.454.CMB.2.raw
  modified_base (352)..(352): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtcgtggggggaggcctggtcaagccgtggggggtcccaagactctcttgtgcagcctcgtggattcaacttcaaaggctacagcatgaactggactccgccagggccgtccgggggaaggtctgcaggtggatttcatccattaggtgttacttaaggngtagtaactaaattttatgcagtacgtcggtagaccgggtccggttacaacctatcctaccgaaggaacgaaccaaaccggcccgtaaccgtaacttttccttacttttacacgtactaaaacttcggaaaacctcgtacccgttaccgaaaggaaccggcccgggaaacgggaaccggtaaccggggtacctttaggtttttaaacttttaccgttcgggttggtaccgggtaagggaaggggtacgggttacgggggaaaccgtaaaaaccggttcggggtacccgttaccgggtttaaacggggaggggttagtaagttcgggtttcctttttaggtacggtttttacggaccgggggttacgtaaaaccggggg

SEQ ID NO: 385029 - DNA, 583 bp, Homo sapiens
  misc_feature: GZ8MTXP02G8FZO.25.71.G05.1.454.CMB.2.raw
  modified_base (315)..(315): a, c, t, g, unknown or other
  modified_base (426)..(426): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttcctgtcgctattttagaaggtgtccagtgtgaggtggtgctggtggagtcgtggggggaggccgtggtcaagccgtggggggtcccaagactctcttgtgcagcctctggattcaaacttcaaaggctacagcatgaactggactccgaccaggcgtccggggaaggtcngcagtgatttcatccattagtgtacttaagcgtagaactaaatttatcgcagactcggtagaacgtccggttacacatctccagacacaacgccgacgtacttctcttacngacaaatacgaaacacgcctacacgagccgaaggacgacggtcttagtttacttgtagtcggacgagagggtaggtagggaaaccgaaaagtggtacgtaccgtaagggacggtagtacgtgttctttacgtagttcggtagggaccgaaaggtacg

SEQ ID NO: 385030 - DNA, 661 bp, Homo sapiens
  misc_feature: GZ8MTXP02JQ4CK.25.71.G05.1.454.CMB.2.raw
  modified_base (367)..(367): a, c, t, g, unknown or other
tcagactgtacagtcacgaccggtgctcgatttagtgtcgtcgcaagagagaggggccttagccctagattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtgggggtcccgaagactctcttgtgcagcctctggattcaacttcaaaggctacagcatgaactggatcccgccaggccgtaccggggaggtctgcagtggtatttcatccattagtggttactaagtcgtagtaactaattttacgngctagacgtcggtcgaacggtccgtacacctatcctccaggacgaccgacgcccgtaacgtacctttctcgtttctagtacctaaaatgaaaccacgacctacgagacggccggaaggaccaacgggtctttacgtttatttccgtgtcggtacggtaggagggtacgggtacgggggaaacgtaaaacggttcgggacccgttaggtaccgggggtaagggttcgaagttccgggttacgtttttacgggtagtttccggggtacgggggtaacccgtaagggggtttaaccc

SEQ ID NO: 385031 - DNA, 702 bp, Homo sapiens
  misc_feature: GZ8MTXP02FM6K8.25.71.G05.1.454.CMB.2.raw
  modified_base (274)..(274): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgtgcttattttagaaggtgtccagtgtgaggtgctagttggaggagtcggtgggggaggtcgttggtccgaggccggggggtcctgagtactctccgtgtgcagcctcgtggtattcaagttttncaggtatttggatgagtcgtggtccgcgtacggccccgaggggacgggctggtgtgggtacaccaaactagtaaccaggaaagtacgtaggggaaggtagaaagtaaaacgttacgtaagtggtaccggtacttcgtgggtacgaaacgggtccgtaacttccgaacctacgtcgtacccgaaggaaaccctaacgtaaccaaacgtaactacgaacgttatacgtcacgaactaaagtcgtaaagttcggtagtagaacgaaccggtaccgaacgggtaccgaaccggttgttaggtttacgttaactttcgtaagggtccggacgggttaaaccgaacggggtttccgaacccccggtaaatcccgttaaaacgtaaggtaaccccttaggttacgttaccgtttagaacgttcgggttacggggg

SEQ ID NO: 385032 - DNA, 655 bp, Homo sapiens
  misc_feature: GZ8MTXP02HWBMD.25.71.G05.1.454.CMB.2.raw
  modified_base (624)..(624): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggtttcctgtcgctattttagaaggtgtccagtgtgaggtggtgctggtggagtcgtgggggagcctgggtcaagccgtgggggtcccaaggactctcttgtgcagcctctggtattcaacttcaaaggctacagcatgaactggactccgcaggcgtaccggggaggtctggcaggtcggtattcgactcgtagttaggtggtacctaaggtcgtagaacttaaatttacgagtacaacgtacgtacggtacggaaccgggtcggtttacaccgtattaccgtaccgaagtacgacgaaaccgtccgacgtactttctacttttacacgaactaacgtacgaacacgtactacgaagtacgacgaacggtacgaacgtgttacgttattcgtacgtgaacgagtaacggtaggtacgggaaacgtaaacgtcggttaccgtacggtaacggtagtacgggtaatttacggtacgttttaaaggngtttacgggtacggggttaacccgtaagggg

SEQ ID NO: 385033 - DNA, 621 bp, Homo sapiens
  misc_feature: GZ8MTXP02GF1RT.25.71.G05.1.454.CMB.2.raw
  modified_base (448)..(448): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtgggctccgctgggtttcctgtcgctattttagaaggtgtccagtgtgaggtggtgctgggtggagtcgtgggggagccgtggtcaagccgtgggggtcccgaagactctcttgtgcagcctctggattcaacttcaaaggctacagcatgaactggactccgccaggcgtaccggggaaggtctgcaggtgatttcatccattagtggttacttaagcgtagaactaaattttagtgacagtacgtacggtagaccggggtccggttacaacctactcctaccgaagacgaaccaaccgacccgacgtactttctctttcncgtacaaactagaaacacgacctacgagacgaccgacggaccgacggtacttagtttacttcgtagtgacgaggaggtaggtacgggaacgtaaaacgtcggtacgtacggtacgggtaggtagtaagttgttcgttttagtacgttttacggacggggtaccgtaaacgggg

SEQ ID NO: 385034 - DNA, 553 bp, Homo sapiens
  misc_feature: GZ8MTXP02JLW9A.25.71.G05.1.454.CMB.2.raw
  modified_base (473)..(473): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctgggggtcccgaagactctcttgtgcagcctctggattcaacttcaaaggctacagcatgaactggatccgccaggctccggggaaggtctgcagtggatttcgatccattagtggtcttaagcgtgactaatttatgacagactcggtgacggtccgttacaccatcctccagcgaacacgccgacgactttctcttactagaaaactgaacagccctagacgacgcgagacgacggactgtttaattctgtggngagagaggtacggacgaaacgtcgtacgtacgtacggagtgtagtgtcgtttagtacgttcggtacggtacgtaggtacg

SEQ ID NO: 385035 - DNA, 569 bp, Homo sapiens
  misc_feature: GZ8MTXP02F13PV.25.71.G05.1.454.CMB.2.raw
  modified_base (306)..(306): a, c, t, g, unknown or other
  modified_base (316)..(316): a, c, t, g, unknown or other
  modified_base (325)..(325): a, c, t, g, unknown or other
  modified_base (351)..(351): a, c, t, g, unknown or other
  modified_base (353)..(353): a, c, t, g, unknown or other
  modified_base (423)..(423): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctcgctgggttttcctgtcgctattttagaaggtgtccagtgtgaggtggtgctgggtggagtcgtgggggaggcctggtcaaggccgtggggggtcccaagactctcttgtgcagcctctggattcaacttcaaaggctacagcatgaactggatccgcaggctcgggaggtcngcagtgattnatcattagnggtacttaagcgtagactaaattttngnagtactcggtagacggccgttacaccatcctaccagtacgacgaaccgcccgtacgactttactctttcngtacaaatgaacacgcctcgaagcgaccgaggaccgacggccttagtttattcgtagtgacgagaggaggtagggacaaaacgtggactcgtaacggaggtagaagttgtcgttttaggagtttcggtacggggtacctaaagggg

SEQ ID NO: 385036 - DNA, 624 bp, Homo sapiens
  misc_feature: GZ8MTXP02IGRTO.25.71.G05.1.454.CMB.2.raw
  modified_base (497)..(497): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtgggggaggcctggtcaagccgtggggggtcccaagactctcttgtgcagcctcgtggattcaacttcaaaggctaacagcatgaactggactccgcaggccgccggggaaggtctgcagtggtatttcatccagtttagtggtacttaagcgtagtaactaaatttttagacgctagacgttcgggtacgaccggggtccgttacaacctatcctacagtacgacaacgccgacgtactttcttacttctacgacaaatcgaaacacgcctacgagacggacgacggacgaccggttntttacgtttatttcgtgtacggacggaagggtacggtacgggtacgggaaacgtaacgtcggtacgtacggtacgggtgtagtaagttcgttacgtttacgtacgtttacgggacggtaacgtaagg

SEQ ID NO: 385037 - DNA, 562 bp, Homo sapiens
  misc_feature: GZ8MTXP02JLUGG.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggaggcttggtccaggccggggggtccctgagactctcctgtgcagcctctggattcagttttagcagtattttggatgagctgggtccgccacggccccgaggggaaggggctgggtgtgggtagccaacatacacgaagagtggaggtgaagaaatactatgcggactcgtggtagaaggggccgattccaccatcctaccgagggaccaactcccaaacaacctcagtatactctagacaaaagtgaaagtggtctaggagacggccgaggaccgacggctgtgtatttcgtggtgcgagacggtcgacccccggaatcccgaagtaacgacccttagtcgtctttgacttagtcgggg

SEQ ID NO: 385038 - DNA, 531 bp, Homo sapiens
  misc_feature: GZ8MTXP02GY76O.25.71.G05.1.454.CMB.2.raw
  modified_base (292)..(292): a, c, t, g, unknown or other
  modified_base (330)..(330): a, c, t, g, unknown or other
  modified_base (363)..(363): a, c, t, g, unknown or other
  modified_base (404)..(404): a, c, t, g, unknown or other
  modified_base (411)..(411): a, c, t, g, unknown or other
  modified_base (445)..(445): a, c, t, g, unknown or other
  modified_base (495)..(495): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttggtccgaggccggggggtccctgagactctcctgtgcagcctcgtggattcagttttagcagtatttggatgagctgggtccnccaggccccagggaacggggctggtgtgggtagccaanatacacgagatggagtgagaatcatgcggatcnggtgaaggcgtattcacgtatccgtcaggacaactccaaanaaacctnaacgtatacgtacagacaaaatgaaatggttacngagagaccgaggacgagctagtgtacttctgtgacgagagtcgaccgtanccataacgcccttaagtctctttacgacttagtggg

SEQ ID NO: 385039 - DNA, 616 bp, Homo sapiens
  misc_feature: GZ8MTXP02IFRKY.25.71.G05.1.454.CMB.2.raw
  modified_base (363)..(363): a, c, t, g, unknown or other
  modified_base (451)..(451): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccaagactctcttgtgcagcctctggattcaacttcaaaggctacagcatgaactggactcccgccaggcgtcccggggaaggtctgcaggtggatttcatccagttagtgtacttaagcgtagtactaatttangcagtacgtcggtagaccgggtccggttcaccactcctacgagacacgacgcccgtacgtactttctcttctcgactaatacgaaacncgtacctacgaacgacggccgaacggacgaccggtcttagtttactttcgtggttcgagacggagggtacggtaggggaaccgtaaacggtcggtcgtacgtaccgggtaggtgaagttcgttacgttttggtacgttttcggtacgggggtaccgtaaacgggg

SEQ ID NO: 385040 - DNA, 731 bp, Homo sapiens
  misc_feature: GZ8MTXP02HDSWQ.25.71.G05.1.454.CMB.2.raw
  modified_base (382)..(382): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtgggggaggccgtggtcaagccgtggggggtcccaagactctcttgtgcagcctctggattcaacttcaaaggctaacagcatgaactggactccgccgaggccgtaccgggggaaggtctgcgtagtggtactttcatcctagttagtggtaccttaagccgtagtaacttaaaagtttttancgactaacgtacgtacgggttacgaccggggtcccgttaccaacccgtatccctaccgaaggacgaaccgaacccggcccgtaacgttacctttacttcctttacgtacggtaactaaacgttacggaaaactaccggaccctacggaacggaaccgggtacccggaacgggaacgttacccggggtactttaacggttttaccgttttcggtagggtacggtacggtaaggggacgggtaacggggttacggggaaccggttaaaaccgtgggaccgttaccgggtaacggtagggtacgtaagttcgttccgttttaggacgtttcggtacggggtaacgtaacggg

SEQ ID NO: 385041 - DNA, 678 bp, Homo sapiens
  misc_feature: GZ8MTXP02HJAAU.25.71.G05.1.454.CMB.2.raw
  modified_base (371)..(371): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggccgtggtcaaggccgtgggggggtccccaagactctcttgtgcagcctctggattcaacttcaaaaggctacagcatgaactggactccgccaggctccggggaagggtctggcagtggatttcatccattaggtggtacttaaagcgtagaactaaatttttangcagtacgtcgggtggaccgggccgggtttcaacccgatccgtacgagaacgaaccgacgccgtaacgtactttccttctttacgacgaactaaacgtcgtaaacgacgtaccctacgaacggacgggacccggtaacggaccggtaccggttacgtttagttttacgttccgttagggtacggacgggaagggtaggggacgggtacggggaaaccggttaaacgtcgggtaccgttacgggtaccgggtaggttaggcgttgttcggttttagtacggtttcgggtaccggggtacggtaaaggg

SEQ ID NO: 385042 - DNA, 565 bp, Homo sapiens
  misc_feature: GZ8MTXP02J0LJN.25.71.G05.1.454.CMB.2.raw
  modified_base (330)..(330): a, c, t, g, unknown or other
  modified_base (335)..(335): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgcttattttagaaggtgtccagtgtgaggtgcagttggaggagtcgtgggggaggcttgggtccgagggccggggggtccctgagactctcctgtgcagcctctggtattctagttttagcagtattttggatgagctgggtccgccaggccccgaggggaggggctggtgtgggtanccaanatacagagatggaggtgaagaaatactagtgcggacttcgtggtgaaacggggccgattccaaccatccctaccgaagggaccaaaccgtaccaaacaactacagtaatactactagactaaagtgaaatggtactagaagacgacgaggaccgacggcttagtgttattcgtggtggtcgagtagtccgcccgaatccaatcgaccctagtcgtctttgactagtcggg

SEQ ID NO: 385043 - DNA, 813 bp, Homo sapiens
  misc_feature: GZ8MTXP02HKFFS.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcaggttggaggagtcgtgggggagtcttgggtccgagggcccgggggggtccctggagcctctcctgtgcagcctcgtggtattcgtagttttagctagtatttggatggagcgtcgggtccgccgacgggccccgaaggggacggggtcgtggggtggtaggggtacgaccgaaacgtacgtaacgaacggaaaggtaggtagggaacgggtagaacgtaaagtacgtaagtcggacggtacttcgtggggtacggaaacggggtccgtacttacccgacctacgtaccctaaccgggaacgggtaaacccctaaacccgttaaccccaaaactaacccgttactaaacgttaacttaacttaccgaggtaaacctaaaaaggttggtaaaacgttggggtaacgttagggaacgggtaaccgggacccgggtaacgggaaccgggtaacccgggttcgtttaacgggtttagtttaaacccgtttttcggtagggtacccgggtaggtaaccgggttacggtacccccggtaacccccgggtaaattaccccggttaaacgtaacccggttaccccttaaggtttccgtttaccggtttttaacggaagtttaccgggggtttcggggg

SEQ ID NO: 385044 - DNA, 608 bp, Homo sapiens
  misc_feature: GZ8MTXP02IQBPS.25.71.G05.1.454.CMB.2.raw
  modified_base (366)..(366): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgttggtggagtcgtgggggaggcctggtcaaggccgtggggggtccccaagactctcttgtgcagcctctggattcaacttcaaaggctacagcatgaactggatccgcaggcgtccggggaaggtctgcgagtggtatttcatcctattagtggttacttaagcgtagaactaaattttangcagtacgtcggtacgaacggtccggttacaccgtactcctaccgagacgacaccgccgaacgtactttctctttctagacctaaatcgaaacacgcctacgagacgaccggaggacgacgggtcttagtttacttcgtggtcgcgaaggaggaggtacgggaacgaaacgtcggtactacggtacggacggtgtagtcgttcgtttaggtacgtttcggtacggggtaccgtaaagggtcg

SEQ ID NO: 385045 - DNA, 598 bp, Homo sapiens
  misc_feature: GZ8MTXP02JTZ2V.25.71.G05.1.454.CMB.2.raw
  modified_base (315)..(315): a, c, t, g, unknown or other
  modified_base (359)..(359): a, c, t, g, unknown or other
  modified_base (429)..(429): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctcagctgggttttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggactccgccgaggcgtcccggggaaggtcngcagtggattcatccattagtggtctaagcgtagactaaatttngctagacgtcggagaccgggtccgttacaccatctaccgagacgacaacgccgacgtactttctctttcncgacaaatcgaacacgtacctacgacgacgaccgacggacgacggtcttagtttacttcgtgtagcgaggaggtaggtacggggaacgtaaaacgtgggtactacggtacgggaggtagaacgttgttacgttttaggtacgtttcggtacgggggtaacctaacgggg

SEQ ID NO: 385046 - DNA, 583 bp, Homo sapiens
  misc_feature: GZ8MTXP02GXWRG.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccaggccgggggggtccctgagactctcctgtgcagcctctggattcagttttagcagtattttggatgagctgggtccgccacggccccgaggggaggggcgtgggtggtgggtagccgaacatacaacggaagagtgggaggtagaagaaatactagtggcgactcgtgtagaaggggccgattccaacatcctaccgaagggacaaacctaccaaacaactacagtaactatactgacaaatgtaaactggtactaggagacgaccgagggacacggcgttcgtaggttattcgtgtacgcggaagtaggtccgacccgacgtccgagtaacgcccttaagtcgtcttttacgacgttattcggggg

SEQ ID NO: 385047 - DNA, 762 bp, Homo sapiens
  misc_feature: GZ8MTXP02FNF70.25.71.G05.1.454.CMB.2.raw
  modified_base (395)..(395): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctgggtggagtcgtgggggaggccgtggtcaaggccgtggggggtcccgaagacctctcttgtgcagcctctggattcaacttacaaaggtctacagcatagaaacgtggactccgaccgaggccgtaccgggggaggtctgcgaggtggtactttcgactcctaagtttaggtggttacgttaaaggcgtagtaaacttaaatttttagngactaagtaccgtcggtacggaccgggtccggttacaacctactccgtaccaaggtacgaaaccgaaccgcccgtaacgttaacctttcttaccttttacgacgtactaaatcgaaacgacgtacccacgacgaacggaccggaacggaaccgtaccgggttacctttagtttttacgttacgtttacggttacggtaacgggaaggggtaacgggtaaacggggtacgggggtaaaaccgtaaaacgggttcgggtaccggtttaaccgggtaaaccgggggtcgggttacggttaagttcgggttttacccgttttagggttacggtttttaccgggaacgggggtaacccggtttaaacggggg

SEQ ID NO: 385048 - DNA, 672 bp, Homo sapiens
  misc_feature: GZ8MTXP02JKCIV.25.71.G05.1.454.CMB.2.raw
  modified_base (388)..(388): a, c, t, g, unknown or other
  modified_base (557)..(557): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccaagactctcttgtgcagcctcgtggattcaacttcaaaggctacagcatgaactggactccgaccaggccgtaccgggggaaggtctggacaggtggtactttcgattccctaagtttacggtggttctttaaagccgttagaacttaaaagtttttnagactaggtaccgtcgggtacggaaccggggtcccgttacaacccgtatcctaccgaagacgaaccaccgacccgtacgtacctttcgttcctttctacgtactaaatcgaaactacgaccctcaaggaccgaccggacggacgtaaccggtctttagtttactttcgngttgacggaggtagggtaagggtacggggaaaccgtaaaaggtcgggtacttaccggtacgggtaggtgtaagtgttacgttttaggactttcggacgggggtacctaaacgggg

SEQ ID NO: 385049 - DNA, 617 bp, Homo sapiens
  misc_feature: GZ8MTXP02HTHLO.25.71.G05.1.454.CMB.2.raw
  modified_base (378)..(378): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtgggggaggcctggtcaagccgtgggggtcccaagactctcttgtgcagcctctggtattcaacttcaaaaggctaacagcaatagaactggactccgcgaggcgtaccggggaaggtctggcaggtggtatttcataccgtagtttagtggtacttaaaggcgtagtaataaaattttngacagtacgttcggtagaccgggtccgttaacacctaattccaccgaaagacgaaccaacggaccgtaacgtactttctactttctagactaaagtagaacacgacctcaagacgacgagacgagtcgtagtttattcgtgtaggagaggaggtacggtaggaacgaaacgtcggtacgtacgtacggtaggtagtaacgttgttacgttagtacgtttacggtacgggtacgtaacgg

SEQ ID NO: 385050 - DNA, 593 bp, Homo sapiens
  misc_feature: GZ8MTXP02H84EU.25.71.G05.1.454.CMB.2.raw
  modified_base (360)..(360): a, c, t, g, unknown or other
  modified_base (410)..(410): a, c, t, g, unknown or other
  modified_base (461)..(461): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtggggggaggcctgggtcaaggccgtggggggtcccgaagactctcttgtgcagcctcgtggattcaacttcaaaggctacagcatgaactggatccgcaggctccggggaaggtctgcaggtggattcgatctattagtgtctaagcgtagactaaatttntgacagactcggtcggaccggtccgggttacaccgtaactcctaccgaanacaaccgaacgaccgtacgtactttctcctttctcgactaaatacgaacancctacagacgacgaggacacgtcgttagtttattcgtgtcgacgtaggaggtaggaggtacgaaaacgtcggacgtacgtacgggtagtgtaagtgtacgtttgtacgtttcggacgggttaccgaaagggg

SEQ ID NO: 385051 - DNA, 621 bp, Homo sapiens
  misc_feature: GZ8MTXP02I0PQJ.25.71.G05.1.454.CMB.2.raw
  modified_base (468)..(468): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctatttagaaggtgtccagtgtgaggtgcagttggaggagtcgtggggggaggcttgggtccaggcccgggggggtcctgagactctcctgtgcagcctcgtggattcagttttagcagtattttggatgagcgtggggtccgccgacggccccgaaggggacggggtctggggtggtggggtagccaacatacacgaagatgggaggtgaagtaaatactagtcgcggacttctggtaggaaggggcctattccacatctaccgaggaccaactaccaaacactacagtatatctagactaaatgaaatcggtntagaggacgaccggaggacgacggtactgttagtatttcgtaggtcgacggacggtacgttacccggaccccgtaaactcccgtaaagtaaccggtaacccctttaagttaccggttcctttttaacggtaacgtttaacggtttacgggggg

SEQ ID NO: 385052 - DNA, 593 bp, Homo sapiens
  misc_feature: GZ8MTXP02HJJUV.25.71.G05.1.454.CMB.2.raw
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctggggggtcccaagactctcttgtgcagcctctggattcaacttcaaaggctacagcatgaactggatccgccaggctcgggaaggtctgcagtgattcatcatgtgtcttaagcgtgactaaatttatgctagacttggcgaacggtccggttcacctatcctaccagacgacaaccgcgaccgtactttctacttctagacaatcgaacagccctacgagacgcccggaggaccgacggtcttagtttattcgttgcggcgaggacggagggtacggggacgtaaaacgttcggacgtacgtaacgggggtagtagtaacgttcggttacgttttaggtaccgtttggtacggggtacccggaaggggtaaccg

SEQ ID NO: 385053 - DNA, 598 bp, Homo sapiens
  misc_feature: GZ8MTXP02I8AFC.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgtgctattttagagtgtccagtgtgaggtgcaggttggaggagtcgtgggggagcttgggtccagggccggggggtccctgagactctcctgtgcagcctctggtattctagttttagctagtattttggatgagcgtcgggtccgccgacggccccgaggggaggggtctgggtggtggacgcaacatacgacgaaagagtaggaggtagaagtaaatactagtggacggtactcgtggtacggaacggggccgtactccaacgtactccgtaccgacgggacaacctaccaaacactacagtatactctagacaaacgtgaaattcggtatagacggacgacggacgacgacggtctgttagtacttgtcgtcgacgacgtacgtaccgacccgtacgtactaagtaaccgtaccttacgtcgttactttagacttagttacggggg

SEQ ID NO: 385054 - DNA, 686 bp, Homo sapiens
  misc_feature: GZ8MTXP02H5G89.25.71.G05.1.454.CMB.2.raw
  modified_base (298)..(298): a, c, t, g, unknown or other
  modified_base (327)..(327): a, c, t, g, unknown or other
  modified_base (345)..(345): a, c, t, g, unknown or other
  modified_base (548)..(548): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaggtgtccagtgtgaggtgcagttggaggagtcgtgggggaggtcttggtccgaggccgggggggtcctggagactctcctgtgcagcctcgtggtattctagttttagctagtatttggatgagtcgtgggtccnccgacggccccgaggggaggggcttgggnggtggggtacaccgaaanatacgaacgaagagtgggaggtagaagaaatacgtaagtcggacggacttcgtggtagggaacgggtcccgtattcccgaactactccctaccgaaggaacctaacctacccaaaacaacctacgtaataactactacctagaactaaagtagtaaagtaggttcgtaaggaacggacggaccggaacggaccgtaacgggtnttacgggttagtttacgtttcgtggtacggtaccgggtaagtaacggttcccggaaccccgtaaactccgtaaacgtaaccggtaccccttaagttaccgggtttacttttacggtacgtttaaacgggttcgggggg

SEQ ID NO: 385055 - DNA, 794 bp, Homo sapiens
  misc_feature: GZ8MTXP02JRD2G.25.71.G05.1.454.CMB.2.raw
  modified_base (255)..(255): a, c, t, g, unknown or other
  modified_base (264)..(264): a, c, t, g, unknown or other
  modified_base (280)..(280): a, c, t, g, unknown or other
  modified_base (774)..(774): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgctagttggaggagtcgtggggggaggcttgggtccagggcccgggggggtccctggacgactctcctgtcgcngcctgtggnttctagtttagcagtntttggatgagcgtcgggccacgacggcccgaaggggacggggctggggtggtagggacgaccgaaacgagtaaccgacggaaaggtagtaggggaacgggtagaaaggtaaaattacgtagtcggacggtacgttcgtggggtaacgggaaacgggggtcccttaagttacccgtaaacccgtacgttccccgttaaacccgggaaacgggggttaaacccaaacccgtaaccccgtaaaaccctaaacccgttactaaacggtaactttaaactcccgttaaagaaccgttaaaagtgttaaagtcgggtttacgagggacgggaacggtaccgggaacgggaaacgtaccggggttcgttacgggttagtttacgttttccggtacggttcggaccgggttaacggtaccgggttaaccccggaccccgtaaacgttaccctaacggttaacccgaaccccgtttaggttcccgtttacgttttaaacggtntaccgggggtttaacggggg

SEQ ID NO: 385056 - DNA, 728 bp, Homo sapiens
  misc_feature: GZ8MTXP02HL60I.25.71.G05.1.454.CMB.2.raw
tcagactgtacagtcacgaccggtgctcgatttagtgtcgtcgcaagagagaggggccttagccctggattccaaggccttttccacttggtgatcagcactgagcaccgaggattcaccatggaagtggggctccgctgggttttccttgtcgctattttagaaggtgtccagtgtgaggtggtgctggtggagtcgtggggaggcctggtcaagccgtgggggtcccaagactctcgttgtgcagcctctggattcaacttcgaaaggctacagcatacgaactggactcccgacgaggccgtacggggaaggtctggctaggtggtattcactcctagtttaggtggtacttaggccgttagaactttaaaatttcgacgacgagtacgttcggggtacggaaacccgggtcccggttaaccaacctacgttccccgtaccgaaggaaaccgaacccgaaacccgtacccgtaaccgtttaaccttttcccttacttttcccgtaggtaacctaaaacgttacgaaaacctccgtacccctaagaacggacccggaccggaacgggaacccgtacgggttacgtttagtttttaaccgtccgttagggtacgacggttaaggaggggtacggtacgggaaaacggtaaacgtcggtacgtacggtacggacggttagtagttccgtttagtttagacgtttcggacgggaccggtaaggttaccg

SEQ ID NO: 385057 - DNA, 693 bp, Homo sapiens
  misc_feature: GZ8MTXP02ILZIW.25.71.G05.1.454.CMB.2.raw
  modified_base (364)..(364): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgtgcagcctctggattcaacttcaaaggctacagcatgaactggatccgccaggctccggggaaggtctggcaggtggatttcatccaattggtggtcttaaagcgtagaactaaatttttngacagtacgtcgggtagtaccggggccgtttaccaacctatcctaccgaggacgaaccgtaacggcccgtaacgtaaccttttcttactttacctcgtaacctaaaagtacgaaacctacgcccgtacaaaggacgacccggaaggaccgtaaccgggtcctttaggttttaactttccgtgggttcgtcggtaaacggaggggtaacgggttacggggaaacggtaaaaacccggttggggtacccgttaccggtaaacggggtgggtaacgaaggttcgttcgtttttacggaagttttcggggtaccgggggtaccgtaaaacggg

SEQ ID NO: 385058 - DNA, 672 bp, Homo sapiens
  misc_feature: GZ8MTXP02IXO31.25.71.G05.1.454.CMB.2.raw
  modified_base (378)..(378): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctgggtggagtcgtgggggaggcctggtcaagccgtggggggtcccgaagactctcttgtgcagcctctggattcaacttcaaaggctaacagcatgaaactggactcccgaccgaggccgtaccggggaggtctggacaggtggtatttcatcctagtttagtggtacttaagcgtagtaactaaattttangacagtactcggtagaccgggtcccgttacacctatacctaccgaaggacaacccgaaccgtacccggaaccgttaactttccttacctttactccgtaactaaaacgtcggaaacacggtaccctacgaacggaacggtccggaacggaaccgtacggttacctttagtttacgtttacgtgttcgggtacgaagggagggtaggtacggggaaccgtaaaagtcggtacctacgtaacggggagtagaacgttgttcgtttagtacgtttacggcgggtaaccgtaacgggg

SEQ ID NO: 385059 - DNA, 585 bp, Homo sapiens
  misc_feature: GZ8MTXP02FSGCA.25.71.G05.1.454.CMB.2.raw
  modified_base (249)..(249): a, c, t, g, unknown or other
  modified_base (264)..(264): a, c, t, g, unknown or other
  modified_base (325)..(325): a, c, t, g, unknown or other
  modified_base (336)..(336): a, c, t, g, unknown or other
  modified_base (407)..(407): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttggtccaggccggggggtcctgagactctcctgtgcagcctntggattctagttttncagtatttggatggagctgggtccgccaggccccgagggaggggctggtgtggtagccaanatacacgaagntaggaggtgagaaatctaatggacggactctggagaaggccgaattcacatctacgaggacaactaccaanaactcagtatatcagacaaaatgaaattggtactaggaacgacgcccggaaggtacccgaaggtctggtagttacttcgtggttacggaccgaggtacggtaccggacccccgtaaatcccgtaaagtaaccgtaccctaagttaccggtttacgtttacggtacgttacggtcgggg

SEQ ID NO: 385060 - DNA, 564 bp, Homo sapiens
  misc_feature: GZ8MTXP02GPAVA.25.71.G05.1.454.CMB.2.raw
  modified_base (352)..(352): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccaagactctcttgtgcagcctctggattcaacttcaaaggctacagcatgaactggatccgcaggctccggggaaggtctgcagtggatttcatcattagtgtcttaagcgtagactaatttngctagactcggagacggccgttcacatcctccagacgacaacgcgacgtacttactctttctcgacaaatcgaacacgcctacgagacgaccggaggacgacgggtcctagtttacttcgtgtcgacgaggacgggaggtcgggacgaaacgtggacgtcgtacggaggtgagtgtagtttagtacgtttcggtacgggaccgaagggtacg

SEQ ID NO: 385061 - DNA, 620 bp, Homo sapiens
  misc_feature: GZ8MTXP02GGT95.25.71.G05.1.454.CMB.2.raw
  modified_base (372)..(372): a, c, t, g, unknown or other
  modified_base (450)..(450): a, c, t, g, unknown or other
  modified_base (457)..(457): a, c, t, g, unknown or other
  modified_base (464)..(464): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggtttccttgtcgctattttagaaggtgtccagtgtgaggtggtgctgggtggagtcgtggggggaggcctggtcaagccgtggggggtcccgaagactctcttgtgcagcctctggattcaacttcaaaggctacagcatgaactggactccgccaggccgtaccggggaagggtctggcaggtggtatttcatcctattagtggttacttaagcgtagaactaaattttangacagactcgggtagaccgggtccggtacaccgtatcctaccaagacgaacaaccgacccgacgtactttcttcttcngacaaantaacacncctacagacgccgagacgacgtcttgtttacttacgtgtgacggtaggagggtaggtacggggaacgaaaacggtcggtacgtacggtaacggggtaggtggtaacgttggttacgttttaggtacgtttcggtacgggggtaaccgtaaacgggg

SEQ ID NO: 385062 - DNA, 636 bp, Homo sapiens
  misc_feature: GZ8MTXP02JNG2A.25.71.G05.1.454.CMB.2.raw
  modified_base (353)..(353): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggagcctggtcaagccgtggggggtccccaagactctcttgtgcagcctcgtggattcaacttcaaaggctacagcatgaactggatccgcaggcgtccggggaggtctgcagtgattcatccattagtgtctaagcgtagactaaatttangtcagtactcggtagaccggtccggttacaccgtatctccgaagacgaccaaacgcccgtacgtacctttcttaccgtttcacggactaaaacgttcgaaaccacggtaccctacgaaggacgacccggaggaaccgacgggtctttagtttaactttccgtggtacgacggtaggagggtaggacgggaacgaaaacgtcggtacgttacggtaacggggtagtacggtaagttacggttccgttttaggtacgtttcgggtaacggggtactaaacggggg

SEQ ID NO: 385063 - DNA, 648 bp, Homo sapiens
  misc_feature: GZ8MTXP02JX9TB.25.71.G05.1.454.CMB.2.raw
  modified_base (358)..(358): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtctgggggaggcctggtcaagccgtggggggtcccaagactctcttgtgcagcctctggattcaacttcaaaggctacagcatgaactggatccgccaggctccggggaggtctgcagtggatttcatccattagtggtacttaaagcgtagaactaaattttangtcagactcggtgacggccgttacacctatctccagacgacaacgccgacgtactttctctttctacgactaaactgaaacctacgaccctacgaacggacggacccggaagggaccgtaccggggtacctttaggttttaactttccgttggttcggacggtaaacgggaaggggtaaccggtagggggaacgaaaaaccggttcggaccgttacgtaaccgggtaggtacggtaagttcggttacgttttcggtaattttcggtacgggggtacccgtaaaacggggg

SEQ ID NO: 385064 - DNA, 616 bp, Homo sapiens
  misc_feature: GZ8MTXP02H0ZV8.25.71.G05.1.454.CMB.2.raw
  modified_base (356)..(356): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggagcctggtcaagccgtggggggtcccaagactctcttgtgcagcctctggattcaacttcaaaggctacagcatgaactggactccgccaggccgtccggggaaggtctgcaggtggattcatcattgtgtctaagcgtagaactaaattttngcagtactcgggtacgaccgggtccggttacaccgactcctccagacgaccaacgcccgacgtactttctctttctacgacaaactcgacacgcctacgacgacgccgaaggacgacggtcctttagtttactttcgtggttcggaggaggaaggtagggtacggggtaacggaaaacgtcggacgttaccgtaacgggtagtaggtaagtcgtttaacgtttcggtagttttaccggtacgggggtaccgtaaacgggg

SEQ ID NO: 385065 - DNA, 744 bp, Homo sapiens
  misc_feature: GZ8MTXP02GW2DI.25.71.G05.1.454.CMB.2.raw
  modified_base (341)..(341): a, c, t, g, unknown or other
  modified_base (389)..(389): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcaggttggaggagtcgtgggggaggcgttggtccgagggcccggggggggtccctggacgactctccgtggtgcacgcctcgtggtattcgtagttttagctagtattttggatgagtcgtcggccgcacggcccgaggggagggtctggtgtgggtanccaaatagtacgaacgaagagtagggaggtagaagtaaatacgttaancgggacggtaaccttgtggggtaacggtaaacgggggtacccgttatttaccccgaaccgttaacgttacccgtaacccgaaacggggtaaaacccctaaacccggttaaccccaaaaaccttaaacccttacgtaaacggttaattaactaccgtaagaacgttaaaaataggtaaacgttaggttacgttaggaacgggtacgacccgggaacggtaaccgacggtacgttggttagtttaacgtttgtacggtcgggtaacggtacggtacggtacccgtaccccggtaaacttaccgtaataacccgtaccgttaacgttgttaccgtttagtaacgttggtttacggggg

SEQ ID NO: 385066 - DNA, 663 bp, Homo sapiens
  misc_feature: GZ8MTXP02GJDIU.25.71.G05.1.454.CMB.2.raw
  modified_base (296)..(296): a, c, t, g, unknown or other
  modified_base (338)..(338): a, c, t, g, unknown or other
  modified_base (577)..(577): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttggtccagccgaggggggtccctgagactctcctgtgcagcctctggattctagttttagctagtattttggatgagcgtcgggtccnccgacggccccgaggggagggctgggtggtgggtacgccaanatacgaacgaagagtgggaggtacgaagaaatacgtaagtggaccggtactcgtggtagggaaacggggtcccgtaacttaccgaaccgaactccgtacccgaaagggacctaaaacctacccaaaacaacctacaaggttaacttactccgttagaaacctaaaagtgaaacgttcggacttaaggacggaacggacccggaagggaccgtacggtacgttaggtgtttaactttcgnggttacgacggtagtacgttcccgaaccccgaacttcccgaaagttaccgaacccttgtacggtttacttttaggaacgtttaggg

SEQ ID NO: 385067 - DNA, 563 bp, Homo sapiens
  misc_feature: GZ8MTXP02FHQZP.25.71.G05.1.454.CMB.2.raw
  modified_base (309)..(309): a, c, t, g, unknown or other
  modified_base (355)..(355): a, c, t, g, unknown or other
  modified_base (457)..(457): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctggggggtcccaagactctcttgtgcagcctctggattcaacttcaaaggctacagcatgaactggatccgccaggcgtccggggaaggtcngcagtggatttcatccattagtggtcttaagcgtgactaaattttntgcagactcgggtgaacgggtccgtcaccatcctcagacgacacgccgacgtactttctcttctgacaaatcgaacacgcctacagacgccgaggacacggntgtttattctgtgcgaggaggaggtcggggacgaaaacgtggactcgtacgggtaggtgtagtgtcgttttagtacgtttcggtacgggggacccgaaggggtacg

SEQ ID NO: 385068 - DNA, 825 bp, Homo sapiens
  misc_feature: GZ8MTXP02IEJ5I.25.71.G05.1.454.CMB.2.raw
  modified_base (137)..(137): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgntgggttttccttgtcgctattttagaaggtgtccagtgtgaggtggtgctgggtggagtcgtgggggaggcctggtcaagccgtgggggtcccgaagactctcttgtgcagcctctggattcaacttcgaaaggctacagcagtagaactggaactccgacgacggtcgtaccgggggaaggtctggcgaggtggtactttcgacttccgtagtttacggttggttaacgttaaacggcggttaaggtaaactttaaaatttttagtacgactaggtacgttcgggtacggtacccgggtccggtttaccaaccctacttacccgtaccaagaaccggaacaacccggtacccgtaaccgttacctttttaccttcccgtttttacgacgtaaaccgtaaaagttacgaaaccgtacgtaccccgttaacgaacggaaccgggtaccgaaacgggtaaccccgtaaacgggttcgtttaacgtttttaacgtttccggttagggtttacggccgggtaaaggggtaaaccggggtagggtttaaacgggggaaacccggtaaaaacggttccgggtaccggttaaccgggtaaccgggggttaacggtttggtaaaccggttttggttaacccgtttttaggttaccggttttaccggggtaaccggggtaaccggttaaaacggggg

SEQ ID NO: 385069 - DNA, 689 bp, Homo sapiens
  misc_feature: GZ8MTXP02I12BN.25.71.G05.1.454.CMB.2.raw
  modified_base (325)..(325): a, c, t, g, unknown or other
  modified_base (560)..(560): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggagcctggtcaagccgtgggggtacccaagactctcttgtgcagccttctggtattccaaacttcgaaaggcctacagcatgaactggactcccggccagggccgtaccgggggtaaggttcnggcaggttggtactttcactcctagtttaggtgttacttaaggcgtagtaacttaaatttttgcgacacggtactacgggtacggtaccgggtcccgttacaacctacgtcctacgacgaaacgaacccgaaccggtcccgtaacccgttaccttttccttccgtttacacgtaactaaacgttacgaacacggtaccctagaacgaccggacggacggtaaccgtacgtcgttntttaagtttcgtaggtacggagagggagggtacggtacgggaaacgtaaacgtcggtacgttacgtacgggtaggtacgtaagttcgtttacgtttggttacgttacgggtacgggaacggttaacggg

SEQ ID NO: 385070 - DNA, 612 bp, Homo sapiens
  misc_feature: GZ8MTXP02GQU87.25.71.G05.1.454.CMB.2.raw
  modified_base (312)..(312): a, c, t, g, unknown or other
  modified_base (364)..(364): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggagtgggctccgcttggtttcctgtcgctattttagaaggtgtccagtgtgaggtggtgctggtggagtcgtgggggagcctggtcaagccgtgggggtcccaagactctcgttgtgcacgtcctcgtggattcaacttcgaaaggctacagcatgaactggactcccgcaggccgtaccggggaggtcngcagtgtatttcatcctagtttagtgtacttaagcgtagaacttaaatttcngactagtaccgttcggtagaacgggtccgttacaccgtattccacgaagacgaacaaccgccgtacgttacttcttcgtttacacgtacctaaatacgaaactacgcctacgagacgccggaaggactacgggtcttacgttttagtcgttaggcggacgaggtagggaggtacgggaacgtaaaagtcggactacggtacgggagtagtagtgtttacgtttgtacgttcggcggacgtaacggtag

SEQ ID NO: 385071 - DNA, 675 bp, Homo sapiens
  misc_feature: GZ8MTXP02F8TQA.25.71.G05.1.454.CMB.2.raw
  modified_base (533)..(533): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgcttattttagaggtgtccagtgtgaggtgctaggttggaggagtcggtggggggaggtcgtttgggtccgaggggtccccggggggggttccctggacgtaccttctccgtggtgggacgtcccttcgtggtattcgtagttttagcgtagtgtttaggatggagtcgtgggtcccgccgacggccccggaaggggacggggcgtgggtggtgggtaccgaccgaacacgtaacgacggaaaggacgtagggagtagaagtaaactacgtagtcggacggtactcgttaggtacggggaacgggtccgtattaccgacctatcccgtaccgaacgggaacctaaacctacccaaaacgtactacgaatactactacgtanaaacgaatagtaagtgtaacgtgacgacggacgaaggaccgtacggtgttgttagttacttcgagttacggacgtagtcggtacccgaccgtacaccgtacgtactcctagtcttacgtttagagttcggcgggtaacgggg

SEQ ID NO: 385072 - DNA, 775 bp, Homo sapiens
  misc_feature: GZ8MTXP02FUV3S.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttggtccgagggccgggggggtccctggagactctcctgtgcagcctcgtggtattcagttttagcagtatttggatggagctgggtaccgccgacggccccgaggggaacggggctggggtggtaggggtacgaccaagatacgaacggaaagagtggggaaggtgaacgtaaaattaccgtagtaggccggacttacgtgggtacgaaacgggggtccgtaaatttccgaaccctacttacccgtaccgtaacggggaaaccctaaaaccgtaacccgaaaacctaaaacccttaccaaaggttaacttaactcgtaaacggtaacctaaaaagttacggtaaaagttcggggttaaccgttagggaaacgggtaaaccggaaccccgggtaaagggggaacccggtaaacgggggttacccgtttgggttaggttttaaacgtttcccggttacggtttacgggacggtaaacggtacggttacccggaccccgtaaaactccccggtaaactaacggtacccctttagtacccgtttagttttacgacgtttaggttccggggg

SEQ ID NO: 385073 - DNA, 714 bp, Homo sapiens
  misc_feature: GZ8MTXP02IIPXJ.25.71.G05.1.454.CMB.2.raw
  modified_base (268)..(268): a, c, t, g, unknown or other
  modified_base (369)..(369): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttcctgtcgctattttagaaggtgtccagtgtgaggtggtgctggtggagtcgtgggggagcctggtcaagcgtgggggcccaagctctcttgtgcagcctctggattcaacttcaaaggctacngcatgaactggatccgcaggcgtaccggggaaggtctgcgagtggtatttcataccgtaagtttacgtggttacttaaaggcgtagaaacttaaaattttnagcgagtacgtcggtacggaaaccggtccgggttaccacctacgtacccttacccgaaggacgaaacccgaaccgtacccgaaccgtttaacctttcttacttttcgtacggtaccctaaaagttcggtaaaacccgacgtaccgtaacgacggaaccggaacccgggtaacggtaaccgttaccggtttacgtttacgttttacgtttacgtggtacggacggtaagggtaagggtacgggtaacgggtaaacgtaaacggtcggtacggtaacggtacggtacggttagttacgtttgtttacgtttacggttacggttcggtacgggtaacgtaacggtacg

SEQ ID NO: 385074 - DNA, 511 bp, Homo sapiens
  misc_feature: GZ8MTXP02HPHUM.25.71.G05.1.454.CMB.2.raw
  modified_base (363)..(363): a, c, t, g, unknown or other
  modified_base (383)..(383): a, c, t, g, unknown or other
  modified_base (500)..(500): a, c, t, g, unknown or other
  modified_base (507)..(507): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggagcttggtccaggccggggggtccctgagactctcctgtgcagcctctggattcagttttagcagtattttggatgagctggtccgcaggccccagggaggggctggtgtgggtagccaacatacacgaaagatgggagtagagaaatactatgcgactcngtgaaggcgattcaccatcncgaggacaacgtaccaacaactcagtatatctgacaaatgataggtctggagagccgaggtacacggtctagtgtattctgtgcgagagtcgacccgatccataagaccctatcgtntttgatntggg

SEQ ID NO: 385075 - DNA, 647 bp, Homo sapiens
  misc_feature: GZ8MTXP02H8Z5M.25.71.G05.1.454.CMB.2.raw
  modified_base (350)..(350): a, c, t, g, unknown or other
  modified_base (372)..(372): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgcttgggttttccttgtcgctattttagaaggtgtccagtgtgaggtggtgctggtggagtcgtggggggaggcctggtcaagccgtgggggtcccaagactctcttgtgcagcctctggattcaacttcaaaggctacagcatagaactggatcccgccaggccgtaccggggaaggtctggacaggtggtatttcatcctagtttacgtggtnttaaagcgtagacttaaatttngtacagtcgtcggtagaccggggtccgttacaccgtactcctacgagacgaacacgacccggtactactttctcgtttcgacgtactaaagtacgaaactcgtaccgtacgacgacggaccgagggtacctacggtccgtttagtttagtttccgtgttggagtaaggtagggtaggtacggggaacgtaaaacggtcggacgttcggtaacgggtgtacgtaagttcgtttacgtttaggttacgtttcgggtacgggggtaccgttaaagggg

SEQ ID NO: 385076 - DNA, 580 bp, Homo sapiens
  misc_feature: GZ8MTXP02FX605.25.71.G05.1.454.CMB.2.raw
  modified_base (234)..(234): a, c, t, g, unknown or other
  modified_base (346)..(346): a, c, t, g, unknown or other
  modified_base (422)..(422): a, c, t, g, unknown or other
  modified_base (441)..(441): a, c, t, g, unknown or other
  modified_base (460)..(460): a, c, t, g, unknown or other
  modified_base (472)..(472): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtctggggagcctggtcaagcctgggggtcccaagactctnttgtgcagcctctggattcaacttcaaaggctacagcatgaactggatccgcaggctccgggaaggtctgcagtggatttcatccattagtgtctaaagcgtgactaatttngtcagactcggtacgacgggtccggtcaccgtatacctccagtacgaccaaacgtccgacgtactttctcgtttcngacaatacgaacagcctanagtacgccgagacacggtntcgtttattcgngttcggacgtaggagtgtacgggacaaaacgtcggtaccgtcgtaaccgggtagacgtacgtaacgttacgtttggtacttttcggacgggtaccgtaagggtaaccg

SEQ ID NO: 385077 - DNA, 761 bp, Homo sapiens
  misc_feature: GZ8MTXP02G4E6A.25.71.G05.1.454.CMB.2.raw
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggccgtggggggtcccaagactctcttgtgcagcctctggattcaacttcaaaggctacagcatgaactggactccgaccaggccgtaccggggaaggtctgcaggtggtatttcattcctatttacggtgttacttaaaggcgttagaaacttaaatttttacgagtactaaggtaccgttcggggtacggaaaccgggtcccgggttacaaccctacgttacctacccgaaggaacgaacccgaaaccggtcccgtaaccgttaacctttccgttactttacgtacgtaaaccaaaacgttacgaaacctacgtaccctacgacgaaccggacccggaacgggtaccaccgggttacgtttacgttttaactttcggtaggtccggtaacgggtaagggaaggggtaagggttacgggggaaaccgtaaaacggttcgggtaaccgtttaccgggtaaacgggtacgggttaaggttagttcggtttacgttttacggtacggttttaccgggtacggggtaacccggtaaaagggggttaccg

SEQ ID NO: 385078 - DNA, 580 bp, Homo sapiens
  misc_feature: GZ8MTXP02JCUTR.25.71.G05.1.454.CMB.2.raw
  modified_base (352)..(352): a, c, t, g, unknown or other
  modified_base (419)..(419): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggtttccttgtcgctattttagaaggtgtccagtgtgaggtggtgctggtggagtctgggggaggcctggtcaagccgtgggggtcccgaagactctcttgtgcagcctctggattcaacttcaaaggctacagcatgaactggactccgccaggctccggggaaggtctgcagtggatttcatccattagtgtctagcgtgaactaatttangcagtactcggtagacggtccggttcaccgtatcctcagacgacgacgccgacgtacttctctttcngactaatacgaacacgacctcagacgccgacggacgaccggtacttgtttacttcgtgtgacgagagggaggtagggaccgtaaaacgtggaccgtacgtaccggggagtagtaagtcggttcgttttacggtgtttcggtacgggggtacctaaacgggg

SEQ ID NO: 385079 - DNA, 788 bp, Homo sapiens
  misc_feature: GZ8MTXP02I3TIP.25.71.G05.1.454.CMB.2.raw
  modified_base (350)..(350): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtgggctccgctggtttcctgtcgctatttagaaggtgtccagtgtgaggtggtgcgtggtggagtcgtgggggagccgtggtcaagccgtcgggggtacccaagacttctcgttgtggcagccttcgtggtattcgaacttcgaaaaggtcctacgaagtcagtacgaaacgttggaacttcccggaccgaacggggtccgtaccccggggaaaggggtttccncggtacgtaggttacggttactttactacgtaccgtaagtttcggtacggtttaccgtttaaaggtcggttacgtaaacttaaaacgtttttcgacgtacgtaacggtacgttaccgggtacggtaccgggtcccgttacctaccgtacgtacctaccgaagaacgaccgtaaccgtaccgttaaccgttactttaccttacgttacgtacgtaacgtaaagtacgaaactacgtaccgtacgtacgaccggaaccggacggtaccgtaaccggttactttaacggtttactttcggtacggtacggtacggtaacgggtacgggtacgggtacggtaaaccgtaaacggtcggtaaccgttacggtaacgggttaggtacgttaacgttacggttacgtttacggttaccggtttacggtaccgggtaacgtaacgg

SEQ ID NO: 385080 - DNA, 778 bp, Homo sapiens
  misc_feature: GZ8MTXP02HH3CT.25.71.G05.1.454.CMB.2.raw
  modified_base (391)..(391): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtgggggtcccgaagactctcttgtgcagcctctggattcaacttcaaaggctacagcatgaaacgtggactccgccgagggccgtacccgggggaaggtctggcgaggtcggtatttcgatcctaagtttaggtaggttacttaaagccgtagtaaacttaaaagtttttanacgtacgaaggtacgttaccgggtacggtaccggggtcccgggtttacaaccctacttccgtacccaaggtaacgaaccgaccgacccggtaacgttctttccttacctttactcgaactaaaacgttacggaaaccacggtacccttaacgaacgggaccggtacccgggaacgggtaaccggtaacccggggtttacgttttacggttttacgtttcgtacgggttacggaaccgggtaaggggtaaacggggtaacggggttaaacggggaaaccgtaaacgggtcgggtaaccgtaccggggtacggtagggttacgttaacgtttcggtttacggttttacggttacggtttccggggtaacggggtaaccggttaaacggg

SEQ ID NO: 385081 - DNA, 639 bp, Homo sapiens
  misc_feature: GZ8MTXP02JSGYQ.25.71.G05.1.454.CMB.2.raw
  modified_base (356)..(356): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggccgtggggggtcccaagactctcttgtgcagcctctggattcaacttcaaaggctacagcatgaactggatccgcaggctaccggggaggtctgcagtggtattcatcatttagtgtctaagcgtagactaaaattttncgtacagtacgtcggtacgtaccgggtcggttacacctactcccgtaccaagacgaaccaaccgacccgacgtactttcttctttacgtagaccaaagtacaacgacgtacctagacgaacgccggagggaccgacgggtccttaggtttactttcgtcggttggacggtagggagggtagggtacggggaaacgtaaaacggtcggtaccgttaccgtacggggaggttagtaacgtcggttcgttttagtacgtttcggtacggggtaccggtaaacgggg

SEQ ID NO: 385082 - DNA, 709 bp, Homo sapiens
  misc_feature: GZ8MTXP02FOFD5.25.71.G05.1.454.CMB.2.raw
  modified_base (368)..(368): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtcgtgggggagcctggtcaagccgtgggggtcccgaagactctcttgtgcagcctctggattcaacttcaaaggctacagcatgaactggactccgccaggcgtaccggggaaggtctgcgaggtgtatttcatccattaggtggttacttaagcgtagtaactaaacgttttancgacaagtacgtacggggtacggtaccggggtccgttacaacccgtagtccctaccgaaaggaacgaaacccgaaaccgtacccgtaaccgttaccttttcttcctttaccgtacgtaacctaaaagtacgaaaaccgacgtaccctacgaacggaacggccggaacggaccgacgggtacctttaggtttactttcgtggtacggacggtaagggtagggtacgggtacggggtaaaccgtaaaacggtcgggaccgttaccgggtaacggggtagggttaggtaacgttcggttacgttttaggtacgtttacggtacgggggtacccgtaaaacgggg

SEQ ID NO: 385083 - DNA, 859 bp, Homo sapiens
  misc_feature: GZ8MTXP02H97RX.25.71.G05.1.454.CMB.2.raw
tcagactgtacagtcacgaccggtgctcgatttagtgtcgtcgcaagagagaggggccttagccctggattccaaggcctttccacttggtgatcagcactgagcaccgaggattcaccatggaagtgggctccgctgggttttccttgtcgctattttagaaggtgtccagtgtgaggtggtgctggtggagtcgtgggggaggcctggtcaaggccgtggggggtcccaagctctcgttgtgcagcctctggattcaacttcaaaggctacgagcatgaaactggactccgccgaggcgtaccgggggaacggtctcggcgtaggtggtaacttttccacgttcctaagtttagggttcggttacgttaaggcggttacgtaaacttaaaagtttttatcgtaccgtaacgtaccgttacggggtaacggtaaacccgggttcccggggttaccctaacccgtaacgttcccgtaaccccgaaaggaacgaaacccgaaaacccgggtcccgtaaacccggtttaacctttttcccgtttcccttttaaccgtacggtaaaccttaaaagttacgaaaaccgtacgtacccttaacggaaacggtacccgggtacccgggaaaggtacccggtaccggggtttacctttttaggtttttaacgtttacccggttggggttaccggtaaccggggaaggggtaacgggggtaaggggttacggggaaaaccgggttaaaaacgttcgggggtacccgttaacgggttaccggggacggtttaggaaccgtttggtttaccgttttagggtttaaccggttttcgggaccgggggtaaacccgtttaaagggggtaccg

SEQ ID NO: 385084 - DNA, 656 bp, Homo sapiens
  misc_feature: GZ8MTXP02G9I7U.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggagcttgggtccaggccggggggtcctggagactctcctgtgcagcctgtggattcagttttagctagtagttttaggatggacgcgtacgggtcccgccgacggtaccccgaggggaacggggcgtggggtggtgggtacgaccaacgactacgacgaagtagtgggaaggtgaagtaatacgtagcgtacggtactcgtggtacgggaaacgggtcctagttaccgacctaacgtccgtaacccgaagggaaaccctaacctaccaaacctaacttacgaacgttaatactactacgaaactaaagtaggtaaattcggtcgtaggaagaccgaccgggaagaccgtacggtgtagttgttacgtttcgtagcgtacgacggtacgtcccgtacccgtaactccgtaaacgtaacgtaccctagtttgtaccttttagacgtaggttcgggg

SEQ ID NO: 385085 - DNA, 786 bp, Homo sapiens
  misc_feature: GZ8MTXP02FSJKC.25.71.G05.1.454.CMB.2.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgtgctattttagaaggtgtccagtgtgaggtgcagttggaggagtcgtgggggagcttggtccaggccggggggtcctgagactctcctgtgcagcctcgtggtattctagtttagctagtatttggatgagcgtcggtccgccgacggccccgaggggacggggtctgggtggtgggtacgaccaaacgactaacgaacggaagagtagggaaggtagaacgtaaaatacgtagtcggacggtaacttcgtgggtacggaaacggggtaccgtaacgttccaaccgtattacccgtaccggaacgggtaaacccaaacccgtaacccaaaactaaaccgttacaaacggtttaattacgtaccttaacgaactaaaaagttagtaaaacgttgggttaccgttagggaaaggaaccgggtaaacccccgggaaagggtaacccgtaacccggggtttcgttaaggggtttactttaaacgttttcggttcgggtttacgggaggttaacggggttaacccggaaccccggtaaccccggtaaaaccttacccgttaaaaccgggttaaccgtttaaaaccccttggtttacccgttttacgtttttaaacgtacggtttacgggtttaacgggggg

SEQ ID NO: 385086 - DNA, 596 bp, Homo sapiens
  misc_feature: GZ8MTXP02HRVES.25.71.G05.1.454.CMB.2.raw
  modified_base (357)..(357): a, c, t, g, unknown or other
tcagactgtacagtcacgaccggtgctcgatttagtgtcgtcgcaagagagaggggccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggagcctggtcaagccgtggggggtcccaagactctcttgtgcagcctctggattcaacttcaaaggctacagcatgaactggactccgccaggctccggggaaaggtctgcagtggatttcatccattagtgtcttaaagcgtagactaaattttngcagactggtacgaacgggtccggttacaccattcctaccgagaacgaccaaacgccgacgtacctttctctttctagactaaatcgaacacgccctagaggagacccggaggaccaaccgggctttaggtttatttcgtggtcgacggaggaggaggtgggaacgtaaaacgtggacgttcgtaacgggaggtagagttgtcgtttagttactttcggacggggtaccgtaaggtacg

SEQ ID NO: 385087 - DNA, 598 bp, Homo sapiens
  misc_feature: GZ8MTXP02HRD0V.25.71.G05.1.454.CMB.2.raw
  modified_base (246)..(246): a, c, t, g, unknown or other
  modified_base (264)..(264): a, c, t, g, unknown or other
  modified_base (284)..(284): a, c, t, g, unknown or other
  modified_base (323)..(323): a, c, t, g, unknown or other
  modified_base (327)..(327): a, c, t, g, unknown or other
  modified_base (332)..(332): a, c, t, g, unknown or other
  modified_base (368)..(368): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgcttattttagaaggtgtccagtgtgaggtggtgctgggtggagtcgtaggggggagccgtggtacgaagccgtggggggtacccaagtctctnttgacgcagcctgtaggnttcaacttccgaaagcacgngcatgaactggaactccgcgaggtcgaccggggagtcgngcgngtgtnttgactcgtgttagtgtacgtagctataattaattncgcagtacgtgggtacgtaccgggtctccacgtcgtaccacgaagtacgaccgacgtacccgtacttcctttcgttcttacgactaactacgacacgtacgacgacgacgacgacgacgacgtacgtcgttcgttcgttcgtcgtgtagtagtaggtacggtacggtacgtacgtacgtacgtacgtacggtagtagtgtgttacgttcgtcgtcggtacggtacgtacg

SEQ ID NO: 385088 - DNA, 531 bp, Homo sapiens
  misc_feature: GZ8MTXP02GZ4PA.25.71.G05.1.454.CMB.2.raw
  modified_base (330)..(330): a, c, t, g, unknown or other
  modified_base (384)..(384): a, c, t, g, unknown or other
  modified_base (387)..(387): a, c, t, g, unknown or other
  modified_base (415)..(415): a, c, t, g, unknown or other
  modified_base (472)..(472): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttggtccaggccgggggggtccctggagactctcctgtgcagcctctggattcagtttagcagtattttggatgagcgtgggtccgccaggccccgagggacggggctggtgtggtagccaanatacacgagatggaggtgagaatacgtatgcggactcgtgtgagggccatcacntcncaggacaactcaacactcagatatctanacaaatgaatggtactagagacgaccgaggacgacggctaggtgtattcgtagtcgngacggagtcggacccgtaatccacgtaacgtaaccctatcgtctttagactagttcggg

SEQ ID NO: 385089 - DNA, 921 bp, Homo sapiens
  misc_feature: GZ8MTXP02GXWJV.25.71.G05.1.454.CMB.2.raw
  modified_base (169)..(169): a, c, t, g, unknown or other
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgcttattttagaaggtntccagtgtgaggtgcaggttggaggagtcgtgggggagtcgttcgggtccgacgggcccggggggttccctggacgtaccttccgtcctggtacgcgtacgtccttcgtggtacttcgtaagttttacgctagttgttttgatcggagtcggttcggacccgccgaccggccccggtaagggggacgggtcgttgggtcggtagggtacgacctaagtacgtaaaccggagaaaggagtggggaaagggtagaaacccgttaaaattagtaaaggttcggacccggtaagttcgttagggggacggaaaccgggggtcctaactttacccgaaccgttaacgttccccgtaaaccggaacgggtaaaacccctaaacccttaccccaaaaacgtaacccctttaacggaaagtttaaaccttcgggtttacccaaacggaaactttaaaagggagttaaacccgggtttttcgggacggttaagaacccgggggtaaacccgtaccgggggaaacggtttaccccggtaaacggggttacggtttacgggttttgtttaaacccgtttttagggcccgggtttaaaggggtccccggttaaaaagggggttccccggtttacccggggaaaaccccccccgtttaaacgtaccccctttaaaggggaaaccccccgtttaaaactttgggtaaacccccgggttttttaaattttcgggtaaaaggtttttcccgggggtaaacgggggggg

SEQ ID NO: 385090 - DNA, 697 bp, Homo sapiens
  misc_feature: GZ8MTXP02JO8N5.25.71.G05.1.454.CMB.2.raw
  modified_base (375)..(375): a, c, t, g, unknown or other
tcagactgtacagtcacgaccggtgctcgatttagtgtcgtcgcaagagagaggagccttagccctggattccaaggcctttccacttggtgatcagcactgagcaccgagattcaccatggaacgtgggctccgctgggttttcctgtcgctattttagaaggtgtccagtgtgaggtggtgctggtggagtcgtggggagcctggtcaagccgtgggggtcccaagactctcttgtgcagtcctctggtacttcaacgttacaaaggtctaacgagcatgaaacgtggactccgcaggcgtaccggggagtctgcagtgtacttcgatacctagttcggtgttacgttaaagcgttagtaactaaacttttcngctaagtacgtacggttacgaccgggtccgttacaacctacgtctaccgagtaccgaacaaccgaccgtaacgttactttcctactttcacggtactaaaacgtcgtaaaccgacgtacccgacgaggaacggcccgttaagggaaccccttacggtattttaccggttttaacttccgttaacgggcggtaacggaagggtaacgggtaacggtaaccgggtaaacgtaaccgggtacgtacgtaaccggtacgggtacggtacgtaacgtttacggtttacgtttacggtaccggtttaccgggacggggtaacgtacgg

SEQ ID NO: 385091 - DNA, 723 bp, Homo sapiens
  misc_feature: GZ8MTXP02H0QC8.25.71.G05.1.454.CMB.2.raw
  modified_base (376)..(376): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgcttattttagaaggtgtccagtgtgaggtggtgcgtggtggagtcgtgggggagcctggtcaagccgtgggggtcccaagactctcttgtgcagcctcgtggtattcaacttcaaaggctacagcatgaactggactccgcgaggcgaccggggtaggtcgtgctaggtggtattcacgtcctagttggttggtacttaagcgtagtaacttaaactttttanaggctagtacgttcgggtacgaccgggtccgttcaccacttccacgagacgacgacgcccgtacgtactttcttccttttacacgtactaaacgtcgaaacgacgtaccgtacgacggacggacccggaacgggtaaccgtaccggggtttactttacggttttaaacgtttttccgagggtttacggaccggtaagggtaaaggggtacgggtaacgggggtaaaacggtaaaaccgtcggggttaaacccttacgggtaacggggtacggttagttaaccggttacggtttcgttttacggttacgttttaccggggtacggggttaacccggtttaaaacgggg

SEQ ID NO: 385092 - DNA, 642 bp, Homo sapiens
  misc_feature: GZ8MTXP02FY8Z0.25.71.G05.1.454.CMB.2.raw
  modified_base (260)..(260): a, c, t, g, unknown or other
  modified_base (279)..(279): a, c, t, g, unknown or other
  modified_base (374)..(374): a, c, t, g, unknown or other
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctattttagaaggtgtccagtgtgaggtggtgctggtggagtcgtgggggacgcctggtcaaggcctgggggtcccaagctctctgtgcagcctgtggattcaacttnaaaggctacagcatgaacnggatccgacaggctccggggaaggtctgctaggtgtacgttcagttccaagtttggtcggttactttaaaggccgttagtacctaaaactttttnagactacgacgtcggtacggccggtccgtacacctactcgtacacgacgactacgccgtaacgttactttcctcttacgctaactaaacgtacgaaactcgtacccgtagaacgacggacgtacggacgtacggtcgttagtttacgttacgtcgtggtacgtaggagggtacggagggtaaccgtaaaacggtcggtacgtacgggtacggtagttacgtaagttacggttacgttacgttacgtttacggtacggtacggtaacgg

SEQ ID NO: 385093 - DNA, 627 bp, Homo sapiens
  misc_feature: GZ8MTXP02IBV9L.25.71.G05.1.454.CMB.2.raw
tcagactgtacagtcacgaccggtgctcgatttagtgtcgtcgcaagagagaggagccttagccctggattccaaggcctttccacttggtgatcagcactgagcaccgaggattcaccatggaagtgggctcgctgggtttcctgtcgctatttagaaggtgtccagtgtgaggtggtgctgggtgagtcgtggggggagcctggtcaaggccgtggggggtaccccaagactctcgtgtgcagcctcgtggacttacgaaacttcgaaaggctacagcatagaactgactccgcaggaccgtccggggtaaggtctgacgaggtaggactttcgacttccctagttacgtggtactttaaagcgtacgtaataaacgttttagacgactaagaccgttcggtagaccgggtccgttacacctactcctacgaagacgtacacgacccgtacgtactttccgtcttacgtacgactaaactcgaaaccagtaccctacgacggacgtcgtaagggacctaggtccttaggtttacttgtagtgacgtagaggtcgtaggacgtaaacgtgacctacgtacggtagtgtaagtacgtcgtttcgaagtttcggtcggtacgtacggg

SEQ ID NO: 385094 - DNA, 506 bp, Homo sapiens
  misc_feature: GZ8MTXP01DXDN4.9.31.C09.1.454.CMB.2.raw
  modified_base (231)..(231): a, c, t, g, unknown or other
  modified_base (243)..(243): a, c, t, g, unknown or other
  modified_base (420)..(420): a, c, t, g, unknown or other
  modified_base (428)..(428): a, c, t, g, unknown or other
  modified_base (434)..(434): a, c, t, g, unknown or other
tcagtgatacgtctcacgaccggtgctcgatttagacgtctcatcaaggaaggaaggggggtctcaggaggcagcgctctcgggacgtctccaccatgacctgggctctgctattcctcaccctcctcactcagggcacagggtcttgggcccagtctgccctgactcagcctgcctccgtgtctgggtctcctggacagtcgatagccatctcctgcactggaactaacngtgacgttggtncttataaattatgtctcctggtatcaacaacacccaggcaaacgcccccaatcattattctgatgtcaacaatcggcccccagggatttctgatcgccttctctgctccaaagtctggcaaacacggcctcctgacatctctgggctcgggctgagacgagctcactatactgcganctcattanacaacngacgactactctgtgtcggcggagggcttgaactgaccgttcaggtcacgccaagcttcgccccgttggtcc

SEQ ID NO: 385095 - DNA, 470 bp, Homo sapiens
  misc_feature: GZ8MTXP01DBFA6.9.31.C09.1.454.CMB.2.raw
  modified_base (348)..(348): a, c, t, g, unknown or other
  modified_base (369)..(369): a, c, t, g, unknown or other
  modified_base (377)..(377): a, c, t, g, unknown or other
  modified_base (434)..(434): a, c, t, g, unknown or other
  modified_base (438)..(438): a, c, t, g, unknown or other
  modified_base (448)..(448): a, c, t, g, unknown or other
  modified_base (455)..(455): a, c, t, g, unknown or other
  modified_base (457)..(457): a, c, t, g, unknown or other
  modified_base (460)..(470): a, c, t, g, unknown or other
tcagtgatacgtctcacgaccggtgctcgatttagacgtctcatcaaggaaggaaggggctggagtgggttggacgtcttaaaagcaagggtagcggtgggacagcagactacgcttcatccgtgaagggcagattcagcatttccagagacgatgcaagacagatgatgtatttacagatgaacagacctaaaaatcggagacacagccctatatttctgcgtcttcatttcgcagtgggagtcttccgggtttacggtcggtgacgttcgtgggggcccgggagcccagtcggtccaccgtctcctcagccctccaccaacggccccagtccggtccttcccccgnggccgccctgctccaggaccnccaccccncgagacgcacgacgccggccgtgggctcgccgtcgacgaacgactactcagtactancagnggcgcggcgngcgacgngnagnnnnnnnnnnn

SEQ ID NO: 385096 - DNA, 446 bp, Homo sapiens
  misc_feature: GZ8MTXP01DSU1Y.9.31.C09.1.454.CMB.2.raw
  modified_base (336)..(336): a, c, t, g, unknown or other
  modified_base (349)..(349): a, c, t, g, unknown or other
  modified_base (407)..(407): a, c, t, g, unknown or other
  modified_base (421)..(421): a, c, t, g, unknown or other
  modified_base (433)..(433): a, c, t, g, unknown or other
  modified_base (440)..(446): a, c, t, g, unknown or other
tcagtgatacgtctcacgaccggtgctcgatttagacgtctcatcaaggaaggaaggggctggagtgggttggacgtcttaaaagcaagggtagcggtgggacagcagactacgcttcatccgtgaagggcagattcagcatttccagagacgatgcaagacagatgatgtatttacagatgaacagacctaaaaatcggagacacagccctatatttctgtgtcttcatttcgcagtgggagctccggtttacggtcggtgtacttcgtggggccgggagccagtggtcaccgtctcctcagcctccacaacggcccatcggtctcccctggccnccctgctccaggnccaccctccgagacgcacacgcgccgtgggcctgcctggtcaggctactccagcgtancacgtgagcgggcngggcaagggtcncaagtgnnnnnnn

SEQ ID NO: 385097 - DNA, 491 bp, Homo sapiens
  misc_feature: GZ8MTXP01CMUOT.9.31.C09.1.454.CMB.2.raw
  modified_base (346)..(346): a, c, t, g, unknown or other
  modified_base (368)..(368): a, c, t, g, unknown or other
  modified_base (465)..(465): a, c, t, g, unknown or other
  modified_base (478)..(478): a, c, t, g, unknown or other
  modified_base (481)..(491): a, c, t, g, unknown or other
tcagtgatacgtctcacgaccggtgctcgatttagacgtctcatcaaggaaggaaggggctggagtgggttggacgtcttaaaagcaagggtagcggtgggacagcagactacgcttcatccgtgaagggcagattcagcatttccagagacgatgcaagacagatgatgtatttacagatgaacagacctaaaaatcggagacacagccctatatttctgcgtcttcatttcgcagtgggagcttccggtttacggtcggtgacgttcgtgggggccgggagcccagtcggtcaccgtctcctcacgccctccaccgaacggccccagtccggtccttcccccgnggcccgccctcgctccgaggcncacccctccgagacgcacgaacgccggcccgtgggcctggcccgtaggtacgaacggacttaccttccgaagtaccgtatcccaagtgacgcgggcnggacaaggccganagnnnnnnnnnnn

SEQ ID NO: 385098 - DNA, 610 bp, Homo sapiens
  misc_feature: GZ8MTXP01BFMRZ.9.31.C09.1.454.CMB.2.raw
  modified_base (403)..(403): a, c, t, g, unknown or other
tcagtgatacgtctcacgaccggtgctcgatttagacgtctcatcaaggaaggaagggggggagaggagccccagccttgggattcccaagtgttttcattcagtgatcaggactgaacacagaggactcaccatggagtttgggctgagctggattttccttgctgcttaattttaaaaggtgtccagtgtgaggtgcaactggtggagtcgtgggggaggctcggtcaagccgtgggggagtcccttagactctcctgtgcaacctctggattcaatttcgacatcgcctggatggaggttcgggcccgccaggctccgagggggaggggctgggagtggggttggacgtacgttaaaaggcgaaggggtagcgggtgggaccaggcagacctacgcttcngtcccggtagaagggcagatcagctaattaccagagacgatagacaagacagatgattagtatttacagtatagaaacagtaacctaaaagtccggaagaaccaacacgtacccttaattaactttctcgttcgttaccttcttacgtttcgacgtaaggtcggggtaagttcccggttacgggtttacgggtcggttcgtaaccgg

SEQ ID NO: 385099 - DNA, 725 bp, Homo sapiens
  misc_feature: GZ8MTXP01DW5H6.9.31.C09.1.454.CMB.2.raw
  modified_base (208)..(208): a, c, t, g, unknown or other
tcagtgatacgtctcacgaccggtgctcgatttagacgtctcatcaaggaaggaaggggggggtctcaggaggcagcgctctcgggacgtctccaccatggcctgggctctgctattcctcaccctcctcactcagggcacagggtcttgggcccagtctgccctgactcagcctgcctccgtgtccgtggtctcgtgactgtcatcncctatcctccgtgactacgtacggaaactaagtaggtcgttacggtttggtatactttaattaaattgttcgtctcgtagtacacaaacaccaccgagaccgaacccaccccctatactatttactttcagtactacgtaacaaacgtacgtccccggacccgtaggttactttcgatctcgtccttctcgtcgtcctacgtaaacgtcgtcggaccaaccgacccgtccctccgtacgactacttcgtcggtcggtccgtcggtcgtagggaaccgggacgtcgtacctactaaacgtttacgttacgtcgaacggtacgttcctaaacgttaacgtaaacctaaacccgaacgaacggtaaccctaaccgtttccgttaccggtttaggtttcccggggaacggggtaaccgggttacggggtacttaaccgtaaacggtcccggttaacccgttcggttaacgccggtaaccgaacccgtacggcccgttaccccgtccccggttcgtaacccc

SEQ ID NO: 385100 - DNA, 632 bp, Homo sapiens
  misc_feature: GZ8MTXP01EDNW7.9.31.C09.1.454.CMB.2.raw
  modified_base (197)..(197): a, c, t, g, unknown or other
  modified_base (260)..(260): a, c, t, g, unknown or other
  modified_base (267)..(267): a, c, t, g, unknown or other
  modified_base (302)..(302): a, c, t, g, unknown or other
  modified_base (360)..(360): a, c, t, g, unknown or other
tcagtgatacgtctcacgaccggtgctcgatttagacgtctcatcaaggaaggaaggggggagaggagccccagccttgggattcccaagtgttttcattcagtgatcaggactgaacacagaggactcaccatggagtttgggctgagctggtattttccttgctgcttaatttaaaaggtgtccagtgtgaggtncaacgtggtggagtcgtgggggagctcggtcaagccgtggggactcccttagactctcctgtncaacctntgattcaattcgacatcgctggatgagtcggcccncaggctcgagggagggctggagtgggtgacgtagtaaagcgaagggtgcggtggaccngacagtactacgcttagaacgtccgtagggaaacgggcaaggtattacgagaccttacgtttccaaggacgaacgtagtacgaacaaagacaaggtatagtaagttagttaatttaacgaagtaagtacgaaacaagtaaacccgttaaaaagacgaagtaacaacgtacgtaccctaattactttgtcgttcgttcttacgttacgtttcggcgtaagggttcgggtaacgttccgttaccgggtttacgggtccggttaacggttccggg

SEQ ID NO: 385101 - DNA, 531 bp, Homo sapiens
  misc_feature: GZ8MTXP01CUR8Q.9.31.C09.1.454.CMB.2.raw
  modified_base (511)..(531): a, c, t, g, unknown or other
tcagtgatacgtctcacgaccggtgctcgatttagacgtctcatcaaggaaggaaggggctggagtgggttggacgtcttaaaaagcaagggtagcggtgggacagcagactacgcttcatccgtgaagggcagattcagcatttccagagacgatgcaagacagatgatgtatttacagatgaacagacctaaaaatcggagacacagccctatatttctgcgtcttcatttcgctagtgggagcgttccgggtttacggtcggtgtacgttcgtgggggccgggagccagtcggtcaccgtctcctcacgccctccgaccgaacgggccctacgttccggtcccttccccccgtggcccggtcccctgcctacccgaggacgcccacccctccggagcgccaccgaacggccggcccgtgggccctgccgtggtcgaaacggtccttactccgaaggtaaccttcaccgacggtggacggcgggtacgacggacgaggtccagagacgnnnnnnnnnnnnnnnnnnnnn

SEQ ID NO: 385102 - DNA, 610 bp, Homo sapiens
  misc_feature: GZ8MTXP01AK9OG.9.31.C09.1.454.CMB.2.raw
  modified_base (379)..(379): a, c, t, g, unknown or other
  modified_base (414)..(414): a, c, t, g, unknown or other
  modified_base (472)..(472): a, c, t, g, unknown or other
tcagtgatacgtctcacgaccggtgctcgatttagacgtctcatcaaggaaggaagggggggagaggagccccagccttgggattcccaagtgttttcattcagtgatcaggactgaacacagaggactcaccatggagtttgggctgagctggtattttccttgctgcttaattttaaaaggtgtccagtgtgaggtgcaacgtggtggagtcgtgggggaggctcggtcaagccgtggggactcccttagactctctgtcgctactctgattcaattcgacatccgcctggatggaggttcggccccgcgaggcctacggaggggaggggctggaggtgggtgacgttacgtaaaggcgaagggtagcggtaggacngcgagtactacgcttcaacgtccggtagaacgggnacgtattccgagactagttccagtagacgagtagacaagacagatagatgtaattaanagtatacgaaacaacgaacctaaaagtacgaagtaacactacgacccttaataacttctgttccgttcttcttacgttcgttcgtaaggttcggtaacgttccggttaccgggtttacgggtcggttaacggtccggg

SEQ ID NO: 385103 - DNA, 621 bp, Homo sapiens
  misc_feature: GZ8MTXP01BS8NK.9.31.C09.1.454.CMB.2.raw
  modified_base (488)..(488): a, c, t, g, unknown or other
  modified_base (494)..(494): a, c, t, g, unknown or other
  modified_base (514)..(514): a, c, t, g, unknown or other
tcagtgatacgtctcacgaccggtgctcgatttagacgtctcatcaaggaaggaagggggggagaggagccccagccttgggattcccaagtgttttcattcagtgatcaggactgaacacagaggactcaccatggagtttgggctgagctggattttccttgctgctattttaaaaggtgtccagtgtgaggtgcaatggtggagtcgtgggggagctcggtcaagccgtggggacgttcccttagactctcctgtcgcaacctctggattcaatttcgacatcgcctggatggagttggccccgcaggcctccgagggaggggctggaggtgggttggacgtacttaaaaggcgaagggtgcggtagggaccaggcagactacgacttcaagtccgtaggaacgggcagattcgaacgtcttacgttaccaaggacgaaccggtatacgaacaaagagagtataggtatgttaataacgagtaanacgaanaacaaacttaaagacggaanaccaacgacgtaccctaattacttctacgttcgttcttcttacgttcgacgtaaggggttggtaacgttccgggttaccggttacgggttcggttgttaacccgggg

SEQ ID NO: 385104 - DNA, 622 bp, Homo sapiens
  misc_feature: GZ8MTXP01CRGZG.9.31.C09.1.454.CMB.2.raw
  modified_base (231)..(231): a, c, t, g, unknown or other
  modified_base (243)..(243): a, c, t, g, unknown or other
  modified_base (263)..(263): a, c, t, g, unknown or other
  modified_base (274)..(274): a, c, t, g, unknown or other
  modified_base (335)..(335): a, c, t, g, unknown or other
  modified_base (452)..(452): a, c, t, g, unknown or other
tcagtgatacgtctcacgaccggtgctcgatttagacgtctcatcaaggaaggaaggggggggtctcaggaggcagcgctctcgggacgtctccaccatggcctgggctctgctattcctcaccctcctcactcagggcacagggtcttgggcccagtctgccctgactcagcctgcctccgtgtctgggtctcctggacagtcgatagccatctcctgcactggaactanagtgacgttggncttatattatgtctctgtancaacaacaccngacaaacgcccccaatcattattctgatgtacaacaactccggacccccagggtactttcngactcgtccttctctggctcccaaagtctggacctaaaccgccgggtccctccctacgacctactcgtcgttcgggcctccggggcttgggacggcgacggtctactactattacgngcagctctaactactacaaccagtaccgtactaccgtcttcggttcggtttaaccgggcgggaaacgggtcttacggtaaaaccgttcggggaaaccccttttccgggacgttccggaactcccccggaaagggtccccgttcccggtccccccgttaacgggttccccc

SEQ ID NO: 385105 - DNA, 708 bp, Homo sapiens
  misc_feature: GZ8MTXP01DU45R.9.31.C09.1.454.CMB.2.raw
  modified_base (284)..(284): a, c, t, g, unknown or other
tcagtgatacgtctcacgaccggtgctcgatttagacgtctcatcaaggaaggaagggggggagaggagccccagccttgggattcccaagtgttttcattcagtgatcaggactgaacacagaggactcaccatggagtttgggctgagctggattttccttgctgcttaattttaaaaggtgtccagtgtgaggtgcaacgtggtggagtcgtgggggaggctcggtcaagccgtggggatcccttagactctcctgtgcaacctcgtgattcaatttcgantcgcctggatgtacggtcggccccgcgaggcctacggaggggaaggggtctagggaggtgggttaggaccgtttacgttaaaaggcgtaagggggtagcggggtaggaccaggacagtaccgtacgcttcaagtacccggtaggaaacggggcaagtactttacgaggtactaacgtttaccgaagagtaaccggtagtacgaaccgaaagacgaagtagtacgtaaagtttacgttaaagttttaacgaaggtaagttaacggaaactaaacgtaaaccgttaaaaagtaccgggaactaaccaaacgtaccgtcccttaatttacgtttcgtacgttcgttctttacgttacgtttcggacgtaagggttacggccggttacggttacccgggtttacggttcgggttcgggtttaacccgg

SEQ ID NO: 385106 - DNA, 600 bp, Homo sapiens
  misc_feature: GZ8MTXP01D1LNN.9.31.C09.1.454.CMB.2.raw
  modified_base (363)..(363): a, c, t, g, unknown or other
  modified_base (371)..(371): a, c, t, g, unknown or other
  modified_base (373)..(373): a, c, t, g, unknown or other
  modified_base (384)..(384): a, c, t, g, unknown or other
  modified_base (417)..(417): a, c, t, g, unknown or other
tcagtgatacgtctcacgaccggtgctcgatttagacgtctcatcaaggaaggaagggggggagaggagccccagccttgggattcccaagtgttttcattcagtgatcaggactgaacacagaggactcaccatggagtttgggctgagctggtattttccttgctgcttaattttaaaaggtgtccagtgtgaggtgcaagtggtggagtcgtgggggagctcggtcaagccgtggggactcccttagacctctcctgtcgctaacctctggattcaatttcgacatcgctggatgagttcggcccgcaggctaccggagggaggctggaggtgggttagacgtataaaggcgaaggtcgnggtggacngngagctacgctncgtcgtagaggcagtatcagctattaccgaganacgatagacaagacgagatgattgttaagttacagtataagaacacgtaaacgtaaaagtacggaataaccacgtaccgtacccttaattacgtttcgtcgttccgttacttcgttacgttcgacgtaagggtcggtaacgttccggttacgggtttacgggttccggttaacgttaaccggg

SEQ ID NO: 385107 - DNA, 588 bp, Homo sapiens
  misc_feature: GZ8MTXP02GYJ0A.9.31.C09.1.454.CMB.2.raw
  modified_base (300)..(300): a, c, t, g, unknown or other
tcagtgatacgtctcacgaccggtgctcgatttagacgtctcatcaaggaaggaaggggggagaggagccccagccttgggattcccaagtgttttcattcagtgatcaggactgaacacagaggactcaccatggagtttgggctgagctggattttccttgctgctattttaaaaggtgtccagtgtgaggtgcaactggtggagtcgtgggggagctcggtcaagcctggggagtcccttagactctcctgtgcaacctctggattcaatttcgacatcgcctggatgagtggcccncaggctcgagggaggctggagtgggtgacgtacgttaaaagcgaaaggggtgcggtgggaccagcagactacgcttcatccgtaggaaggcaagtattcagtctatttccgaagagacgagtagacaaagaacagagtagaattagttaatttacagtatagaaacaacgaaacctaaaaagtcggaaagaaccaacgacgtaccctaattactttctacgtcgttacttcgtactttcgcgtaaggtcggacgtacgttaccggtttacggtcggttacgttaccgg

SEQ ID NO: 385108 - DNA, 512 bp, Homo sapiens
  misc_feature: GZ8MTXP02GF54G.9.31.C09.1.454.CMB.2.raw
  modified_base (383)..(383): a, c, t, g, unknown or other
  modified_base (407)..(407): a, c, t, g, unknown or other
  modified_base (471)..(471): a, c, t, g, unknown or other
tcagtgatacgtctcacgaccggtgctcgatttagacgtctcatcaaggaaggaaggggctctgctattcctcaccctcctcactcagggcacagggtcttgggcccagtctgccctgactcagcctgcctccgtgtctgggtctcctggacagtcgatagccatctcctgcactggaactaacagtgacgttggtgcttataattatgtctcctggtatcaacaacacccaggcaaagcccccaatcattattctgatgtcaacaatcggcccccaggatttctgatcgcttctctggctccaagtctggcaacacggcctccctgaccatctcctgggctcgggctgaggacgaggctcgactattacctgcagctcatanacaaccagcacactctgtcgtcgnggaggactgaactgaccgtctaggtcaggcccaaggctcgcccctcggtcactctcgttccccncctcctacacgactcgtcacgtcggacgcggcgtacggacg

SEQ ID NO: 385109 - DNA, 540 bp, Homo sapiens
  misc_feature: GZ8MTXP02IHOOV.9.31.C09.1.454.CMB.2.raw
  modified_base (297)..(297): a, c, t, g, unknown or other
  modified_base (480)..(480): a, c, t, g, unknown or other
tcagtgatacgtctcacgaccggtgctcgatttagacgtctcatcaaggaaggaagggggagaggagccccagccttgggattcccaagtgttttcattcagtgatcaggactgaacacagaggactcaccatggagtttgggctgagctggattttcctgctgctatttaaaggtgtccagtgtgaggtgcaactggtggagtcgtgggggagctcggtcaagcctggggatcccttagctctcctgtgcaacctctggattcaatttcgacatcgcctggatgagttgggccccncaggctccgagggaggctggagtgggtgacgtcgtaaaagcaaaggggtgcggtggaccagcagactacgcttcatccgtgaaaggggcaggattcgagctattccagagacgatgacaagacagatgaatgtatttacagatagaacagacctaaaagtcgaagacacagccctatatttcngtcgtcttcacttttcgacaaggttggaacgtcgttaccggtttacggtcggtgtaccgg

SEQ ID NO: 385110 - DNA, 549 bp, Homo sapiens
  misc_feature: GZ8MTXP02F2C5Q.9.31.C09.1.454.CMB.2.raw
  modified_base (303)..(303): a, c, t, g, unknown or other
  modified_base (336)..(336): a, c, t, g, unknown or other
  modified_base (431)..(431): a, c, t, g, unknown or other
tcagtgatacgtctcacgaccggtgctcgatttagacgtctcatcaaggaaggaagggggggagaggagccccagccttgggattcccaagtgttttcattcagtgatcaggactgaacacagaggactcaccatggagtttgggctgagctggattttccttgctgctattttaaaaggtgtccagtgtgagggtgcaactgggtggagtcgtgggggagctcggtcgagcctggggagtcccttagactctcctgtgcaacctctggattcaattcgacatcgcctggatgagtgggcccncaggctccgagggaggctggagtgggtgacgtntaaaagcgaagggtgcggtggaccagcagactacgcttcagtccgtggaaaggggcaggtattcgagctattccagagacgatagcaagacagangatgtattacagatagaacaagacctaaaatacggaagacacacgacctagtacttctacgtcgttctctacttcgactaaggtcggacgtcgttccggtttacggtcggtcgtacgg

SEQ ID NO: 385111 - DNA, 585 bp, Homo sapiens
  misc_feature: GZ8MTXP02JV5SN.9.31.C09.1.454.CMB.2.raw
  modified_base (337)..(337): a, c, t, g, unknown or other
tcagtgatacgtctcacgaccggtgctcgatttagacgtctcatcaaggaaggaagggggggagaggagccccagccttgggattcccaagtgttttcattcagtgatcaggactgaacacagaggactcaccatggagtttgggctgagctggattttccttgctgctattttaaaaggtgtccagtgtgaggtgcaactggtggagtcgtgggggaggcgtcggtcaaggccgtggggagtcccttagactctcctgtgcaacctctggattcaattcgacatcgctggatgagtcggccgcaggctcgagggagggctggagtggggtgacgtntaaaagcgaaaggggtgcggtggaccagcagactacgcttcatccggtagaacgggcagattacagctacttaccagagacgagtagacaagaacaagatgtagtgttaatttacgaagtagtagaaacaagtaaacctaaaagtacggaagaacacaacgaccctaattactttctacgtccgttacttctacgttcgacgtaaggtcggtacgtcggttaccggtttaccggtcggttacgtacgg

SEQ ID NO: 385112 - DNA, 556 bp, Homo sapiens
  misc_feature: GZ8MTXP02GNHX7.9.31.C09.1.454.CMB.2.raw
  modified_base (231)..(231): a, c, t, g, unknown or other
  modified_base (242)..(242): a, c, t, g, unknown or other
tcagtgatacgtctcacgaccggtgctcgatttagacgtctcatcaaggaaggaagggggggtctcaggaggcagcgctctcgggacgtctccaccatggcctgggctctgctattcctcaccctcctcactcagggcacagggtcttgggcccagtctgccctgactcagcctgcctccgtgtctgggtctcctggacagtcgatagccatctcctgcactggaactaanagtgacgttgngcttataattatgtctctggtatcaacaacaccaggacaaacgcccccaaatcattatttctgatgtacaacaactccgggccccagggtatttctgactcgccttctctgctcaacgtctggcaacacggccctcctcgaccatctcgtcgggctacggggctggaggacgaggctcactacttacgtgccagtctacatactaaccaaaccaggacaacactcgtggtttcggtcggcgggtaaggacttagaaaccgtcgtaacccgtccgtaaggtccacgacccgaacggcctcggccccctcggtacc

SEQ ID NO: 385113 - DNA, 577 bp, Homo sapiens
  misc_feature: GZ8MTXP02JR5KN.9.31.C09.1.454.CMB.2.raw
  modified_base (301)..(301): a, c, t, g, unknown or other
tcagtgatacgtctcacgaccggtgctcgatttagacgtctcatcaaggaaggaaggggggagaggagccccagccttgggattcccaagtgttttcattcagtgatcaggactgaacacagaggactcaccatggagtttgggctgagctggattttccttgctgctattttaaaaggtgtccagtgtgaggtgcaactggtggagtcgtgggggaggctcggtcaagcctggggagtcccttagactctcctgtgcaacctctggattcaatttcgacatcgcctggatgagtggcccncaggctcgagggagggctggagtgggtgacgtctaaaagcgaaggggtagcggtagggaccagcagactacgcttcatccgtggaagggcagtattcagcatttccagagacgatgacaagacagatgatgtattacagatagaacaagaacctaaaaagtacgaagaaccaacgaacgtaccctaattactttactcgtaccgttactttactactttccgacgtaaggtcgggtacgtcggtttaccgggtttacggttcgggtacgttaccgg

SEQ ID NO: 385114 - DNA, 555 bp, Homo sapiens
  misc_feature: GZ8MTXP02ICPAW.9.31.C09.1.454.CMB.2.raw
  modified_base (301)..(301): a, c, t, g, unknown or other
  modified_base (377)..(377): a, c, t, g, unknown or other
tcagtgatacgtctcacgaccggtgctcgatttagacgtctcatcaaggaaggaaggggggagaggagccccagccttgggattcccaagtgttttcattcagtgatcaggactgaacacagaggactcaccatggagtttgggctgagctggattttcctgctgctatttaaaggtgtccagtgtgaggtgcaactggtggagtcgtgggggaggctcggtcaagccgtggggagtcccttagactctcctgtgcaacctctggattcaatttcgacatcgcctggatgagttcggcccncaggctccgagggaggctggagtgggtgacgtactaaaagcgaaggggtagcggtggaccagcagactacgcttcntccgagaagggcagatcagcattccagagacgatgacaagacagatagatgtattacagatagaacagaacctaaaagtcggaagaacacaacgaccctaatactttctacgtcgttacttactactttcgacgtaaggtcgggacgtcgtaccggtttacggtcggttacgtaccgg

SEQ ID NO: 385115 - DNA, 597 bp, Homo sapiens
  misc_feature: GZ8MTXP02IEXEI.9.31.C09.1.454.CMB.2.raw
  modified_base (503)..(503): a, c, t, g, unknown or other
tcagtgatacgtctcacgaccggtgctcgatttagacgtctcatcaaggaaggaagggggggagaggagccccagccttgggattcccaagtgttttcattcagtgatcaggactgaacacagaggactcaccatggagtttgggctgagctggattttccttgctgcttattttaaaaggtgtccagtgtgaggtgcaactggtggagtcgtgggggagctcggtcaaggccgtggggactcccttagactctcctgtgcaacctctggattcaatttcgacatcgcctggatggaggttcgggccccgccgaggcctaccggaggggaaggggcgtgggaggttggggttggacgttacgttaaaaggcgaaaggggtagcgggtaggaccagcagactacgcttcacgtccgtaggaacgggcagtattcagctattccagagacgatgacaagacagatgatgttattagagatagaacagaaacctaaaagtcggaanacacgactacccttattactttctcgtcgttacttctacgtttcgacgtaaggtcgggacgtccgttaccgggtttacggtcggttcgtaccgg

SEQ ID NO: 385116 - DNA, 570 bp, Homo sapiens
  misc_feature: GZ8MTXP02HWFR2.9.31.C09.1.454.CMB.2.raw
  modified_base (305)..(305): a, c, t, g, unknown or other
  modified_base (392)..(393): a, c, t, g, unknown or other
  modified_base (397)..(397): a, c, t, g, unknown or other
  modified_base (406)..(406): a, c, t, g, unknown or other
  modified_base (408)..(408): a, c, t, g, unknown or other
  modified_base (436)..(436): a, c, t, g, unknown or other
tcagtgatacgtctcacgaccggtgctcgatttagacgtctcatcaaggaaggaagggggggagaggagccccagccttgggattcccaagtgttttcattcagtgatcaggactgaacacagaggactcaccatggagtttgggctgagctggattttccttgctgctattttaaaaggtgtccagtgtgaggtgcaactggtggagtcgtgggggaggctcggtcaaggcctggggatcccttagactctcctgtgcaacctctggattcaatttcgacatcgcctggatgagttcgggcccnccaggcctacgaggggaggggctgggagtggggttggacgtacgttaaaaggcgaagggtagcgggtgggaccagcagactagcttnntcgngaaggcagntnagcattcagagacgatgacaagacaganagatagtattacagatagaacagacctaaaagtcggaagacacacgaccctattactttcgtcgtcgttacttactactttacgcgtaaggtcgggtacgtaccgttccgggtttacggtcgggttacgtacgg

SEQ ID NO: 385117 - DNA, 574 bp, Homo sapiens
  misc_feature: GZ8MTXP02IHZG8.9.31.C09.1.454.CMB.2.raw
  modified_base (306)..(306): a, c, t, g, unknown or other
  modified_base (381)..(381): a, c, t, g, unknown or other
  modified_base (445)..(445): a, c, t, g, unknown or other
tcagtgatacgtctcacgaccggtgctcgatttagacgtctcatcaaggaaggaagggggggagaggagccccagccttgggattcccaagtgttttcattcagtgatcaggactgaacacagaggactcaccatggagtttgggctgagctggattttccttgctgcttattttaaaaggtgtccagtgtgaggtgcaactggtggagtcgtgggggagctcggtcaagccgtggggatcccttagactctcctgtgcaacctctggattcaatttcgacatcgcctggatgaggttcgggcccncgaggctccgagggaggctggagtgggtgacgtagttaaaagcgaagggtgcggtggaccagcagactagcttcngtccgagacgggcagatcagctattccagagacgatgacaagacagatagatagttattacganatagaacacgaactaaaagtcggaacaacacgacgtacccttaatactttctcgtcgttactttacgtactttcgacgtaaggtcgggtacgtccggttaccgggtttacggtcggttacgttaccggg

SEQ ID NO: 385118 - DNA, 563 bp, Homo sapiens
  misc_feature: GZ8MTXP02GOPJ4.9.31.C09.1.454.CMB.2.raw
  modified_base (300)..(300): a, c, t, g, unknown or other
  modified_base (332)..(332): a, c, t, g, unknown or other
  modified_base (377)..(377): a, c, t, g, unknown or other
tcagtgatacgtctcacgaccggtgctcgatttagacgtctcatcaaggaaggaaggggggagaggagccccagccttgggattcccaagtgttttcattcagtgatcaggactgaacacagaggactcaccatggagtttgggctgagctggattttccttgctgctattttaaaaggtgtccagtgtgaggtgcaactggtggagtcgtgggggaggctcggtcaagcctggggagtcccttagactctcctgtgcaacctctggattcaatttcgacatcgctggatgagtggcccncaggctcgagggaggctggagtgggtgacgtntaaagcgaagggtgcggtggaccagcagactacgcttcagtccgngaagggcagattcagctatttccagagacgatgacaagacagatagatgtattacagatagaacagaacctaaaagtcggaagacaacacgaccctaattactttctacgtccgttactttctactttcgcgtaaggtcgggtacggtccggttccgggtttacgggttccgggttacggtaccgg

SEQ ID NO: 385119 - DNA, 628 bp, Homo sapiens
  misc_feature: GZ8MTXP02G1Y3P.9.31.C09.1.454.CMB.2.raw
  modified_base (311)..(311): a, c, t, g, unknown or other
tcagtgatacgtctcacgaccggtgctcgatttagacgtctcatcaaggaaggaagggggggagaggagccccagccttgggattcccaagtgttttcattcagtgatcaggactgaacacagaggactcaccatggagtttgggctgagctggattttccttgctgcttattttaaaaggtgtccagtgtgaggtgcaactggtggagtcgtggggggaggctcgggtcaagccgtgggggactcccttagactctcctgtgcaacctctggattcaatttcgacatcgcctggatggaggttcggcccncgaggctccgaggggagggcgtggaggtgggttggacgttacgttaaaaggcgaaaggggtagcggggtggaccagcagactacgcttcacgttccggagaacggggcaggtattcgagtctatttacccagagacgatagacaaagacagatagatagttaattagagtatagaaacaacgtaaactaaaagtacggaacgaacaacgaacgtacccttaattactttctacggtcctttactttacgtacgtttccgacgtaaggtcgggtacgttccggtttaccgggtttacggtcgggttacgtttaccggg

SEQ ID NO: 385120 - DNA, 629 bp, Homo sapiens
  misc_feature: GZ8MTXP02G72M3.9.31.C09.1.454.CMB.2.raw
  modified_base (247)..(247): a, c, t, g, unknown or other
tcagtgatacgtctcacgaccggtgctcgatttagacgtctcatcaaggaaggaaggggggggtctcaggaggcagcgctctcgggacgtctccaccatggcctgggctctgctattcctcaccctcctcactcagggcacagggtcttgggcccagtctgccctgactcagcctgcctccgtgtctgggtctccgtggacagtcgatagccatcctcctgcactggaactaacagtgacgttggtntcttataattatgtctctgtatcaacaacaccaggacaaacgcccccaactcaattatttctgatgtacaaacaacgtcccggccccagggtactttctagactcgccttctcgtcggcctaccaagttctggaccaaacgaccggccctccctacgaccctatcctcgtcgggccgttccggggctggacggtaccggaggtcctacacttattactggacacgtctactaattaacaaccgaaaccacggaccaactacttcgttaggtttcggttaccgggaccgggtagggtacctacggaaacgtccggtaacccgtccgttaggtaacccgacggaccccgaacggcccgtacccgtcccccgtacggtaaccccg

SEQ ID NO: 385121 - DNA, 741 bp, Homo sapiens
  misc_feature: GZ8MTXP02FRNY3.9.31.C09.1.454.CMB.2.raw
  modified_base (332)..(332): a, c, t, g, unknown or other
tcagtgatacgtctcacgaccggtgctcgatttagacgtctcatcaaggaaggaagggggggagaggagccccagccttgggattcccaagtgttttcattcagtgatcaggactgaacacagaggactcaccatggagtttgggctgagctggattttccttgctgctattttaaaaggtgtccagtgtgaggtgcaacgtggtggagtcgtgggggagctcggtcaaggccgtggggactcccgttagacctctcctgtcgctaactctgagttacttactacgttacgaactcgtccgtcgtaggtagtaggtacgggtccgggccccncggacggtcccgtaccggggaagggggacgggtcggaggggttaggggttcggggttacgggtaaccgttaaacggttaaaacgacggggtaaaggggtacggtcggggtaaccggaacgacggacgaacgtaccgtaaccgttcgttacgacgtcggtaagggacgtacgtagtactacgactctttacccgagaaggacgagtaacgcgtaaacgaaagagagtgtacgttataagttaagagtagaataacgaaacgtaaacgtaaaacgtaacggacgaaaccaacgtacctaccgttaactttagttaccgttacgtccgttaccttacgttacgttacgtacggtaaggttacgggtacggtacccggtttccgggtttaccgggttacgggttacgtacggg

SEQ ID NO: 385122 - DNA, 566 bp, Homo sapiens
  misc_feature: GZ8MTXP02JDKBC.9.31.C09.1.454.CMB.2.raw
  modified_base (305)..(305): a, c, t, g, unknown or other
  modified_base (364)..(364): a, c, t, g, unknown or other
  modified_base (399)..(399): a, c, t, g, unknown or other
tcagtgatacgtctcacgaccggtgctcgatttagacgtctcatcaaggaaggaagggggggagaggagccccagccttgggattcccaagtgttttcattcagtgatcaggactgaacacagaggactcaccatggagtttgggctgagctggattttccttgctgctattttaaaaggtgtccagtgtgaggtgcaactggtggagtcgtgggggagctcgggtcaaggccgtggggacgtcccttagactctcctgtgcaacctctggattcaatttcgacatcgctggatgagtcggcccncaggctcgagggaggctggagtgggtgacgtactaaaagcgtaagggtgcggtaggacngcagactacgcttcagtccgtagacggcagacttnacgctacttaccagtacgacgagtacgacaagacagatagatagtattacagatagaaacagaaccgtaaaagtcgaacacaacacgtaccttatacttctacgtcttacttctacttcgacgtaaggtcggtacgtccgttacggtttacggtcggtacgtaccgg

SEQ ID NO: 385123 - DNA, 614 bp, Homo sapiens
  misc_feature: GZ8MTXP02JIMVP.9.31.C09.1.454.CMB.2.raw
  modified_base (300)..(300): a, c, t, g, unknown or other
tcagtgatacgtctcacgaccggtgctcgatttagacgtctcatcaaggaaggaagggggggagaggagccccagccttgggattcccaagtgttttcattcagtgatcaggactgaacacagaggactcaccatggagtttgggctgagctggattttcctgctgctatttaaaggtgtccagtgtgaggtgcaactggtggagtcgtgggggagctcggtcaagccgtggggactcccttagactctcctgtgcaacctctggattcaattcgacatcgcctggatgagttcggcccncaggctccggagggaacggggctggaggtgggttggacgtagtaaaagcgaaagggtgcggtggacccaggcagactacgcttcgacgtccgtaggaaacgggtccaggtactttacgagtactagtttaccagacgacgatcgacgaagacagatagtatgtaattacagtatagtaaacacgtaaccgtaaaacgtcgaaacgacgaactacgtacccctaattacttacgtactacgtttcttactacgtttcgtacgtaaggtacgggtacgtaccggttccggtttaacgggttcggtcgtttaccggg

SEQ ID NO: 385124 - DNA, 611 bp, Homo sapiens
  misc_feature: GZ8MTXP02FS3X7.9.31.C09.1.454.CMB.2.raw
  modified_base (249)..(249): a, c, t, g, unknown or other
  modified_base (297)..(297): a, c, t, g, unknown or other
  modified_base (328)..(328): a, c, t, g, unknown or other
  modified_base (368)..(368): a, c, t, g, unknown or other
tcagtgatacgtctcacgaccggtgctcgatttagacgtctcatcaaggaaggaaggggggagaggagcccagccttgggattcccaagtgttttcattcagtgatcaggactgaacacagaggactcaccatggagtttgggctgagctggattttcctgctgctatttaaaaggtgtcagtgtgaggtgcaagtggtggagtcgtgggggagctcggtcaagccgtggggagtccctagactctccngtgcaacctctggattcaatttcgacatcgctggatgagttcggcccncaggctcgagggaggctggagtggtgacgtntaaaagcgaaaggtgcggtggaccagcagactcgccttancgtccgtaggaacggcaggtacttcgagactatttaccgagagtacgatagacaaagacgtagagtagattgtaatttaacgagtatacgaaacgaagaaaccttaaaaagcgggaaactaacaaccaacgtacccttaataacgtttctacgttccgttactttactaactttccggagtaacgggtcgggtaacgtccggtttacccgggtttacggtaccgggttacgtttaacccgggg

SEQ ID NO: 385125 - DNA, 616 bp, Homo sapiens
  misc_feature: GZ8MTXP02G1AKQ.9.31.C09.1.454.CMB.2.raw
  modified_base (180)..(180): a, c, t, g, unknown or other
  modified_base (195)..(195): a, c, t, g, unknown or other
  modified_base (298)..(298): a, c, t, g, unknown or other
  modified_base (339)..(339): a, c, t, g, unknown or other
  modified_base (375)..(375): a, c, t, g, unknown or other
  modified_base (416)..(416): a, c, t, g, unknown or other
  modified_base (423)..(423): a, c, t, g, unknown or other
tcagtgatacgtctcacgaccggtgctcgatttagacgtctcatcaaggaaggaagggggggagaggagccccagccttgggattcccaagtgttttcattcagtgatcaggactgaacacagaggactcaccatggagtttgggctgagctggattttcctgctgctattttaaaaggngtccagtgtgaggtncaactggtgagtcgtgggggagctcggtcaaggccgtggggatcccttagactctcctgtcgacacctctggattcaattcgacatcgctgatgagtcggccncaggctccgaggggaggctggagtgggtgacgtagtaaagngaaagggtgcggtggaccagcaagtactacgctacntccggagaagggcagatcagcacgttccagacgtacgatanacgaaanacagatagattgtaaacttagagtataacggaaactaaacgaaaccgtaaaaggtacggaagaacccgacgaacgtaccccttaaagttcgttactacgtaccgttacgtttactacgtttccgacgttaagggtacgggtaccggttacccggttcgggtttaacccgggtccggtttacggtaacccgggg

SEQ ID NO: 385126 - DNA, 651 bp, Homo sapiens
  misc_feature: GZ8MTXP02H8T3M.9.31.C09.1.454.CMB.2.raw
  modified_base (234)..(234): a, c, t, g, unknown or other
tcagtgatacgtctcacgaccggtgctcgatttagacgtctcatcaaggaaggaaggggggggtctcaggaggcagcgctctcgggacgtctccaccatggcctgggctctgctattcctcaccctcctcactcagggcacagggtcttgggcccagtctgccctgactcagcctgcctccgtgtctggtctcctggacagtcgatagccatcctcctgcactggaaactaacngtgacgttggtgcttataattatgtctctggtatcaacaacacccaggaccaaacgacccccactctattatttctgatgtacaacaacgtcccggccccagggtactttctgtactcgtccttctctcggcctacagtctggaccaacgtaccggccctcccgtacgacctatccgtcgtcgggccgtccgggctaggaggacgaggtctcacgttacttactcgactacgctactacttaacaccgaaacacgaccgtacacgttcgtttcgttcggttaccggggacgggtacgggtaacgttaacggtaaccggttacgtaaccccggttacccgttaacgggtcccgaaacccggttacccggaaaacggtccccgttaccccggtaccccccgttccgggtttaacccccg

SEQ ID NO: 385127 - DNA, 718 bp, Homo sapiens
  misc_feature: GZ8MTXP02JZVJP.9.31.C09.1.454.CMB.2.raw
  modified_base (599)..(599): a, c, t, g, unknown or other
tcagtgatacgtctcacgaccggtgctcgatttagacgtctcatcaaggaaggaagggggggagaggagccccagccttgggattcccaagtgttttcattcagtgatcaggactgaacacagaggactcaccatggagtttgggctgagctggatttttccttgctgcttattttaaaaggtgtccagtgtgaggtgcaactggtggagtcgtgggggaggctcggtcaagccgtggggacgtcccttagactctcctgtcgctaacctctgattctaattcgacatcgctggatggagttcgggccccgccgaggccctccggaaggggacggggcgtggggtacggttaggggttcggaacgttaacgttaaaaaggcggtaaaggggtacggcggggtaggggaccgaggaccgaagtaaccgtacgtcttacgacgttaccggtaaggaaacggacaacgtatttacgacgtacctacgtttacccgaagtaacggaacgtatacggaacaaacgaacgaagagtagtaagttagttaaatttaacgaagtaataacgaaacgtaacgtaaaccgttaaaaacgacgggtaaanaacccgaactaaccgtaccttaacgttactttcgtacgtccgttcttactacgtttcgtacgtaaggtacgggtacggttccggtttaccgggtttacgggttcggtcggtttaccggg

SEQ ID NO: 385128 - DNA, 857 bp, Homo sapiens
  misc_feature: GZ8MTXP02I7Q74.9.31.C09.1.454.CMB.2.raw
tcagtgatacgtctcacgaccggtgctcgatttagacgtctcatcaaggaaggaagggggggagaggagccccagccttgggattcccaagtgttttcattcagtgatcaggactgaacacagaggactcaccatggagtttgggctgagctggattttccttgctgcttattttaaaaggtgtccagtgtgaggtgcaactggtggagtcgtgggggagcgtcggtcaagccgtgggggacgtcccttagactctcctgtgcaacctctgtattcaatttcgacatcgcctggatggaggttcgggccccgtaccgaggtcctaccgggaggggaacggggcgtggggaggttgggggttacggaccgtttacgtaaaaacggcggaaagggggttaggaccggggtaggggaaccaacggaccgaggaacccgttacggtccctttaacgaccggtttcccgggtaggggaaaacggggtcccgaaaggtactttaccgaagtaccgttacgtttacccgaagaacggtaaccgtaagtacggaacccgaaaggaaccgtaaggtaaagtaggttaaacgtttagtttaaacgtttaaaccggtaaggttaactaacggttaaaaacccgaaccggtaaaaacccgtttaaaaaacggtccggggtaaaaacaaccgaaaccgtaacccggttaccctttaaaatttaccgtttttaaccgtcgtttaaaccggtttcctttacccgtttaacgttttccccgggtaaggttaacggggttacgggggtaaccgttcccgggttttaacccgggggttttaaccggggttccgggtttacggttttacccggggg

SEQ ID NO: 385129 - DNA, 706 bp, Homo sapiens
  misc_feature: GZ8MTXP02IZWRO.9.31.C09.1.454.CMB.2.raw
  modified_base (244)..(244): a, c, t, g, unknown or other
  modified_base (258)..(258): a, c, t, g, unknown or other
  modified_base (383)..(383): a, c, t, g, unknown or other
tcagtgatacgtctcacgaccggtgctcgatttagacgtctcatcaaggaaggaaggggggggtctcaggaggcagcgctctcgggacgtctccaccatggcctgggctctgctattcctcaccctcctcactcaagggcacagggtcttgggcccagtctgccctgactcagcctgcctccgtgtcgtggtcctccgtggacagtcgatacgccatcctcctgccacgtaggtaaactaacgngttgacgtttggtnacttttaataatttagtcgttctccgtaggtactacaaacaacaccgaggaccaaaccgtccccccaataccatttcttcatatcgttacaaacgaacgtcccggacccctaagggtactttcgngtacttccgtaccctttcgtcgtcggaccttaccgaagttcctacgggacctaaaccgccggtccccttaccctacggaaaccctgttaccgtcgtccggggtccgttccggggacttaggggacggacggaaacccggttctaccgtagttacttacgacgtacgacttactactaacgtaaacctaacccgaacgtaccacgtaacttaccttcggtacggttcgggtacgggacgggtaacgacgtacgtaaccgttccggtaaccgtccgacggtccgtaaccgaccgtacggtaccctccccgtcccgttacgtaccg

SEQ ID NO: 385130 - DNA, 525 bp, Homo sapiens
  misc_feature: GZ8MTXP01EN71S.17.35.D02.1.454.CMB.2.raw
  modified_base (501)..(501): a, c, t, g, unknown or other
tcagcgtagactagcacgaccggtgctcgatttagcacacgatagttgggtttggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaaggtcctgatatatgagacttctactttagaaagtgggggtcccatcaaggttcagcggcagtggatctgggaacagaattcactctcactatcaccagcctgcaacctgatgtatttgctaacttattactggcccaaactagtatctaatccatcattagtaatttcgggtggtaacgggaccgaaagggtggaggtactaaacgaacgttgttaggntgcacccattcttgttctttaacc

SEQ ID NO: 385131 - DNA, 579 bp, Homo sapiens
  misc_feature: GZ8MTXP01D602T.17.35.D02.1.454.CMB.2.raw
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtagagacagagtcaccatcacttgccggcagtcagatatataggtgtgctggatcagcagaacaggaaagcccctaaggtcctgatatatgagacttctactttagaagtgggtcccatcaagttccagcgcagtgaatctgggacagaatcactctcactatcacagcctgcaacctgatgatttgactaaacttacttactacgtacctaaacctagtaactcctaatcctaattccgtaaatttaggttaaagttttccggggttaaggggtaacggggttaacccgtaaaggggttagggaaacgggttaacaaaaccgggttaacgttagggttaaggggacccttgggaccgtaaccccgttaattcccttggttttccc

SEQ ID NO: 385132 - DNA, 514 bp, Homo sapiens
  misc_feature: GZ8MTXP01CQBQ6.17.35.D02.1.454.CMB.2.raw
  modified_base (246)..(246): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggcagtcagatatataggtgtgctggancagcagaacagggaaagcccctaaggtcctgatatatgagacttctactttagaaagtggggtcccatcaaggttcagcggcagtggatcgtgggaacagaaattcactctacactatcacagcctgcaacctgatgtatttgctaacttattactggacaaactatatcatcatctatttgtaaagtttcgggtagggtaagggaccgaagggttggaggttacgaaacgaacgttgttgggaactggcaccattctgttcttaacc

SEQ ID NO: 385133 - DNA, 485 bp, Homo sapiens
  misc_feature: GZ8MTXP01EVVPT.17.35.D02.1.454.CMB.2.raw
  modified_base (438)..(438): a, c, t, g, unknown or other
  modified_base (471)..(471): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggcagtcagaatatataggtgtgctgatcagcagaaaccaggaaagcccctaaggtcctgatatatgagtacttctaactttagaagtgggtcccatcaagttccagcgcagtggaatctgggacagaattcactctcactatcaccagcctgcaaacctgatgatttgctaaacttattactgaccaaacagtatcatcatctattgtaattcgggngtagggacaaggttgaggtcaaacgcttggtgntgcacatcgttgtc

SEQ ID NO: 385134 - DNA, 525 bp, Homo sapiens
  misc_feature: GZ8MTXP01DXGFS.17.35.D02.1.454.CMB.2.raw
  modified_base (268)..(268): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggcagtcagaatataataggtgtgctgatcagcaagaaccaggaaancccctaaggtcctgatatatgagtacttactactttaagaaagtggggtacccatacaaggttccaggcggacagtggaatctgggacaagattcaactctacactatcaccagcctagacaaacctgatgtatttgactaaactttattacggtatacccaaatatactacatcaatctaagttagttaattcgggtaaggaggaccgtaaaggttggaaggtacaaaagacgttgtgcgtcgcacactcgttgtc

SEQ ID NO: 385135 - DNA, 513 bp, Homo sapiens
  misc_feature: GZ8MTXP01DGTPG.17.35.D02.1.454.CMB.2.raw
  modified_base (253)..(253): a, c, t, g, unknown or other
  modified_base (425)..(425): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtaggagacagagtcaccatcacttgccgggcagtcagaatattaataggtggtgctggtancagcagaaacagggaaacgcccctaaggtcctgatatatgagtacttctactttaggaaagtggggtaccatcaaggtcacgcggcagtgatcgtagggcagtaatcactctcactatcaccagcctgcctaaacctgattgtattttgactaaacttattactgacctaanagtatcatcatctattgtaattcgggtaggaaggacgaagggtggaggttacaaacgttacgttgttggctgcactattctgttcttc

SEQ ID NO: 385136 - DNA, 509 bp, Homo sapiens
  misc_feature: GZ8MTXP01EME6N.17.35.D02.1.454.CMB.2.raw
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggcagtcagaatataataggtgtgctggatcagcagaaaccagggaaagcccctaaggtcctgatatatgagacttctactttagaaagtgggtcccatcaaggttccagcggcagtggaatctgggacagaattcaactctcactatcaccagcctgcaaacctgatgatttgactaaacttattactgccaaacatatcaatcaatctaagttgtaaatttcggtggaagggaccaaagggttggaagggtacaaacggacttagtgggctgcaccatcttgttcc

SEQ ID NO: 385137 - DNA, 590 bp, Homo sapiens
  misc_feature: GZ8MTXP01DM3U6.17.35.D02.1.454.CMB.2.raw
  modified_base (197)..(197): a, c, t, g, unknown or other
  modified_base (250)..(250): a, c, t, g, unknown or other
  modified_base (337)..(337): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccggcagtcagaatattataggtggtgctggtancagcagaaaccagggaaagcccctaaggtcctagatatatgaagacttctactttagaaagtggggtacccatcaaggttcagcggnagtgatcgtgggaacagaattcactctcactatcacagctgacaactgattgtatttgactaaacttatttaacgtggaccctaaactattaataccattccaattaccgtaatttaggttaaagttttccggggtagggtaaacggggtaaccgttaaagggggttgggaaacggttaaccgaaaacggttaaacgttggttaacgggcccttaggaaccctaacccgtaattccttcggtttcctttaacc

SEQ ID NO: 385138 - DNA, 565 bp, Homo sapiens
  misc_feature: GZ8MTXP01AGGZ4.17.35.D02.1.454.CMB.2.raw
  modified_base (343)..(343): a, c, t, g, unknown or other
  modified_base (380)..(380): a, c, t, g, unknown or other
tcagcgtagactagcacgaccggtgctcgatttagcacacgatagtgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggcagtcagaatattaataggtggttggctggtatcagcaagaaaccagggaaacgcccctaaggtcctgatatatgagtacttctacgtttagaaagtcggggtaccagtcaaggttcagcggnagtgatcgtgggaacagaattcactctcactatcacngacctgacaactgatgtattttcgactaacttattactaggaccaaactagtaactcctaattcaacttacgtaatttggttaaacgtttcggggtaggggtaagggaaccgttaaaggggtgggaaacggttacgaaaacggttacgttggttcggaacgtgccaacctattctcgttctttcc

SEQ ID NO: 385139 - DNA, 502 bp, Homo sapiens
  misc_feature: GZ8MTXP01D26R1.17.35.D02.1.454.CMB.2.raw
  modified_base (244)..(245): a, c, t, g, unknown or other
  modified_base (247)..(248): a, c, t, g, unknown or other
  modified_base (260)..(260): a, c, t, g, unknown or other
  modified_base (321)..(321): a, c, t, g, unknown or other
  modified_base (356)..(356): a, c, t, g, unknown or other
  modified_base (382)..(382): a, c, t, g, unknown or other
  modified_base (395)..(395): a, c, t, g, unknown or other
  modified_base (402)..(402): a, c, t, g, unknown or other
  modified_base (407)..(407): a, c, t, g, unknown or other
tcagcgtagactagcacgaccggtgctcgatttagcacacgatagttgggtttgggggagtcagacccagtcaggacacagtatggacatgagggtccccgctcagctcctggggctcctgctgctctggctcccaggtgccagatgtgacatccagatgacccagtctccttccaccctgtctgcatctgtaggagacagagtcaccatcactgccggcagtcagaatatatagtgtgctgannannagaacaggaacncctaagtctgatatatgatacttatactttagaaagtgggtaccatcaaggtcagccgganagtgatcgtaaggacaagaattcactctacactancacagcctgacaactgaatgtatttnactaactattacnaccaaanatatnatcatgtattgtaagttggaggaggaactaagggttggtaacggttacaaaacgggtaattgggcgacgtcgactaactactcttcttcgttctc

SEQ ID NO: 385140 - DNA, 577 bp, Homo sapiens
  misc_feature: GZ8MTXP01C6S15.17.35.D02.1.454.CMB.2.raw
  modified_base (198)..(198): a, c, t, g, unknown or other
  modified_base (245)..(246): a, c, t, g, unknown or other
  modified_base (264)..(264): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttcaccctgtctgcatctgtagganacagagtcacatcacttgccggcagtcagaatatatggtgtgctgannagcaagaacagggaaacnccctaaggtcctgatatatgaagtactttctaactttaaggaaaggttcgggtacccatcgaaggttccaggtcggcaggtggaattcgtgggacaggtaaattcactctacactatcacagcctgacaactgatagtatttacgactaaactttacttactacgtacctaaacattactcaatcaattcgtaatttaggttaagtttcggggaaggtaacgggttaaccgtaaaggggttagggtaaacggttacgaaaaacggttcgttagggtcgggtacttcggacccaccttattccgttcgtttccc

SEQ ID NO: 385141 - DNA, 558 bp, Homo sapiens
  misc_feature: GZ8MTXP01EC6TC.17.35.D02.1.454.CMB.2.raw
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggcagtcagaatatataggtgtgctgatcagcagaacaggaaacgcccctaaggtcctgatatatgagtacttctactttaagaaagtgggtccatcaagttccagcgcagtggaatcgtgggacagaattcactctacactatcacctagcctgactaaacctgtaatgtatttcgacttaacttattactgacctaactatatactatactattctaattagttaaagtttcggggtaaggtaacggggaaccgtaaaggggttagggaaggttaacgaaaacggttacgttaggtaacggtccttaaggaccacccgttattcccgtttcgttcc

SEQ ID NO: 385142 - DNA, 516 bp, Homo sapiens
  misc_feature: GZ8MTXP01ARUWH.17.35.D02.1.454.CMB.2.raw
  modified_base (197)..(197): a, c, t, g, unknown or other
  modified_base (255)..(255): a, c, t, g, unknown or other
  modified_base (275)..(275): a, c, t, g, unknown or other
  modified_base (497)..(497): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccgggcagtcagaatattaataggtggttggcctggtancagcagaaaccagggaaacncccctaaggtcctgatatatgagacttctactttagaaagtggggtcccatcaaggttcagcggcaggtggatcgtgggaacaggaattcactctcactatcacagcctgcaacctgatgtattttgactaaatttattaactggaccaaactagtaatcatcattcagttgtaaatttcggtggaagggaccaagggtgaggtacaaacgacttggttagntagcacattcctgttcttc

SEQ ID NO: 385143 - DNA, 536 bp, Homo sapiens
  misc_feature: GZ8MTXP01C3AH1.17.35.D02.1.454.CMB.2.raw
  modified_base (197)..(197): a, c, t, g, unknown or other
  modified_base (247)..(247): a, c, t, g, unknown or other
  modified_base (264)..(264): a, c, t, g, unknown or other
  modified_base (290)..(290): a, c, t, g, unknown or other
  modified_base (386)..(386): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccggcagtcagaatataataggtgtgctgancagcagaacaggaaacnccctaagtcctgatatatgatacttntactttagaagtgggtccagtcagttcacgcggcagtggatcgtagggaacagtaattcactctacactatcacagctgacaactgtatgtatttnactaacttattactggaccctaatagtatcaatctatactatttagttaaacgtttcgggtaggtaacgggacgttaaaggggttaggaacggttaacgaaacggttaacgttgttacgggtctaggccaactattccgtttcgttcttc

SEQ ID NO: 385144 - DNA, 553 bp, Homo sapiens
  misc_feature: GZ8MTXP01BXWMD.17.35.D02.1.454.CMB.2.raw
  modified_base (237)..(237): a, c, t, g, unknown or other
  modified_base (252)..(252): a, c, t, g, unknown or other
  modified_base (272)..(272): a, c, t, g, unknown or other
  modified_base (292)..(292): a, c, t, g, unknown or other
  modified_base (344)..(344): a, c, t, g, unknown or other
  modified_base (391)..(391): a, c, t, g, unknown or other
  modified_base (404)..(404): a, c, t, g, unknown or other
  modified_base (413)..(413): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtaggagacagagtcaccatcacttgccggcagtcagaatattaanaggtggttgctggancagcagaaaccagggaaacncccctaaggtctagatatangagtacttctaactttaagaaaggtgggtacccaatcaaaggttcagcgganaggtcggatcgtagggcaagtaaattccactctacactatccacacncctagaccaactntatatattnacttaacttatactacgaactaatatatactatactatacgtattagttaagttcgggaggaacgggtaacgaagggtaggaacgtaacgtaaacgttaacgttggttacggtcgtcgaacgtacctattcttcgttctc

SEQ ID NO: 385145 - DNA, 601 bp, Homo sapiens
  misc_feature: GZ8MTXP01CE1AZ.17.35.D02.1.454.CMB.2.raw
  modified_base (255)..(255): a, c, t, g, unknown or other
  modified_base (275)..(275): a, c, t, g, unknown or other
  modified_base (295)..(295): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgctatcgtgtaggagacagagtcaccatcacttgccggcagtcagaatattaagtaggtggtggctgtancagcaagaaacgaggaaacnccccgtaaggtcagatatangtaagtacttcttaacgtttaaggaaaggttcggggtaccctaagtacgaaaggttcgaacggcggagtaggtggagtaccgtagggaactaagtaacttcactcactactactcaccagcctagacctaactagtattagtactttagacttaattacttacctaggaccctaagtatactcgaatctagttactagttagtaagttcgggagggtaacggtaacgttaaggggtaggttaacggtaactaaacgttacgttggttacggctacgcctacgtattccttaacgttccgtttaacc

SEQ ID NO: 385146 - DNA, 536 bp, Homo sapiens
  misc_feature: GZ8MTXP01DJDFB.17.35.D02.1.454.CMB.2.raw
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggctggtatcagcaagaaaccagggaaagcccctaaggtcctagatatatgagtacttactactttagaaagtggggtaccatcaaggttcagcggcagtggatctgggaacagaaattcactctcactatcacagctgcaactgatgtatttgactaacttattactggaccctaatagttatcatctatactatttgttaaattcgggtaggaacgggtaccgaagggtacgggaaggttacgaaacgaacgttgttacgggctggccaccattccttgttctttccg

SEQ ID NO: 385147 - DNA, 526 bp, Homo sapiens
  misc_feature: GZ8MTXP01DVQYC.17.35.D02.1.454.CMB.2.raw
  modified_base (247)..(247): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggcagtcagatatatagtgtgctgatnagcagaaaccaggaaacgccctaaggtcctgatatatgagacttctactttagaagtgggtccatcaagttcagcggcagtggaatctgggacagaattcactctcactatcacagctgcaactgatgtatttgactaactttattactcgaccaaactatatcatctaatctatttagtaagtttcgggtaaggtaacgggaccgtaaagggttaggtaagggttaacgaaaacggttacgttggtaagggccttggccaccttattcgttgtttccc

SEQ ID NO: 385148 - DNA, 514 bp, Homo sapiens
  misc_feature: GZ8MTXP01BBG61.17.35.D02.1.454.CMB.2.raw
  modified_base (253)..(253): a, c, t, g, unknown or other
  modified_base (391)..(391): a, c, t, g, unknown or other
  modified_base (416)..(416): a, c, t, g, unknown or other
tcagcgtagactagcacgaccggtgctcgatttagcacacgatagttgggtttggggagtcagacccagtcaggacacagcatggacatgagggtccccgctcagctcctggggctcctgctgctctggctcccaggtgccagatggtgacgatccgagatgacccagtctccttccaccctgtctgcatctgtaggagacagagtcaccatcacttgccggcagtcagaatattaataggtggtgctggtancagcagaaacagggaaagcccctaaggtcctgatatatgagacttctactttagaagtggggtccatcaaggttcacgcggcagtggatcgtgggcagaattcactctcactatcacagcctgcaactgattgatttnactaacttatacacgacaatatacnctatctatactattagtaagttcgggagggtaaggtaacgagggtaggaggtaacgaacgttacgttggttacggctgctactacttcgtcgttcgtc

SEQ ID NO: 385149 - DNA, 494 bp, Homo sapiens
  misc_feature: GZ8MTXP01C5TNG.17.35.D02.1.454.CMB.2.raw
  modified_base (195)..(195): a, c, t, g, unknown or other
  modified_base (250)..(250): a, c, t, g, unknown or other
  modified_base (268)..(268): a, c, t, g, unknown or other
  modified_base (474)..(474): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctccaggtgccagatgtgacatccagatgacccagtctccttccacctgtctgcatctgtagganacagagtcaccatcacttgccgggcagtcagaatattaataggtggtgctggtancagcagaaacagggaaancccctaagtcctagatatatgagtacttctactttagaaagtggggtaccatcagttcacgcggcagtgatcgtgggaacagaatcactctcactatcaccagcctgcaactgatgtatttagctaacttattactaggacctaaacagtatcatcatctattgtaattcggtggaagggaacagggtggaggtacaaagacttgngctgcacgattctgttcttc

SEQ ID NO: 385150 - DNA, 507 bp, Homo sapiens
  misc_feature: GZ8MTXP01BMCVE.17.35.D02.1.454.CMB.2.raw
  modified_base (450)..(450): a, c, t, g, unknown or other
  modified_base (472)..(472): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggcagtcagaatattaataggtggttggctggtatcagcagaaacagggaaagcccctaaggtcctgatatatgagtacttctactttagaaagtcgggggtacccatcgaaaggttcagcggcagtggatcgtgggcagtaattcactctcactatcacagcctgacaacctgacttgtattttgactaacttattactgacaatagtatcatcatcattgtaattcggnggaagggacgagggtggagtanaacgacgttgttaggctgcacattcgtcgttcttc

SEQ ID NO: 385151 - DNA, 636 bp, Homo sapiens
  misc_feature: GZ8MTXP01BKOYX.17.35.D02.1.454.CMB.2.raw
  modified_base (200)..(200): a, c, t, g, unknown or other
  modified_base (440)..(440): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtcctccttccaccctgtctgcatctgtagganacagagtcaccatcacttgccgggcagtcagaatattaataggtggttggctggatcagcaagaaaccaggaaacgacccgtacgtacgtcgtagtatatagtagtacgttacttactttaagttaaaggtagggttccggtaactacgtaacggttaccggtacgcggtacgacgtaggtaacgtactcgggacgaaacgaagttactacctactctactactacaccacgtctccganaaacccctgtagtagtagtttacttacaacctttaactttacgtacgtaaccctaccaaagttacttacactactagttaccttattagttaacgtttgggtaacgggtaaggggaccgggtaaacgttagggggtaacggtacgttaaaccgaaacgttcggtgggtctcggcacccttaagttcttaacgttcc

SEQ ID NO: 385152 - DNA, 507 bp, Homo sapiens
  misc_feature: GZ8MTXP01BL6O9.17.35.D02.1.454.CMB.2.raw
  modified_base (197)..(197): a, c, t, g, unknown or other
  modified_base (250)..(250): a, c, t, g, unknown or other
  modified_base (298)..(298): a, c, t, g, unknown or other
  modified_base (335)..(335): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccggcagtcagaatatataggtggtggctggtancagcagaaaccagggaaagcccctaaaggtcctgatatatgagacttntactttagaaagtggggtcccatcaaggttcagcggnagtggatctgggcagaattcactctcactatcaccagctgcaacctgatgtatttgcaacttatactggacccaatatatcatcatacgattgtaattcggtgggaagggtaccgaagggtaggaggtacgtaaacgacgttggttggcttggccaccattccttgttcttc

SEQ ID NO: 385153 - DNA, 618 bp, Homo sapiens
  misc_feature: GZ8MTXP01D3ZC8.17.35.D02.1.454.CMB.2.raw
  modified_base (191)..(191): a, c, t, g, unknown or other
  modified_base (199)..(199): a, c, t, g, unknown or other
  modified_base (268)..(268): a, c, t, g, unknown or other
  modified_base (270)..(270): a, c, t, g, unknown or other
  modified_base (420)..(420): a, c, t, g, unknown or other
  modified_base (518)..(518): a, c, t, g, unknown or other
  modified_base (593)..(593): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatntaggaganacagactacactatctacgttcggccggactagtacaagtaattaataagtgggtggttcgctaggtananagacaaacgaaaccgaagggaacctacccgtaaggtctagtaataatagtagtacttactttacgttaacgtttaaaggaacggggttccggtaccctaagtacggtaacggttacgacgggcgagtaggtagtaacttggaaggggaanaaaggttactactactctaactaacttacaccacggactctacacctaactgtatgttattacaacttaattacttacgtacaacctaaatacttaanactatatagtatagttagttacggtagggaaggtaacgggagtagggttaggaacgtaacgaaacgttcgttggngctaacgactacttattcgttcgtc

SEQ ID NO: 385154 - DNA, 623 bp, Homo sapiens
  misc_feature: GZ8MTXP01BSDO0.17.35.D02.1.454.CMB.2.raw
  modified_base (198)..(198): a, c, t, g, unknown or other
  modified_base (252)..(252): a, c, t, g, unknown or other
  modified_base (360)..(360): a, c, t, g, unknown or other
  modified_base (603)..(603): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtagganacagagtcaccatcacttgccggcagtcagaatattaagaggtggtgctggtancagacaagaaaccgagggaaacgccccgtaaggtcctagatatagtgagtacttactacgtttaagaaaggttcgggtacccagttacgaaaggttcgaacgcggganaggtgagtcgtagggaacagtaaacttcactctacactactcaacagtcctcgacaacctagtattagtattttacgacttaaactttagttactacggtaactaactaattactacaattccgtaattaccttaagtttaggtttaaagttccgggtaagggaacgggttaaaccggagggttacggaaaggtaaccgtaaaacggttaacgttcggttaggtaactacgaactaaaccgtnttccttcgttccgtttaacc

SEQ ID NO: 385155 - DNA, 767 bp, Homo sapiens
  misc_feature: GZ8MTXP01AJLUM.17.35.D02.1.454.CMB.2.raw
  modified_base (197)..(197): a, c, t, g, unknown or other
  modified_base (245)..(246): a, c, t, g, unknown or other
  modified_base (281)..(281): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcacatcacttgccggcagtcagatatataggtgtgctgtannagcagaacaggaaacgccctaaggtcctgatatangagtacttactactttagaaaggttcggggtaccctagtacgtaaaggttccgaggccggacagggtgggataccgtaggggaaccaagtaaacttccaaccttacctactaacttaactaccctaacccgacggtacccttacggaaccctaaacccttagggtaaactttcggtttaacgtttttacggtaaccttaaaactttttacgtttaacccttacggggtaacccctaaaacggttacgtttaaacctactaacgttaccctaggtttaaccttaaagttttagggtttaaacgggtttttaccgggggttaaggggggtaaaaccgggggttaaacccgggttaaaaggggggggttaccgggttaaacggggttaaacccgtaaaaaacccggggttaacgttggggttacgggggtaacttacgggaacccttaaacccggtcttaacgttttccggttaaccttttaaccccgg

SEQ ID NO: 385156 - DNA, 608 bp, Homo sapiens
  misc_feature: GZ8MTXP01B0K5P.17.35.D02.1.454.CMB.2.raw
  modified_base (248)..(249): a, c, t, g, unknown or other
  modified_base (265)..(265): a, c, t, g, unknown or other
  modified_base (596)..(596): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccacctgtctgcatctgtaggagacagagtcacatcacttgccggccagtcagtaatatataggtgtgctgannagcaagaacaggaacnccccgtaaggcctagatatatgagtacttctaacgtttaagaaacggttgggtacccagtacgtaaggttccgaggcggcgtaggtggaattcgtgggaactagtaacttcactctcaacttatccaacctacgcctcgactaacctgtaattgtatttcgaacttaactttaacttacgtacgtaacctaactacgtaataccaattactaaacttcgttaaacgttttaggttaaacgttttcgggggaaggtaacggggttaacgtaaagggttggggtaaacggtaacgttaaaacggttacgttggttggcctcggaccaccgttnttccgttcgttc

SEQ ID NO: 385157 - DNA, 589 bp, Homo sapiens
  misc_feature: GZ8MTXP01A6W7T.17.35.D02.1.454.CMB.2.raw
  modified_base (253)..(253): a, c, t, g, unknown or other
  modified_base (274)..(274): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggcagtcagaatattaagtaggtggttgctggtancagcagaaaccgagggaaacncccctaaggtcctagatatatgagtactttactaacgtttaaggaaacggttcgggggtaccccaagtaccgtaaagggtttccaacggccggggactaagggtgggaattaccggtagggggaactaaggtaaactttccaaccttcctacaactactaccaccagccctgacctaacctgattgtatttgactaacttattactggacctaaatatatcatctagtctagtttgttaagtttcgggagggaacggtacgagggtaggaggtaacgaaacgttacgttggttggctgcacctattctgttcttc

SEQ ID NO: 385158 - DNA, 566 bp, Homo sapiens
  misc_feature: GZ8MTXP01C6931.17.35.D02.1.454.CMB.2.raw
  modified_base (251)..(251): a, c, t, g, unknown or other
tcagcgtagactagcacgaccggtgctcgatttagcacacgatagttgggtttggggagtcagacccagtcaggacacagcatggacatgagggtccccgctcagctcctggggctcctgctgctctggctcccaggtgccagatgtgacatccagatgacccagtcctccttccaccctgtctgcatctgtaggagacagagtcaccatcacttgccggcagtcagaatattaataggtggtgctggtancagcagaaaccagggaaacgcccctaaggtcctgatatatgaagacttctatttagaaagtggggtaccatcaagttcagcggcagtgatcgtagggcagaattcactctcactatcacagcctgcaacctgactgtatttgactaacttattactggacctaactagtatacatcatacgtattagttaagttacgggttgggaaacggtaaccgaaaggggttggttaaacgggtaacgtaaaaccggttaaacgttggttaacggtccgttaggaacctaacccgtaattccgttcggttccttttaacccg

SEQ ID NO: 385159 - DNA, 687 bp, Homo sapiens
  misc_feature: GZ8MTXP01EO69H.17.35.D02.1.454.CMB.2.raw
  modified_base (199)..(199): a, c, t, g, unknown or other
  modified_base (251)..(251): a, c, t, g, unknown or other
  modified_base (271)..(271): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatcgacccagtcctccttccaccctgtctgcatctgtagganacagatcacatcacgttgccggcagtcaagaatattagaggtggtgctggancagacaagaaacgaggaacncccgtaagtcagactatatagagtacttacttaacgtttaaggaaacggttcgggtacccagtacgaaaggttcgacggcggtacaggtgactacggtagggaactagtaaacttcctactcctactaactactaccaacctacgtacctacgacctaacgttagtaatttacggttactttagtaaacccttaatttaactttaaccgacgtaactaaacgttactacttacaacttaccgtactttaacttaagtttacggttaacggtttcggggaaggggtaaacggggtaaacggttaaaggggttaacggggttaaaaccgttaacgggtaaaaacggttacgggttcggttacggggttaaccctacggaacctaacccttaggttacccttcggttttccttaacccg

SEQ ID NO: 385160 - DNA, 586 bp, Homo sapiens
  misc_feature: GZ8MTXP01DNJRV.17.35.D02.1.454.CMB.2.raw
  modified_base (197)..(197): a, c, t, g, unknown or other
  modified_base (235)..(235): a, c, t, g, unknown or other
  modified_base (249)..(249): a, c, t, g, unknown or other
  modified_base (269)..(269): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccggcagtcagaatattanaggtggtgctgtancagcaagaaacagggaaacncccctaaggtcctgatatatgaagtacttactaacgtttaagaaaggtcggggtaccctaagtacgaaaggttcaacggcggacaggtggatacgtagggaacaagtaacttcactctacacttacacaccagcctagacctaacctgtattagtatttacgacttaaacttagttactaggacctaaactattactctaatctagttacttagttagttaacgtttgggtagggtaacgggtaacgttaaggggtaggaacggtaaacgaaacgttacgttggttacggctagccactagttcttcgttcttaacc

SEQ ID NO: 385161 - DNA, 754 bp, Homo sapiens
  misc_feature: GZ8MTXP01D961N.17.35.D02.1.454.CMB.2.raw
  modified_base (198)..(198): a, c, t, g, unknown or other
  modified_base (252)..(252): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtagganacagagtcacatcacttgccggcagtcagaatattagtaggtggttgctggtancagcaagaaacaggaaacgcccctaaggtcctagatatagtgtaacgtactttacgtaacgtttaagaaaggttcgggggtaccctagttacgtaaaggtttcaacggcgggtacgtaggttacggaacgttaccgtaggggaactaaaggtaaactttaccgtaccttaccttaccctaacttaactaccctaaacccgtaacggtaccccttacggaaaccctaaacccgttagtaaccgtttacgtttaagtttttaacggaccttaaaaccttttaactttaacccgttaccggggaaaccccgttaaaacgtaagttaacctttaacctaaacttaccctaaagtttaccttaagttttaaggtttaaacggttttacgggtgggggtaaaacgggtaacccggttaaagggggttcggttaaacggttaaccgaaacgttaaccgttggttacgtcgtacgaacgtaccctagttccttaacggttctttaacccg

SEQ ID NO: 385162 - DNA, 634 bp, Homo sapiens
  misc_feature: GZ8MTXP01BT97K.17.35.D02.1.454.CMB.2.raw
  modified_base (248)..(248): a, c, t, g, unknown or other
  modified_base (267)..(267): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgttctggctcccaggtgccagatgtgacatccagatgacccagtctccttccaccctgtctgcatctgtaggagacagagtcacatcacttgccggcagtcagatatataggtgtgctggtancagcagaaacagggaaacnccccgtaaggtcctagatatatgagtacttctactttagaaagtcggggtacccatcgaaaggttcacgcggcaggtgagtacgtgggaacagtaacttcactctacactatccacacgcctgccaacctgattgtatttgactaacttattaccttcggacctaactagttactactactactaattaccttaagttttacggtttaaacgttttcgggggtaacgggggtaaacggggtaaacccggttaaagggggttacggggttaaacgggttaaacccgtaaaacgggttaaacggtttcggttacggggtaaccttacgggaaccctaaccccggtattccgttcgtttcctttaacccg

SEQ ID NO: 385163 - DNA, 594 bp, Homo sapiens
  misc_feature: GZ8MTXP01DX8RN.17.35.D02.1.454.CMB.2.raw
  modified_base (197)..(197): a, c, t, g, unknown or other
  modified_base (251)..(251): a, c, t, g, unknown or other
  modified_base (402)..(402): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccggcagtcagaatattaataggtggtgctggtancagcagaaaccaggaaacgcccctaaggtcctagatatatgaagtacttactaactttaaggaaaaggtcgggggtacccagtacgtaaaggttcacggcggcagtgatcgtagggaacagtaaattcactctacactactcaccagcctnacaacctgattgtatttgactaattatactaggacaacatatacatcattacgtattagttaaagtttcggggtaggtaacggggtaaccgttaaaggggtaggttaaacggttaaccgaaaacggttaaccgttggttacgggaacttacggaaccgtaaccctagttccgttaacgttaacgtttaaccc

SEQ ID NO: 385164 - DNA, 542 bp, Homo sapiens
  misc_feature: GZ8MTXP01C5UH2.17.35.D02.1.454.CMB.2.raw
  modified_base (250)..(250): a, c, t, g, unknown or other
  modified_base (267)..(267): a, c, t, g, unknown or other
  modified_base (333)..(333): a, c, t, g, unknown or other
  modified_base (373)..(373): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtaggagacagagtcaccatcacttgccggcagtcagaatataataggtgtgctggtancagcagaaacaggaaancccctaagtcctagatatatgagtacttctactttagaaagtgggtaccatcaaggttcacgcggnagtgatcgtgggaacagaattcactctacactatcaaccngcctgccaactgatgtatttgactaacttattactgaccaacgattatcatcagttctatttgttaaatttcggggtgggaacggggtaacaaggggttgggaaaggttaccgaaacggttaacgttggttacgggcttggaacctaccattccgttgttcctttaacc

SEQ ID NO: 385165 - DNA, 729 bp, Homo sapiens
  misc_feature: GZ8MTXP01DLOXH.17.35.D02.1.454.CMB.2.raw
  modified_base (198)..(198): a, c, t, g, unknown or other
  modified_base (249)..(249): a, c, t, g, unknown or other
  modified_base (269)..(269): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtagganacagagtcaccatcacttgccggcagtcagaatattataggtgtgctgtancagcagaaaccagggaaacnccccgtaaggtcctagatatatgaagtactttactaacgtttaaggaaacggttcgggggtaccctaagtacgaaaggttcaacggtcggacgtaggtaggaacttaccggtagggaacctaaggtaaacttcctaaccttcctactaacttaactacccaaccctaacggtcccttacggaacccttaaacccgtaggtaactttagggttaaactttttacggaacccttaaaacgttttaactttaaacccttacggggtaaacccctaaaagtaacgttaaactacctaacttaccgtaatttaccgttaagtttagtttaaacggtttccggggtaaggggaaacgggtaaccggttaaaggggttacgggaaacgggttaaccgtaaaacggttaaccgttgggttacggtaaccgttgaaccctacctacttcgtaacgtttcgtttaacccg

SEQ ID NO: 385166 - DNA, 571 bp, Homo sapiens
  misc_feature: GZ8MTXP01DQ53E.17.35.D02.1.454.CMB.2.raw
  modified_base (276)..(276): a, c, t, g, unknown or other
  modified_base (421)..(421): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggcagtcagaatattaataggtggttggcctggatcagcaagaaaccagggaaacncccctaaggtcctgatatatagagtactttactactttaagaaaggttggggtacccagtcaaggttccaggcggcgagtggaactctggggaacagtaaattcactctcactatcaccagtcctgacaaacctgatgtatttanactaacttattacggtcacaaactataatcatcaattgtaattgttaaactttgggtaagggacggaaacgtaaggggttagggtaaacgtacgaaaacgttcgttaggttaacgggaccttaagcctaaacccgttacttcgttcgttc

SEQ ID NO: 385167 - DNA, 541 bp, Homo sapiens
  misc_feature: GZ8MTXP01DXZZ4.17.35.D02.1.454.CMB.2.raw
  modified_base (198)..(198): a, c, t, g, unknown or other
  modified_base (252)..(252): a, c, t, g, unknown or other
  modified_base (407)..(407): a, c, t, g, unknown or other
  modified_base (460)..(460): a, c, t, g, unknown or other
  modified_base (530)..(530): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtagganacagagtcaccatcacttgccggcagtcagaatattaagtaggtgtgctggtancagacaagaaaccgagggaaacgcccctaaggtcctagactatatgtagtactttcttaacgtttaagaaaggtcgggtaccctagtcgaaaggttcaacggcggactaggtggtatcgtagggaacaagtaacttcactctcaactactccacngcctgaccaactgtatgtatttgactaatttactactaggacaactatactanatcattacgtattgtagttcggagggaacgaacgagggtagacgtaataacgagttgttaggctgctacngttctgttctc

SEQ ID NO: 385168 - DNA, 671 bp, Homo sapiens
  misc_feature: GZ8MTXP01A9XL2.17.35.D02.1.454.CMB.2.raw
  modified_base (201)..(201): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatcgacccagtcctccttccaccctgtctgcatctgtagganacagagtcacatcacttgccggcagtcaagtaatataagtggtggtgctggatcgagacaagaaaccgaggaaacgccccgtaaggtcctagatatatagaacgtactttacttaacgtttaaggaaacggttcgggtacccaagtacgtaaggttccaggcggctaggtgaatcgtgggaactaaggtaacttccgactactacgtaactactaccaaccgacgtaccctacgtaaccctaacccgtagtaaccttagttaacgttttacgaacctttaaactttaactttaaccggtacgtaaccctaaacgtacggttaatacctaagttactaaacttcttaagtttaggttaaacggtttcggggtaaacggggttaacggggaaaccgtaaaggggttacggtaaacggtacgaaaacgttcgttaggtaacgtccgtgaccctacgacgttcttcgtttaacc

SEQ ID NO: 385169 - DNA, 609 bp, Homo sapiens
  misc_feature: GZ8MTXP01CMSAV.17.35.D02.1.454.CMB.2.raw
  modified_base (197)..(197): a, c, t, g, unknown or other
  modified_base (250)..(251): a, c, t, g, unknown or other
  modified_base (269)..(269): a, c, t, g, unknown or other
  modified_base (298)..(298): a, c, t, g, unknown or other
  modified_base (370)..(370): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccggcagtcagaatattataggtggtgctggtannagcagaaacagggaaacncccctaaggtccagatatatgagtacttntaactttaggaaaggtggggtaccatcaaggttcacgcggcaggtgagtcgtagggaacagtaattcactcncactatccacagcctgacaactgacttagtattttcgactaactttattacttacggacctaaacgtattaactactaatacctagttaacctaattttagttaaggtttccggggaggggtaaacggggtaaccgttaagggggttacggggaaaggtaaaccgtaaaacgggttaacgttagggttcgggaaccttacgggaaccgtaacgtacttacgttcgtttccgtttaaccc

SEQ ID NO: 385170 - DNA, 553 bp, Homo sapiens
  misc_feature: GZ8MTXP01BR3FW.17.35.D02.1.454.CMB.2.raw
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtaggagacagagtcaccatcacttgccgggcagtcagaatattaagtaggtggttggcctggtatcagcaagaaaccagggaaacgcccctaaggtcctagatatatgagtactttctactttaggaaagttgggggtcccatcgaaggttcaggcggcaggtggatcgtagggaactagaaattcactctacactactccacacgcctgacaacctgatgtatttgactaacttattactgacctaatagtatcatctatctatttgtaatttcggggtggaacgggacgttaaaggggtcggaaggtaccgaaaacgttacgttggttcggctggccacctattccgttgttcttaacc

SEQ ID NO: 385171 - DNA, 564 bp, Homo sapiens
  misc_feature: GZ8MTXP01AZ9ME.17.35.D02.1.454.CMB.2.raw
  modified_base (200)..(200): a, c, t, g, unknown or other
  modified_base (251)..(251): a, c, t, g, unknown or other
  modified_base (271)..(271): a, c, t, g, unknown or other
  modified_base (345)..(345): a, c, t, g, unknown or other
  modified_base (356)..(356): a, c, t, g, unknown or other
  modified_base (391)..(391): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatcgacccagtcctccttccacctgtctgcatctgtagganacagagtcaccatcacttgccggcagtcagaatataatggtggtgctggancagacaagaaccgaggaacncccgtaaggcctagatatatgagtactttctaacgtttaagaaacggtcggtacccattcgaaggttcagcggnaggtgaatcgnggacagtatcacgtctacactatcgaccagcctanacaaccgtgattgtaatttcactaaactttatacgtcacctaactagtatactatacgtactgtatttagtaagtttcggggaagggaacgggttaaacgaaggggttacggtaacggtaacgaaacggttagttcggtaacgggcttcgacctaaccttcgttccgttcgtc

SEQ ID NO: 385172 - DNA, 571 bp, Homo sapiens
  misc_feature: GZ8MTXP01CFKSX.17.35.D02.1.454.CMB.2.raw
  modified_base (197)..(197): a, c, t, g, unknown or other
  modified_base (250)..(250): a, c, t, g, unknown or other
  modified_base (271)..(271): a, c, t, g, unknown or other
  modified_base (351)..(351): a, c, t, g, unknown or other
  modified_base (389)..(389): a, c, t, g, unknown or other
  modified_base (393)..(393): a, c, t, g, unknown or other
  modified_base (404)..(404): a, c, t, g, unknown or other
  modified_base (429)..(429): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccacctgtctgcatctgtagganacagatcacatcacgttgccggcagtcagaatattaagtaggtggtgctgtancagcaagaaacgagggaaacncccgtaagtctagatatatagagtacttacgttatttaaggaaaggttcgggtacctagtacgtaaggttcacggcgganaggtgagtacgtaggaacagtaactcactctacactancacngctagcaactnactgtatttgactaacttattacgngtacctaaagtatactctatctaattacgtagtttagttaacggtttcgggagggtaacggtaacgttaaggggtacggaaacgggtaaacaacggttagttggcggtctacgaacctaacctgttacttcgttccttaacg

SEQ ID NO: 385173 - DNA, 662 bp, Homo sapiens
  misc_feature: GZ8MTXP01AC69V.17.35.D02.1.454.CMB.2.raw
  modified_base (248)..(248): a, c, t, g, unknown or other
  modified_base (265)..(265): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggcagtcagaatatataggtgttgctgtancagcagaacaggaaacnccctaagtctgatatatgagtacttactactttaaggaaagtcgggggtaccctaagtcgtaaaggtttcgaacggcgggacaggtggatacggttaggggaactaggtaaactttcacttctacacttaactaccacctaaggtccctagacctaacctggtaattaggttaattttacgaccttaaactttactttaaccgacgggtaaccctaaacgtagtaacttacctaatacctacggttacttattttaagggtttaacgtttcggggtagggaaacgggggtaacccgttaaagggggtacggttaaacgggtaacgtaaaacccggttacgttcgggttagggttaacctacggaacccttacccaagttcgttcgttaaccctttcg

SEQ ID NO: 385174 - DNA, 491 bp, Homo sapiens
  misc_feature: GZ8MTXP01AESDB.17.35.D02.1.454.CMB.2.raw
  modified_base (479)..(479): a, c, t, g, unknown or other
  modified_base (487)..(487): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccaggtctccttccaccctgtctgcatctgtaggagacagagtcaccatcacttgccggccagtcagaatataataggtgtgctggatcagcagaaaccagggaaagcccctaaggtcctgatatatgagacttctactttagaaagtgggtacccatcaaggttccagcgcagtgaatctgggacagaattcactctcactatcaccagcctgcaacctgattgatttgctaacttattactgaccaacagtatcatcaatcgtattgtaattcggtgggaggacaaggttggagtacaaagacttgtggctgnaccattcngttc

SEQ ID NO: 385175 - DNA, 529 bp, Homo sapiens
  misc_feature: GZ8MTXP01BZX6M.17.35.D02.1.454.CMB.2.raw
  modified_base (453)..(453): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggcagtcagaatatataggtgtgctgatcagcagaaaccagggaaagcccctaaggtcctgatatatgagacttctactttagaaagtgggtacccatcaaggttcagcggcagtggaatcgtgggacagaaattcactctcactatcaccagcctgcaaacctgaatgatttgacaactttattactcgaccaaacagtaatcattcaatctagttagttaaatttcgggnggtaacgggaccgtaaagggttggaaagggtacaaaacggaacttggttaaggctggacaccttatccttgttaac

SEQ ID NO: 385176 - DNA, 655 bp, Homo sapiens
  misc_feature: GZ8MTXP01B0YGI.17.35.D02.1.454.CMB.2.raw
  modified_base (199)..(199): a, c, t, g, unknown or other
  modified_base (246)..(246): a, c, t, g, unknown or other
  modified_base (248)..(248): a, c, t, g, unknown or other
  modified_base (263)..(263): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcacatcacttgccggcagtcagaatatataggtgtgctgntnagcagaacaggaacnccctagtcctgatatatgagtacttctaactttaaggaaaggtcgggtaccctagtacgaaaggttccgaggcggtcgtaggtggaactcgtgggacaggtaacttccactctacaacttctaccaccgagcccttacgaccctaaaccgttggtaacttggttacttttacgaaccttaaacttttaacttaaccgtacgtaaccctaaagtacttaactactataccgtaattccgtaagtttacgttaacggttttccgggggtaaggggtaacggggttaaacccggtaaagggggttcgggtaaacgggttaaccggaaaaccggttaacggttcgggtcgggtaccgttcggaccctaccgttactttccgtttaacggtttcccc

SEQ ID NO: 385177 - DNA, 654 bp, Homo sapiens
  misc_feature: GZ8MTXP01AVPZL.17.35.D02.1.454.CMB.2.raw
  modified_base (198)..(198): a, c, t, g, unknown or other
  modified_base (250)..(250): a, c, t, g, unknown or other
tcagcgtagactagcacgaccggtgctcgatttagcacacgatagttggggtttgggggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcacatcacttgccggcagtcagaatattaataggtggtgctgtancagacaagaaacgaggaaacgaccctaagtccagatatatgaagtactttactaacgtttaaggaaaggtcgggggtaccctaagtacgtaaaggttcacggcggacgaggtaggatacgtaggggaacaagtaaacttccaactcctacaactactaccaaccacgtacctgaacctaaccgtagtaattgttaattttacgaccttaaacctttattaaccgtacgtaaaccctaaagtaacttaatacctaatctaattacgttaagtttaaggttaacggttttacggggaggggaaacggggtaaccgttaaagggggttaggaaacggttaaacgaaaacggttacgttgggttacgtaacgcgtaacctaccctagttccttaacgttccttaaccg

SEQ ID NO: 385178 - DNA, 634 bp, Homo sapiens
  misc_feature: GZ8MTXP01C6YHU.17.35.D02.1.454.CMB.2.raw
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtcctccttccaccctgtctgcatctgtaggagacagacgtcaccatcacttcgccgggccagtcaagtaattattaagtaggtggttgctggatcagacaagaaaccgaggaaacgcccctaaggtctagatatatagaagtactttactaactttaaggaaaggttcgggtacccaagtacgaaggttccgaaggcggagtaggtggaattcggtgggaacaagtaaacttcaacttctacaactactacgaccactcctagaccaaactgtattgttatttacaacttaaacttattacgtactaaccctaaatattactacattactagttacttaagtttacggttaaacgtttggggtaagggtaacgggaaccgtaaagggttacggtaaacggtaacgaaaaccggttacgttgggtaaggtccgtaacgacccgttaaccgttacttcgttcgtaacc

SEQ ID NO: 385179 - DNA, 502 bp, Homo sapiens
  misc_feature: GZ8MTXP01DQGT4.17.35.D02.1.454.CMB.2.raw
  modified_base (196)..(196): a, c, t, g, unknown or other
  modified_base (419)..(419): a, c, t, g, unknown or other
  modified_base (445)..(445): a, c, t, g, unknown or other
tcagcgtagactagcacgaccggtgctcgatttagcacacgatagttgggtttggggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccgggccagtcagaatattaataggtggtggctggtatcagcagaaaccagggaaagcccctaaggtcctgatatatgagtacttctactttagaaagtgggtacccatcaaggttcagcggcagtggatcgtagggaacagaattcactctcactatcacagctgcaactgatgatttgactaacttattactgaccctaaanagtatcatcatctattgtaattcggnggaagggacaagggtcggaggtacaaacgacgttgttggctgcacattctgttcttc

SEQ ID NO: 385180 - DNA, 627 bp, Homo sapiens
  misc_feature: GZ8MTXP01BGTOO.17.35.D02.1.454.CMB.2.raw
  modified_base (198)..(198): a, c, t, g, unknown or other
  modified_base (238)..(238): a, c, t, g, unknown or other
  modified_base (253)..(253): a, c, t, g, unknown or other
  modified_base (275)..(275): a, c, t, g, unknown or other
  modified_base (390)..(390): a, c, t, g, unknown or other
  modified_base (608)..(608): a, c, t, g, unknown or other
  modified_base (615)..(615): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtagganacagagtcacatcacttgccgggcagtcagaatattaagnggtggttgctggtancagcaagaaaccgagggaaacncccctaaggtctagatatatgactactttacttacgtttaaggaaacggttcggggtaccctaatacgtaaagggttcaacgggcgtacgtaggtggactttcgggacgggtaanaagtactcctacttcgtactactacgtaccaccgtacgtccacgacctaacgttagtactttaggttaactttacgaacttaaacgtttacgttaccgtaccggtaacctaaagttactactactaacttactagtttacttagttaggtttaacggtttcggggaagggtaacgggtaacgttaggggtaggaacgtaacgaagttcgttgcggtcngctactnttcgttcttctc

SEQ ID NO: 385181 - DNA, 642 bp, Homo sapiens
  misc_feature: GZ8MTXP01EZNYT.17.35.D02.1.454.CMB.2.raw
  modified_base (197)..(197): a, c, t, g, unknown or other
  modified_base (238)..(238): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccgggccagtcagaatattaanaggtggttggcctggtatcagcagaaaccagggaaagcccctaaggtcctgatatatgagacttctactttagaaagttgggggtacccatcaaggttcacgcggcagtggatcgtgggaacagaattcatctcactatcacagctgcaactgattgattttgactaaactttattaactcggggtaccctaaacgtagttaactacctagttacctaattaccgttaaatttacgggtttaaaagtttttccgggggtaaggggtaacgggggtaaaccccgttaaaagggggttaccggggttaaaggggttaacaaaaaccgggttaaaccgttcgggttagggtccgttacgggaacccgtaaacccgtacgttaccttaacgggttttcccttttcccg

SEQ ID NO: 385182 - DNA, 589 bp, Homo sapiens
  misc_feature: GZ8MTXP01E0PF1.17.35.D02.1.454.CMB.2.raw
  modified_base (270)..(270): a, c, t, g, unknown or other
  modified_base (449)..(449): a, c, t, g, unknown or other
  modified_base (579)..(579): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggcagtcagaatataataggtgtgctggatcagcaagaaaccaggaaacnccccgtaaggtcctagatatatgaatacttactactttaagaacggtcggggtcccaagttcgaaaggtttcccaagggtcggacgaaggtggtaaatcgttcggggaacaagtaaattccactctacactataccacagcctagacaacctgatgtatttcaacttacttattacgtnaccctaaatatatccatactagtctaatttagttaaacgtttgggtaagggtaacggaaaccggtaaggttacgggaaggttaacccgaaagttacgttaggttcggcttaaggaccctacttactttcncgtttaaccc

SEQ ID NO: 385183 - DNA, 769 bp, Homo sapiens
  misc_feature: GZ8MTXP01BL6JM.17.35.D02.1.454.CMB.2.raw
  modified_base (260)..(260): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtaggagacagagtcaccatcacgttcgccgggcagtcaagtaatattaagtaggtggttggctggtancgagacaagaaaccgagggaaacgccccgtaaggtcctagatatatgtagtacttacttaacgtttaaggaaaggttcgggggtacccctaagttaccgtaaacgggtttccgaacgggaccgggtacgtaagggtacgggtaacgttacccgggtaagggggtaacctaaagggttaaacctttccgtaacccttaccttaccctaacttaactacccaacccgaccggtacccctacgacccctaaaccgtaggtactttagttactttttaccgaacttaaactttaacgttaacccttacggtaacctaaacgtaagttaacttactaacttaccttaagttaccgttaagttttaggtttaaacggtttcgggggtaacgggtaaaccgggggtaaaccggttaaagggggttacggggttaaacggtaaaccggtaaaacggttaccgttgggttcggtaactacggaacctacctagtttccttaacgtttcctttaacccg

SEQ ID NO: 385184 - DNA, 571 bp, Homo sapiens
  misc_feature: GZ8MTXP01EM22J.17.35.D02.1.454.CMB.2.raw
  modified_base (201)..(201): a, c, t, g, unknown or other
  modified_base (248)..(249): a, c, t, g, unknown or other
  modified_base (251)..(252): a, c, t, g, unknown or other
  modified_base (265)..(265): a, c, t, g, unknown or other
  modified_base (280)..(280): a, c, t, g, unknown or other
  modified_base (283)..(283): a, c, t, g, unknown or other
  modified_base (323)..(323): a, c, t, g, unknown or other
tcagcgtagactagcacgaccggtgctcgatttagcacacgatagttgggtttggggaggagtcagacccagtcaggacacagcatggacatggagggtccccgctcagctcctggggctcctgctgctctggctcccaggtgccagatgtgacatccagatgacccagtcctccttccaccctgtctgcatctgtagganacagagtcacatcacttgccggcagtcagaatatatggtgtgctgannannagaacgaggaacnccctagcagatatangancttatactttaagaagtggtccagtacgaaggttccaggnggcagtggaatcgtgggaacaagtaactccattcactactatcaccagcctagaccaaactgtattgtatttacgacttaaactttattactacgacctaaatatactcacttactaagttactaagtttaggttaaacgtttcggggaacggtaagggttaacccgtaaagggttacgggtaaacgttaacgaaaacgttacgttaggtaacgggtctaaggacctaacgttcttcgttaacgttcc

SEQ ID NO: 385185 - DNA, 614 bp, Homo sapiens
  misc_feature: GZ8MTXP01BEH8F.17.35.D02.1.454.CMB.2.raw
  modified_base (197)..(197): a, c, t, g, unknown or other
  modified_base (252)..(252): a, c, t, g, unknown or other
  modified_base (272)..(272): a, c, t, g, unknown or other
  modified_base (356)..(356): a, c, t, g, unknown or other
  modified_base (397)..(397): a, c, t, g, unknown or other
  modified_base (448)..(448): a, c, t, g, unknown or other
  modified_base (600)..(600): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctccaggtgccagatgtgacatccagatgacccagtcctccttccaccctgtctgcatctgtagganacagatcacatcacttgccggcagtcagaatattaagtaggtggtggcctggtancagcaagaaacagggaaacnccccgtaagtccagatatatagagtacttactaacgtttaaggaaacggtcgggtacccaattaccgaaggttcacggtcgganagtcggattcgagggtaacagtaactcgactctacgaactnccacacgctagacaaactgaacttgtaatttcgactaacttactttaccgnggtaacccctaagtactaactaccacttaactcggttaccttaagtttaccgttaaaggtttcccgggtaagggaacgggtaaccggttaaagggttacgggaacgtaaacgtaaacgttaacggttggttacgaagtacctcgaaaccttnttaccttgttcctc

SEQ ID NO: 385186 - DNA, 558 bp, Homo sapiens
  misc_feature: GZ8MTXP01A9HGY.17.35.D02.1.454.CMB.2.raw
  modified_base (202)..(202): a, c, t, g, unknown or other
  modified_base (251)..(251): a, c, t, g, unknown or other
  modified_base (254)..(254): a, c, t, g, unknown or other
  modified_base (267)..(267): a, c, t, g, unknown or other
  modified_base (275)..(275): a, c, t, g, unknown or other
  modified_base (291)..(291): a, c, t, g, unknown or other
  modified_base (328)..(328): a, c, t, g, unknown or other
  modified_base (436)..(436): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatcgacccagttcctccttccaccctgtctgcatctgtagganacagagtcacatcacgtgccggcagtcagaatataagtggtgtgctgancancagaacaggaacncctagtcngatatatgactacttntaacttaaggaagtcggtaccatcgagttccaggcgnagtgaatcgtggactagaacttcgactcacactataccgacacgtcctcgaacacgtgattcgttaatttacgacttaaacttacgttacgacaacctaactacttanactacgtactaatcgttaagtttagtaaacggttttcgggggaacggtaacgggaaaccgtagggttacggaacggtaacaaaacggttcgttggcggtcaacgcacttagttcttcgttcc

SEQ ID NO: 385187 - DNA, 563 bp, Homo sapiens
  misc_feature: GZ8MTXP01ETSLM.17.35.D02.1.454.CMB.2.raw
  modified_base (201)..(201): a, c, t, g, unknown or other
  modified_base (272)..(272): a, c, t, g, unknown or other
  modified_base (290)..(290): a, c, t, g, unknown or other
  modified_base (533)..(533): a, c, t, g, unknown or other
  modified_base (539)..(539): a, c, t, g, unknown or other
  modified_base (552)..(552): a, c, t, g, unknown or other
  modified_base (559)..(559): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatcgacccagtctcccttccaccctgtctgcatctgtagganacagacgtcacatcacttgccggacagtcagtaatatagtggtgtgctggatcagcaagaaccgaggaacnccgtaagcctagatatangatactttactaagtttaagaacggtcggtaccagtacgtaaggttccaggcggacgaggtggaaatcggtaagggactaagtacttcacttctactactatccgacacgctagactaactgtatcgttatttcgaacttaaactttactacgtacgaacctaaagtatatacaattacagttctaagtttacgtaaggtttcgggaaggtacggacgtagggttgacggtaacaaacggttnttaggngctcgacacgttntccgttntccc

SEQ ID NO: 385188 - DNA, 618 bp, Homo sapiens
  misc_feature: GZ8MTXP01BJCX9.17.35.D02.1.454.CMB.2.raw
  modified_base (272)..(272): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtcctccttccaccctgtctgcatctgtaggagacagagtcaccatcacgttcgccgggcagtcagaatataagtggtggtgctgatcagcaagaacgaggaacnccctaaggtctagatatagtagagtactttacttaacgtttaggaaacggtcgggtaccctagtacgtaaggttccacggtcggcgaggttaggtaacttacggtggggaaactaagtaaacttccacttacctactaacttataccgaaccacgtcctagactaacctgactgttattcgtactaaactttattacgtagtaccctaaactatactccagtactatcttaagtttacgttaagttgggtaagggaacgggttaaccgtaagggggttaggtaacggtaacgaaaaccggttagttcggtaaggtctaacggctaacttcttccgttaacgttccc

SEQ ID NO: 385189 - DNA, 777 bp, Homo sapiens
  misc_feature: GZ8MTXP01C2IFD.17.35.D02.1.454.CMB.2.raw
  modified_base (203)..(203): a, c, t, g, unknown or other
  modified_base (767)..(767): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatcgacccagtcctcccttccaccctgtctgcatctggtagganacagagtccacatctacgttggtccgggacctagtacaagtaattaagttaagtagggttggttcggacctggtatcgaagacaaacggaaaccgagggaaaccgtccccgttaaggtcctaggtaacttaagtagtacggtaacgtactttacttaaacgtttaaggaaacgggttcgggtaccctagtacgtaacggttccaacgggcggtacgtaagggtcggtaaacttcgggtaagggggaaacctaaggttaaacctttcaacccttctaacctaaaccttaacttacccgaaccgtaacggtcccttacggaaccctaaaccgttggtaactttacgttaacgtttacgtaacctttaaacttttacttaacggttaccgtaaccccttaaacgttagttacctacctaacttacgtaactttaccgttaaagttttacgggtttaaacggtttcgggggaacggggtaaacgggggttaaccggtaacggggttagggtaaaacggtacgttaaaacgggttcgttgggtaacgtactcgtaccaccttagtttcncgttttaacc

SEQ ID NO: 385190 - DNA, 535 bp, Homo sapiens
  misc_feature: GZ8MTXP01DL9E6.17.35.D02.1.454.CMB.2.raw
  modified_base (198)..(198): a, c, t, g, unknown or other
  modified_base (246)..(247): a, c, t, g, unknown or other
  modified_base (250)..(250): a, c, t, g, unknown or other
  modified_base (261)..(261): a, c, t, g, unknown or other
  modified_base (323)..(323): a, c, t, g, unknown or other
  modified_base (335)..(335): a, c, t, g, unknown or other
  modified_base (524)..(524): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtagganacagagtcaccatcattgccggcagtcagaatataatggtgtgctgtnnagnagaacaggaanccctaagctagatatatgatattctaacttagaaagtcgggtaccatcgagttcacgcgganagtgatcgaggnagtaacttcactctcatactcacagcctgactaactagtatgtatttcgacttaacttattaccgtaggtaccctaaataacttactctaacttactattacttatttaggttaaagtttccggaggggtaaggtaacgttaagggtaggaagggttaacaaacggaacgttggttaggctagcacgtnttctcgttctc

SEQ ID NO: 385191 - DNA, 692 bp, Homo sapiens
  misc_feature: GZ8MTXP01B1OYU.17.35.D02.1.454.CMB.2.raw
  modified_base (658)..(658): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatcgacccagtctcccttccaccctgtctgcatctggtagagacagatcacatcacttcgccggcagtcaagaatatagtaggtggtgctgatcagcaagaaaccgagggaacacccgtaagtctgaatatatagatacgtttactaacgtttaagaacgggtcgggtaccctaagtacgtaaggttccgaggtcggacgtaggtaggtaacgttacggtaaggggaaactaaaggtaacttacctaacctctaccaccttactaccaacccgtagcccttacggaccctaaaccttggtaattcggttaaactttacgtaacccttaaaatttacctttaacggaccggtaaacctaaacggtaacttactccgtaattacctaaacttacgtaagttttaggttaaacggtttcgggggaaagggtaacgggttaaaccggtaaggggttacggtaaacggtaacgaaaacggttcgttacgggtcgtccggttaanacccctaacgttacttccggtttaacgttaaccc

SEQ ID NO: 385192 - DNA, 642 bp, Homo sapiens
  misc_feature: GZ8MTXP01D2BDS.17.35.D02.1.454.CMB.2.raw
  modified_base (199)..(199): a, c, t, g, unknown or other
  modified_base (256)..(257): a, c, t, g, unknown or other
  modified_base (631)..(631): a, c, t, g, unknown or other
tcagcgtagactagcacgaccggtgctcgatttagcacacgatagttggggtttgggggagtcagacccagtcaggacacagcatggacatgagggtccccgctcagctcctggggctcctgctgctctggctcccaggtgccagatgtgacatccagatgacccagtcctccttccaccctgtctgcatctgtagganacagacgtcacatcacgtcggccggacagtcaagtaatattagtggtggtgctgtannagactaacgaaacgaggaaaccgtcccctaaggtcctagattatatgaacgtactttactaagtttaagggaaacggtcgggtaccaatcgtaaggtccaggcggagtaggtggtactcggtagggaacctagtaacttccacgtcactacttacgcaaccagtcctagactaaacttgtacgttagttacttttacaactttaactttaacttaccgtaccgggtaaacctaagtaacttactacctaatactacggtttaacttagtttaagtttaacggttacggggaggggaaaccggtaagttaagggggtacgaaacggtaaaccgtaaagttacgttggacggtcaactccctaagtcttccggttnttccgttaacc

SEQ ID NO: 385193 - DNA, 587 bp, Homo sapiens
  misc_feature: GZ8MTXP01BD1E1.17.35.D02.1.454.CMB.2.raw
  modified_base (261)..(262): a, c, t, g, unknown or other
  modified_base (281)..(281): a, c, t, g, unknown or other
  modified_base (403)..(403): a, c, t, g, unknown or other
  modified_base (411)..(411): a, c, t, g, unknown or other
  modified_base (416)..(416): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggcctcccaggtgccagatgtgacatccagatcgaccagtctcctccaccctgtctgcatctgtagagacagagtcacctatccacgttcgccgggacagtcaagtaattattaagtaggtggtgctggannagacaagaaccgaggaacnccctagtctagatatatgatacttacgtaagtttaggaacggtcggtaccctagtacgaaggttcccaggtcggacaggtgtaacgtcgtgggaactagtaacttcgacttctactactacncgactacncgtanactacgtatagttacgtatttacgaacttaacttactacgtactaacctaacacttacacctatacgtactagttagttacgttagttcgggaacggtaacggttacggtaagggttaggaacggtaacgaacgttgttcggtaacgctcgacctacttacgtcgttcgtc

SEQ ID NO: 385194 - DNA, 605 bp, Homo sapiens
  misc_feature: GZ8MTXP01AKEC3.17.35.D02.1.454.CMB.2.raw
  modified_base (242)..(242): a, c, t, g, unknown or other
  modified_base (258)..(258): a, c, t, g, unknown or other
  modified_base (430)..(430): a, c, t, g, unknown or other
  modified_base (582)..(582): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatcgtgtaggagacaggactcaccatcacttcggccggcagtcaagaatattaanaggtggttgctggtancagacaagaaaccgagggaaacgccccgtaaggtcctagactatagtcgagtacttacttaacgtttaggaaacggttcggggtacccagtacgaaggttcaggcgcgagtcgatcgtaggaacagtactcactctacactatccactacgctcgactacgtgtatgtattnactaacttagtactacggacaacgtactactacctatacgtatattattcggtttaaacgttcggggtaacggaacgggtaacttagggggtagttaaacggtaaccgtaaaagttaccgttggttacggtaacgtacgtcttaacccggtnttccggttaacgtttccttcccg

SEQ ID NO: 385195 - DNA, 573 bp, Homo sapiens
  misc_feature: GZ8MTXP01B81KR.17.35.D02.1.454.CMB.2.raw
  modified_base (250)..(251): a, c, t, g, unknown or other
  modified_base (350)..(350): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggcagtcagaatatataggtgtgctggannagcagaaccaggaacgcccctaaggtcctgatatatgagtacttctaactttagaaaggtgggtacccatacgaaggttccaggcggcagtggaatcgngggacagattcactctacactatcaccagcctgcaactgatgtatttgactaactttagttacctcgacctaaacagttactctaattctaattctagtttagtttaaagtttcggggtaaggaacgggttaaccgtaaaggggttggaaacgggttaccgaaaacggttaaccgtttggaacgggcttcggccctaacccgttattccgttcgtttaacccg

SEQ ID NO: 385196 - DNA, 809 bp, Homo sapiens
  misc_feature: GZ8MTXP01ATTEM.17.35.D02.1.454.CMB.2.raw
  modified_base (281)..(281): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatcgacccagtcctccttcccaccctgtcctgcatcgtaggtaggagacagacgtccaactactcgtacgttcggcccgggacaggtacaagtaattagttaagtaggtggttggcgtaggtancgagacgaacgaaacgagggtaaaccgccctaggtcctagactagtagtagtacgtactttacgtaacgtttaagggaacggtcgggtacccaagtttacccggaaggtttcgaaccgggtcggtacgtagggttacggagtttaacgggaggggaactaaacggtaactttaccgtacttaccgtaccctatacctacccaccgtacggtaccctaggtaacccgtaacgttcggttaagttacggtttaaactttacggtaaaccttttaaaccttagtttaacccgtaccggggaaacccctttaaacgggtaagttaactaccgttaactacctaaggtttaaccgttagttttaaaccgggtttaagggtttcccggggggtaaaggggtaaccgggggttaaaccgttaaaggggggtaccggttaaacggtaaaccggtaaaacgggttcccgggttaaaggggttcgtaacggtccgtaaaccctaccggttactttcccggttaactttaaccgtcccg

SEQ ID NO: 385197 - DNA, 583 bp, Homo sapiens
  misc_feature: GZ8MTXP01BAOF4.17.35.D02.1.454.CMB.2.raw
  modified_base (204)..(204): a, c, t, g, unknown or other
  modified_base (258)..(258): a, c, t, g, unknown or other
  modified_base (299)..(299): a, c, t, g, unknown or other
  modified_base (353)..(353): a, c, t, g, unknown or other
  modified_base (405)..(405): a, c, t, g, unknown or other
  modified_base (411)..(411): a, c, t, g, unknown or other
  modified_base (453)..(453): a, c, t, g, unknown or other
tcagcgtagactagcacgaccggtgctcgatttagcacacgatagttgggtttgggggaggagtcagacccagtcaggacacagcatggacatgagggtccccgctcagctcctggggctcctgctgctctggctcccaggtgccagatgtgacatccagatcgacccagtcctcccttccaccctgtctgctatctgtagganacagacgtcaccatcacgttgccggacagtcaagtaatatagtggtgtgctgancgagacaacgaaacgacggaacctcctagtcctagatatanagtatacttatacgttaaggaaggtcgggtaccagtacgtaagttccacggcgngtagtgaacttcgaaggactagtactctactcactattacacacacgcctanactacngtactgttattacacttaatttactctacgtacctaaacgtnttaactctaagttactacttactagttttagtaacgggtttcggaagggtaacgggttacggtagggttacggaacggtaacgaaacgttcgttggtaacgctcggacaccttgttccgttaacgttccc

SEQ ID NO: 385198 - DNA, 619 bp, Homo sapiens
  misc_feature: GZ8MTXP01BOKWD.17.35.D02.1.454.CMB.2.raw
  modified_base (250)..(250): a, c, t, g, unknown or other
  modified_base (268)..(268): a, c, t, g, unknown or other
  modified_base (608)..(608): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtcctccttccaccctgtcctgcatctgtaggagacagatcacatcacttgccggcagtcagatatagtggtgtgctgatcancaagaaccgagggaaacncccctaaggtcctgactatatagacgtactttcgtaacgtttaggaaacggttcggggttacccagtcgtaaacggtttccagggcggtacgtagggttcggaagttcccggtaaggggtacaaggttaaacttcccaacttcttacacttacgtccaacctacgcccttagacccaaaccttgaactttagtactttagacctttaaatttacgtttagaccgtacctaagtattactctaatctaaagttctagtttagtacgtttcgggaagggacgttaccgtaagggttggaaacgtacttaaaacggttgttacggtggctggtccaaccgttnttccgttcgtc

SEQ ID NO: 385199 - DNA, 513 bp, Homo sapiens
  misc_feature: GZ8MTXP02HVYL6.17.35.D02.1.454.CMB.2.raw
  modified_base (477)..(477): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggcagtcagaatattaataggtggttggctggtatcagcagaaaccagggaaagcccctaaggtcctgatctatactgcatccaatttgacaaagtggggtcccatcaaggttcagtggcagtggatcgtgggacagatttcactctcaccatcagcagtctgccaactgaggtatttgactaactttactacttgtacaacgtaggttacacgtaccccgtactactttcggaccgtaggggaccaaggcttagganatacaaacgaactgtggaactgacacatctgtcttc

SEQ ID NO: 385200 - DNA, 487 bp, Homo sapiens
  misc_feature: GZ8MTXP02ITX1G.17.35.D02.1.454.CMB.2.raw
  modified_base (267)..(267): a, c, t, g, unknown or other
  modified_base (295)..(295): a, c, t, g, unknown or other
  modified_base (400)..(400): a, c, t, g, unknown or other
  modified_base (415)..(415): a, c, t, g, unknown or other
  modified_base (418)..(418): a, c, t, g, unknown or other
tcagcgtagactagcacgaccggtgctcgatttagcacacgatagttgggtttggggagtcagacccagtcaggacacagcatggacatgagggtccccgctcagctcctggggctcctgctgctctggctcccaggtgccagatgtgacatccacgatgacccagtctccttccaccctgtctgcatctgtaggagacagagtcaccatcacttgccggcagtcagatataatagtgttgctggtatcagcagaaaccagggaaancccctaaggtcctgatatatgagacttntactttagaaagtgggtcccatcaaaggttcagcggcagtggatctgggcagaattcactctcactatcaccagcctgcaacctgatgatttgtcactattattncacatatacatcatnatntattagtggtaggacgaggtaggaggtacgaacgaacgtaagtaggtcgtcgacacactactcgttctc

SEQ ID NO: 385201 - DNA, 502 bp, Homo sapiens
  misc_feature: GZ8MTXP02JMHUD.17.35.D02.1.454.CMB.2.raw
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggcagtcagatatatagtgtgctgtatcagcagaaaccaggaaagcccctaaggtcctgatatatgagtacttctactttagaaagtggggtaccatcaaggttccagcggcagtggatctgggacagaattcactctcactatcaccagcctgcaacctgatgtatttgactaacttattactgtaccaatagtatcatcatctattagtaattcggtaggaggacctaagggtggtaacggtacaaaacgaacgtgtaaggctagacactatctagttcc

SEQ ID NO: 385202 - DNA, 537 bp, Homo sapiens
  misc_feature: GZ8MTXP02HICP2.17.35.D02.1.454.CMB.2.raw
  modified_base (199)..(199): a, c, t, g, unknown or other
  modified_base (248)..(248): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccggcagtcagaatatatagtgtgctgatnagcagaacagggaaagcccctaaggtcctagatatatgagtacttctactttagaagtgggtaccatcaaggtccagcgcagtgatcgtgggacagaattcactcacactatcaccagccctgaccaacctgattgtattttagactaaactttattactcgtaccaaactagttaactacattacatactaagtttagttaaagtttcgggtaggacgggtaaccgtaaagggtggaaacggttacaaaacgtaacgtgtaaggctacgaccactactcttacgttcc

SEQ ID NO: 385203 - DNA, 486 bp, Homo sapiens
  misc_feature: GZ8MTXP02I1U73.17.35.D02.1.454.CMB.2.raw
tcagcgtagactagcacgaccggtgctcgatttagcacacgatagttgggtttggggagtcagacccagtcaggacacagcatggacatgagggtccccgctcagctcctggggctcctgctgctctggctcccaggtgccagatgtgacatccagatgacccagtctccttccacctgtctgcatctgtaggagacagagtcaccatcacttgccgggcagtcagaatatataggtgtgctggtatcagcagaaaccagggaaagcccctaaggtcctgatatatgagacttctactttagaaagtggggtcccatcaaggtcagcgcagtggatctgggcagaattcactctcactatcacagcctgcaactgatgtactttgctaactttattactgaccaacagtatcatcatcaattgtaatttcgtggacggtacaaggtggaggtacaaacgaactgtaggctgcacatactgtctttc

SEQ ID NO: 385204 - DNA, 490 bp, Homo sapiens
  misc_feature: GZ8MTXP02GVEIZ.17.35.D02.1.454.CMB.2.raw
  modified_base (419)..(419): a, c, t, g, unknown or other
  modified_base (475)..(475): a, c, t, g, unknown or other
  modified_base (483)..(483): a, c, t, g, unknown or other
tcagcgtagactagcacgaccggtgctcgatttagcacacgatagttgggtttggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaaggtcctgatatatgagacttctactttagaaagtggggtcccatcaaggttcagcgcagtggatctgggacagaaattcactctcactatcaccagcctgcaaacctgatgaattttgctaacttattactgccaanagtatcatcatcattgtaattcgtgtaggacaaggtgaggtcaaacgaactgtagngtgcacanctctctc

SEQ ID NO: 385205 - DNA, 539 bp, Homo sapiens
  misc_feature: GZ8MTXP02HY7T6.17.35.D02.1.454.CMB.2.raw
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggccagtcagaatattaataggtgttggctggtatcagcagaaaccagggaaagcccctaaggtcctgatatatgagtacttctactttagaaagtgggtcccagtcaaggttccagcgcagtgatctggggacagattcactctcactatcaccagcctgccaacctgatgtatttgactaaactttattaactgtaccaactagtaactcatctaatctatttagtaaactttcgggtaggtagggtaaccgaaagggtacggtaacggtaccgaaaacggtaactggtaaggcgtagccaacctatcgttcgttcc

SEQ ID NO: 385206 - DNA, 524 bp, Homo sapiens
  misc_feature: GZ8MTXP02IXORY.17.35.D02.1.454.CMB.2.raw
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggcagtcagaatataataggtgtgctggtatcagcagaaaccagggaaacgcccctaaaggtcctagatatatagagacttctactttagaaagtgggtacccatcaaaggttcagcggcagtggatcgtgggacagaattcactctcactatacaccagcctagacaacctgatgtattttgactaaactttatactgaccaacagtatacatcatctagttgtaatttcggaggaacgggaccaaagggttggaacggttacaaacgtaaactggtaggcgtcgacaccattcctgttcttac

SEQ ID NO: 385207 - DNA, 484 bp, Homo sapiens
  misc_feature: GZ8MTXP02HYPO4.17.35.D02.1.454.CMB.2.raw
  modified_base (414)..(414): a, c, t, g, unknown or other
  modified_base (425)..(425): a, c, t, g, unknown or other
tcagcgtagactagcacgaccggtgctcgatttagcacacgatagttgggtttggggagtcagacccagtcaggacacagcatggacatgagggtcccgctcagctcctggggctcctgctgctctggctcccaggtgccagatgtgacatccagatgacccagtctccttcaccctgtctgcatctgtaggagacagagtcaccatcacttgccggccagtcagaatataatagtgttggctggtatcagcagaaccaggaaagcccctaaggtcctgatatatgagacttctactttagaaagtggggtcccatcaaaggttcagcgcagtggatctgggcagaaattcactctcactatcaccagcctgcaaacctgatgatttgctaacttattaactgtccaacagtancatcatcattntaattcggtgaggacaaaggtgaggtacaaacggactgtaggctagcacatctgtctac

SEQ ID NO: 385208 - DNA, 583 bp, Homo sapiens
  misc_feature: GZ8MTXP02G02DH.17.35.D02.1.454.CMB.2.raw
  modified_base (270)..(270): a, c, t, g, unknown or other
  modified_base (348)..(348): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtcctccttccaccctgtctgcatctgtaggagacagagtcaccatcacttgccggcagtcagatatataggtgtgctggtatcagcagaaaccagggaaacncccctaaggtcctgatatatgagtacttctactttaggaaagtcgggtaccatcgaaggttccagcgcagtggatcgnggggacagaacttcactctacactatcaccagcctgaccaacctgattcgtaattttcgacttaaactttattacgtacgacctaaactagttactactaatacattacgtaatttagtaacgttttcggggagggtaacgggaaccggtaaaggggttagggaaacgggttaccgaaaaacggtacgttaagggtcggtaccgtacggacctaaccgtattccgtacgtttccc

SEQ ID NO: 385209 - DNA, 564 bp, Homo sapiens
  misc_feature: GZ8MTXP02GUXQR.17.35.D02.1.454.CMB.2.raw
  modified_base (269)..(269): a, c, t, g, unknown or other
  modified_base (344)..(344): a, c, t, g, unknown or other
  modified_base (378)..(378): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggccagtcagaatattataggtggtgcctgatcagcagaaccagggaancccctaaggtcctagatatatgagtacttctactttagaaagtgggtcccatcaagttccagcgcagtgattcgngggacagaattcactctcactatcaccagcctcncacctagatagtatttatactaacttacttacttacgtacaactatacttacactactatactatttagttaacgtttacggttaggtaacgggaaccggtaaacgggtaacgggtaacggtaacgtaaaaccggaaacgtacggttaacgggtacgtacgtacgtaccgtactacgttacgttcg

SEQ ID NO: 385210 - DNA, 543 bp, Homo sapiens
  misc_feature: GZ8MTXP02HV5T9.17.35.D02.1.454.CMB.2.raw
  modified_base (199)..(199): a, c, t, g, unknown or other
  modified_base (273)..(273): a, c, t, g, unknown or other
  modified_base (396)..(396): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccggcagtcagaatattaataggtgttgctggtatcagcagaaaccagggaaacncccctaaggtcctgatatatgagacttctactttagaaagtgggtaccatcaagttcagcgcagtgatctggggacagaattcactctacactatcaccagcctgcaactgatgtaagttttnacttaattattactacgaccaactagtactactatactatcttagttagttaagtttcgggtacgggtaacgggtaacgtaagggtagggtaaacggtaaccgaaaacgtacgtggtaacggtctacgacacgtacttcttacgttc

SEQ ID NO: 385211 - DNA, 470 bp, Homo sapiens
  misc_feature: GZ8MTXP02GDZZG.17.35.D02.1.454.CMB.2.raw
  modified_base (419)..(419): a, c, t, g, unknown or other
  modified_base (426)..(426): a, c, t, g, unknown or other
tcagcgtagactagcacgaccggtgctcgatttagcacacgatagttgggtttggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggcagtcagaatatataggtgtgctggtatcagcagaaacagggaaagcccctaaaggtcctgatatatgagacttctactttagaaagtgggtccatcaaaggttcagcggcagtggatcgtgggacagaattcactctcactatcacagctgcaacctgatgatttgacaacttatactgacaacatatcatcatcattntattcgngaggacaggtggagtcaaacgactgtagctgcacatctgtcttc

SEQ ID NO: 385212 - DNA, 530 bp, Homo sapiens
  misc_feature: GZ8MTXP02G50A5.17.35.D02.1.454.CMB.2.raw
  modified_base (197)..(197): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccgggcagtcagatataataggtgtgctggtatcagcagaaaccaggaaacgcccctaaggtcctgatatatgagacttctactttagaaagtgggtcccatcaaggttcagcggcagtcggatcgtgggacagaacttcactctacactatcaccagcctgaccaacctgactgtatttcgactaacttattactgacctaacagttatcatacatactattgttaaagttcggtaggtaacgggacgtaaagggtggaaacggtacaaacggtaacgtcggtaggcgtacgactacctatcttgtcctttac

SEQ ID NO: 385213 - DNA, 611 bp, Homo sapiens
  misc_feature: GZ8MTXP02GZNSQ.17.35.D02.1.454.CMB.2.raw
  modified_base (197)..(197): a, c, t, g, unknown or other
  modified_base (359)..(359): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccggcagtcagaatataataggtggtgctggtatcagcagaaaccagggaaacgcccctaaggtcctgatatatgaagtacttactactttaaggaaaggttcggggtacccaagtcgaaaggttcaggcggcagtggatcgngggacagtaattcgactctcactactcaccacgctgaccaacctgactgtattttacgactaaactttattactacgacctaaatacgttactaccaatacctagttactaagtttagttaaacggtttttcgggaaggggaacgggtaacccgtaaaggggtacggtaaacgggttaaaccgaaaacggtaaccgtggttacggaaccgttcggacccgaacctacgtttccttaacggttctttaacccg

SEQ ID NO: 385214 - DNA, 537 bp, Homo sapiens
  misc_feature: GZ8MTXP02HKC96.17.35.D02.1.454.CMB.2.raw
  modified_base (274)..(274): a, c, t, g, unknown or other
  modified_base (396)..(396): a, c, t, g, unknown or other
  modified_base (427)..(427): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtaggagacagagtcaccatcacttgccgggcagtcagaatattaataggtggtggctggtatcagcaagaaaccagggaaancccctaaggtcctgatatatgagacttctaactttagaaagtgggtacccatcaaggttcagcggcagtggatcgtagggacagaattcacctctacaactatcaccagccctgccaacctnatgtatttgactaactttatactgacctaanagtatacatcatctatttgttaattcgggtagggtaacgggtacgaaagggtgggtaacggtacaaaacgtactggtaggcgtacggctaaccagttctcgttactttcc

SEQ ID NO: 385215 - DNA, 544 bp, Homo sapiens
  misc_feature: GZ8MTXP02IOLU0.17.35.D02.1.454.CMB.2.raw
  modified_base (270)..(270): a, c, t, g, unknown or other
  modified_base (378)..(378): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccacctgtctgcatctgtaggagacagagtcaccatcacttgccgggcagtcagaatattataggtgtgctggtatcagcagaaaccagggaaacncccctaaggtcctagatatatgagtacttctactttaagaaagtggggtacccatcaaaggttcagcggcagtggatcgtgggacagaattcactctacactatcacngcctgcaactgactgtatttgactaactttattactgaccaactagtatacatcatctaatttgttaaagtttcggtaggtaacgggtaccgtaaagggtagggaacggtacgaaaacggtaacgtggtacggcttacggacctaccgtatccttcgtactttacc

SEQ ID NO: 385216 - DNA, 494 bp, Homo sapiens
  misc_feature: GZ8MTXP02JM661.17.35.D02.1.454.CMB.2.raw
  modified_base (197)..(197): a, c, t, g, unknown or other
  modified_base (263)..(263): a, c, t, g, unknown or other
  modified_base (404)..(404): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccggcagtcagaatatataggtgtgctgatcagcagaaccaggaaancccctaaggtcctgatatatgagtacttctactttagaaagtgggtcccatcaaggtcagcgcagtggatcgtgggacagaattcactctcactatcacagcctgacaacctgatgtatttgactaattatactgaccaanagtatacatcatctattgtaatttcgggaggtacggtacgaggtacggaggtacaaacgactgtaggctagcacctatcctagtcttaac

SEQ ID NO: 385217 - DNA, 537 bp, Homo sapiens
  misc_feature: GZ8MTXP02F4R1A.17.35.D02.1.454.CMB.2.raw
  modified_base (419)..(419): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaaggtcctgatatatgagacttctactttagaaagtggggtccatcaaggttcagcgcagtggatctgggcagaattcactctcactatcaccagcctgcaacctgatgtattttgactaactttattactgaccaanagtatcatcatctatttcgttaaagtttcgggtaggtaacgggtaccgtaaaggggttaggaacgggtacaaaacggtaaacgtggtaggcgtacgacacctatcgtcgttctttacc

SEQ ID NO: 385218 - DNA, 524 bp, Homo sapiens
  misc_feature: GZ8MTXP02HMWO7.17.35.D02.1.454.CMB.2.raw
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggccagtcagaatattaataggtggttggcctggtatcagcagaaaccaggaaagcccctaaggtcctgatatatgagacttctactttaaggaaagtggggtacccagtcaaggttccagcggcagtggatcgtggggacagaattcactctcactatcaccagcctgctaacctgactgtatttgactaaactttattactgaccaacagtatcatcatctattagtattcggtaggagggaccaaggtaggaacgtacgaaaacgtacgtagtcggcttacggccactactccttgtttcc

SEQ ID NO: 385219 - DNA, 520 bp, Homo sapiens
  misc_feature: GZ8MTXP02ICZML.17.35.D02.1.454.CMB.2.raw
  modified_base (199)..(199): a, c, t, g, unknown or other
  modified_base (374)..(374): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccggcagtcagaatattaataggtggtggcctggtatcagcagaaaccgagggaaacgcccctaaggtcctagatatatgagtacttctactttaagaaagtcggggtacccagtcaaggttccagcgcagtgatcgtgggacagaattcactcanactatccaccagcctcgctaacctgatagtatttgactaaactttattactcgaccaactagtatacatcatctatttgtaagtttcggtaggaggtacgaaggttaggacggtacaaacgactggtaagctagcacgtctctctc

SEQ ID NO: 385220 - DNA, 590 bp, Homo sapiens
  misc_feature: GZ8MTXP02GB10I.17.35.D02.1.454.CMB.2.raw
  modified_base (197)..(197): a, c, t, g, unknown or other
  modified_base (400)..(400): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccgggccagtcagaatattaataggtggttggcctggtatcagcaagaaaccgagggaaacgcccctaaggtcctagatatatgagtacttctaactttagaaaggtgggtcccatcgaaggttcagcggcagtggatcgtgggacagtaactcactctcactatcacagcctagccaaacctnattgtattttagactaacttattactacgtaccaaacattactactatactaatctaatttgttaacgtttcgggtacggggtaacgggtaaaccgtaaaggggttagggtaaacgggttaaccgaaaacggtaaaccgttggtaacggtcgttacggacctaaccctattccgttacgtttcctttacc

SEQ ID NO: 385221 - DNA, 505 bp, Homo sapiens
  misc_feature: GZ8MTXP02GUPUJ.17.35.D02.1.454.CMB.2.raw
  modified_base (267)..(267): a, c, t, g, unknown or other
  modified_base (344)..(344): a, c, t, g, unknown or other
tcagcgtagactagcacgaccggtgctcgatttagcacacgatagttgggtttggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagatataatagtggtgctggtatcagcagaaaccaggaaancccctaaaggtcctagatatatgagacttctactttagaaagtggggtacccatcaaaggttcagcgcagtggatcngggacagaaattcactctcactatcaccagcctgcaaacctgatgattttgcaacttatactgcaacatatcatcatcattgtaatttcggaggtaggaccgaaagggtcggaaggtacgaaaacgaacgtgtaggaactgacaccatctgtactttaaac

SEQ ID NO: 385222 - DNA, 579 bp, Homo sapiens
  misc_feature: GZ8MTXP02HYVDX.17.35.D02.1.454.CMB.2.raw
  modified_base (197)..(197): a, c, t, g, unknown or other
  modified_base (266)..(266): a, c, t, g, unknown or other
  modified_base (366)..(366): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccggcagtcagatataataggtgtgctgatcagcagaaaccagggaaacncccctaaggtcctagatatatagagactttctaactttagaaagtgggtccatcgaaggttcagcgcagtggatcgtgggacagaattcactctcactancacagcctgcaaacctgatgtatttgactaactttattactacgtacctaaatacgtatacaatccaattctaaagtttcgttaaaagtttcggggtagggtaaacggggtaccgtaaaggggttacgggtaaacgggtaacgtaaaacggtaaacgttggttaacggccgttacggaccgtaacctaacgttccttacggtttactttcccg

SEQ ID NO: 385223 - DNA, 544 bp, Homo sapiens
  misc_feature: GZ8MTXP02HFDTY.17.35.D02.1.454.CMB.2.raw
  modified_base (199)..(199): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccggcagtcagatataatggtgtgctggtatcagcagaaaccaggaagcccctaaggtcctgatatatgagtacttctactttagaaagtcgggtcccatcaaggttccagcgcagtgatcgtggggacagtaattcactctcactatcaccagcctgaccaactgatgtatttgactaaacttattactagaccaactagtactacatacattactaatttagttaaagtttcgggtagggaacgggtaaccgtaagggtaggtaacggtacgaaaacggtaacgtggtaacggacgtacgacctaacctactcgttacgttccc

SEQ ID NO: 385224 - DNA, 564 bp, Homo sapiens
  misc_feature: GZ8MTXP02HR7HE.17.35.D02.1.454.CMB.2.raw
  modified_base (276)..(276): a, c, t, g, unknown or other
  modified_base (435)..(435): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtaggagacagagtcaccatcacttgccggcagtcagaatattaataggtggttggcctggtatcagcaagaaaccagggaaacncccctaaaggtcctagatatatgagtacttctaactttagaaagtggggtacccatcaaggttcagcggcagtggatcgtgggacagtaattcactctcactatcaccagcctgacaaccctgattgtattttgactaaactttattactgacctaaanagtatacatcattcgaatttagttaagtttcgggagggtaacgggaaccgtaaaggggtacggtaaacggttaacgaaaacggtaacgttggtacgggctacggacctaccattctcgttacctttacc

SEQ ID NO: 385225 - DNA, 525 bp, Homo sapiens
  misc_feature: GZ8MTXP02H8U3B.17.35.D02.1.454.CMB.2.raw
  modified_base (334)..(334): a, c, t, g, unknown or other
  modified_base (373)..(373): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggcagtcagaatataataggtggttggcctggatcagcagaaaccagggaaacgcccctaaggtcctagatatatgagacttctaactttagaaagtgggtccatacaggtcagnggcagtggatcgtggggacaggaaattcactctcactanccacagcctgacaactgatgtaatttgactaacttattactgactaaacagtatacatcatactatttagtaatttcggggaggtacgggtaaccgtagggtaggaggtacaaaacggtaactggtaggcgtcgacaccatctcgttcttcc

SEQ ID NO: 385226 - DNA, 534 bp, Homo sapiens
  misc_feature: GZ8MTXP02HSTOT.17.35.D02.1.454.CMB.2.raw
  modified_base (365)..(365): a, c, t, g, unknown or other
  modified_base (427)..(427): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtaggagacagagtcaccatcacttgccggcagtcagaatattataggtgtgctgatcagcagaaaccagggaaacgcccctaaaggtcctagatatatgagtacttctaactttagaaagttgggtaccatcaaggttcagcgcagtggatcgtgggacagtaattcacttcncactatcacacgcctgacaacctgacttgtaattttgactaactttattactgaacctaaanacgttaatcatactatctatttacgtaagtttcgggtaggacggaacgtaaggggtacgaggtacaaaacgaactggtagctggactaccgattctacgttcttacc

SEQ ID NO: 385227 - DNA, 558 bp, Homo sapiens
  misc_feature: GZ8MTXP02J0RUY.17.35.D02.1.454.CMB.2.raw
  modified_base (198)..(198): a, c, t, g, unknown or other
  modified_base (381)..(381): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtagganacagagtcaccatcacttgcccgggcagtcagaatatataggtggtgctggtatcagcagaaaccgagggaaacgcccctaaggtcctagatatatgagtacttctactttagaaaggtggggtcccatcaaggttcagcggcagtggatcgtgggacagaattcactctcactatacaccanccctgccaacctgatgtattttcgactaatttatactcccgacaactagtactacatctatctattagttaagtttcgggtaggtacgggaaccgtaagggtacgggtaaggttacgaaaacggtaacgtggttacggcgttacggacctacccgtattccgtacgttactttaccg

SEQ ID NO: 385228 - DNA, 618 bp, Homo sapiens
  misc_feature: GZ8MTXP02H015X.17.35.D02.1.454.CMB.2.raw
  modified_base (198)..(198): a, c, t, g, unknown or other
  modified_base (250)..(250): a, c, t, g, unknown or other
  modified_base (266)..(266): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtagganacagagtcaccatcacttgccggcagtcagtaatatagtaggtgtgctgatnagcaagaacaggaacncctaagtctagatatatagtaagtactttactaacgtttaaggaaacggttcggggtacccagtacgaaggttcacggcgacgtaggtggtatcggagggtacaagtaacttcactctacactactccaacactcctagacctaacctgtacttgttatttacgacttaactttattacctagtaaccctaaagtataactactatacctaattctaagtttaggtttaacggtttcgggtaacggggtaaacgggtaccgtaaagggggtacggtaaacggtaaaccgtaaacggtacgttacggtcggtaaccgtacgtaccaccgttattccttacgtttccttacccg

SEQ ID NO: 385229 - DNA, 566 bp, Homo sapiens
  misc_feature: GZ8MTXP02I9M9E.17.35.D02.1.454.CMB.2.raw
  modified_base (199)..(199): a, c, t, g, unknown or other
  modified_base (367)..(367): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtagganacagatcaccatcacttgccgggcagtcagaatattaataggtggttggctggtatcagcaagaaaccagggaaacgcccctaaggtcctagatatatagagtacttctactttagaagtgggtccatcagtcagcgcagtgatctgggacagattcactctcactancacagcctgccaactgatgtatttgactaaattacttactacgtaccaaactagtaactcattaccattactatttagtaaagtttacgggtaggggtaacgggtaaccgtaaaggggttaggaacgggttaaccgtaaaaacggtaccgttaggtcggggtacctacgggtaccaaccctagttccttacggtttccc

SEQ ID NO: 385230 - DNA, 541 bp, Homo sapiens
  misc_feature: GZ8MTXP02HG59V.17.35.D02.1.454.CMB.2.raw
  modified_base (197)..(197): a, c, t, g, unknown or other
  modified_base (356)..(356): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccgggcagtcagaatattaataggtggtgctggtatcagcagaaaccaggaaacgcccctaaggtcctgatatatgagacttctaacgtttaagaaagttggggtacccagtacgaaaggttcacgcggcagtggatcgngggacagtaattcactctcactatcacacgctgacaactgatgtatttgactaattatactagactaacagtactcaatctatctattacgttaagtttcgggtagggtaacgggtaaccgtaaggggttacggaagggtacgaaaacggtacgtagtacgcgtggaccactatctacgtcttac

SEQ ID NO: 385231 - DNA, 551 bp, Homo sapiens
  misc_feature: GZ8MTXP02I6L11.17.35.D02.1.454.CMB.2.raw
  modified_base (252)..(252): a, c, t, g, unknown or other
  modified_base (361)..(361): a, c, t, g, unknown or other
  modified_base (379)..(379): a, c, t, g, unknown or other
  modified_base (441)..(441): a, c, t, g, unknown or other
tcagcgtagactagcacgaccggtgctcgatttagcacacgatagttggggtttggggaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtccaccatcacttgccggcagtcagaatataataggtgtgctgtancagcagaaaccgaggaacgacccctaaggtcctagtatatatgagtacttactacctttaaggaaagttcggggtaccagtacgtaacggttcacgcggcagtgatcgngggacagtatcactctanactatcaccagctgactaactgatgtaatttcactaacgttattactacacctaaacattanacctatacgtataacttagtttagtaacgtttcgggaggtacgggaacgtaaggtcggtaacgtacaaaacgtacgtggtaacgctcgacctccgtattcgtacgtttcc

SEQ ID NO: 385232 - DNA, 544 bp, Homo sapiens
  misc_feature: GZ8MTXP02F55FW.17.35.D02.1.454.CMB.2.raw
  modified_base (197)..(197): a, c, t, g, unknown or other
  modified_base (233)..(233): a, c, t, g, unknown or other
  modified_base (296)..(296): a, c, t, g, unknown or other
  modified_base (350)..(350): a, c, t, g, unknown or other
  modified_base (373)..(373): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccggcagtcagatatanaggtgtgctggtatcagcagaaacaggaaacgcccctaaaggtcctagatatatgagtacttntactttagaaagtggggtacccagtcaaggttcagcgcagtgatcgtgggacanaattcactctacactatcaccancctgactaacctgacttagtattttgactaaactttatactgtaccaaagattatcaatcaattcgtattagttaagtttcgggaggtaacgggtacgtaagggtacgggacggtaaacgtaaacgtaaacgtgttacgggcttacggaccacgtatcgtactactttacc

SEQ ID NO: 385233 - DNA, 614 bp, Homo sapiens
  misc_feature: GZ8MTXP02IFRO1.17.35.D02.1.454.CMB.2.raw
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccacctgtctgcatctgtaggagacagagtcaccatcacttgccggcagtcagaatataataggtggttggctggtatcagcagaaaccgaggaaacgcccctaaggtcctagatatatgagtacttctaactttaagaaaggtcggggtacccatacgtaaggttcagcggcaggtggatcgtagggacagtaacttcactctcaactactccaaccacgccctgaccaaccgtgattgtattttgactaactttattactgacccaatagtatactaactctattactaagtttagttaaacggttttcggggagggtaacggggtaaccgtaaaggggttaggggtaaacggttaaaccgaaaacggtaaaaccgttgggttacgggaaccgtacggaacctaacccgtatttaccggttacgtttacccttttacc

SEQ ID NO: 385234 - DNA, 623 bp, Homo sapiens
  misc_feature: GZ8MTXP02IVUMX.17.35.D02.1.454.CMB.2.raw
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccacctgtctgcatctgtaggagacagagtcaccatcacttgccggcagtcagaatattaataggtggttggcctggtatcagcaagaaaccagggaaacgacccctaaggtcctagatatatagagtacttctaactttaaggaaacggttcggggtacccaagttacaaaggttcacggtcggctaggtggatcgtagggacagtaattcactctacactatccaccacgccctagacctaaccgtgtactagtattttacgacttaaactttacttactacgaaccctaaatacgttactacaattctaacttctaagtttaggttaaacgtttcggggtaagggtaacggggtaaccgtaaagggggttggaaacgggttaaccgaaaacggtaacgttggtacgggcttacggacctaaccgtacttcgttcgttactttaaccg

SEQ ID NO: 385235 - DNA, 559 bp, Homo sapiens
  misc_feature: GZ8MTXP02F32LL.17.35.D02.1.454.CMB.2.raw
  modified_base (181)..(181): a, c, t, g, unknown or other
  modified_base (235)..(235): a, c, t, g, unknown or other
  modified_base (333)..(333): a, c, t, g, unknown or other
  modified_base (346)..(346): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctntctgcatctgtaggagacagagtcaccatcacttgccggcagtcagaatataanaggtgtggcctggatcagcagaaccaggaaagccctaaggtcctgatatatgagacttctactttagaaagtggggtaccatcaaaggttcacgcggnagtgatcgagganagtatcactctacactactacacacgctcactactagatagtattagtactaacttacttactacgtacaactagtactactactactacttacttacgttagttacgtttacgggtacgggtaacgggtaacggtaaggtacgggtaacggtaacgtaaacggtaaacgtacgtacggtaacgtcgtacgtactacgtacgttcgttacttc

SEQ ID NO: 385236 - DNA, 548 bp, Homo sapiens
  misc_feature: GZ8MTXP02I2H3T.17.35.D02.1.454.CMB.2.raw
  modified_base (272)..(272): a, c, t, g, unknown or other
  modified_base (359)..(359): a, c, t, g, unknown or other
  modified_base (363)..(363): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagatcaccatcacttgccggcagtcagatattaataggtggttggctggtatcagcaagaaaccagggaaacnccccgtaaggtcctagatatatgagactttctaatttagaaacggttggggtaccccagtcgaaaggttcacgcggcagtggatcgngggnagaattcactctacactactcacacgcctgacaacctgactgtatttgactaacttattactgacctaatacgtatacattcatctaattgttaagttcgggaggaacggggtacgaaagggtcgggaagttacgaaaacgtacgtggtacggctacggacacctataccgttcgtactttaccg

SEQ ID NO: 385237 - DNA, 587 bp, Homo sapiens
  misc_feature: GZ8MTXP02F4QSL.17.35.D02.1.454.CMB.2.raw
  modified_base (197)..(197): a, c, t, g, unknown or other
  modified_base (236)..(236): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccggcagtcagaatattaanaggtggtgctggtatcagcaagaaacgagggaaacgcccctaaggtcctagatatatgagtactttactaactttaaggaaaggtcggggttacccaagtacgtaaaggttcacggcggacgaggtaggatcgtaggggacagtaattcactcctacactactcaccacgcctagacaacctgattgtattttgacttaacttattactagacctaaactagttaactacactactatacgtaatttacgtaagtttcggggacggtaacggggacgtaagggtacggtaacggtaacgtaaacggtacgtggtacggctacggacctaccgtattacgtacgttctttcg

SEQ ID NO: 385238 - DNA, 544 bp, Homo sapiens
  misc_feature: GZ8MTXP02G9FW1.17.35.D02.1.454.CMB.2.raw
  modified_base (265)..(265): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagatcaccatcacttgccggcagtcagaatataataggtgtgctgtatcagcagaaccaggaaacncccctaaggtcctgatatatgagtacttactactttagaaagttcggggtcccaagtacaaaggttcacgcggcagtggatcgtgggacagtaaattcactctcactatccacacgcctgacaacctgactgtatttgactaaactttattacctagacccaatactatacaatcaagttctaatttgtaaacgtttcggagggtaacgggaccgtaaagggtcgggtaaaggtacgaaaacgaacgtggtaggccttgaccacctatctactcttacc

SEQ ID NO: 385239 - DNA, 562 bp, Homo sapiens
  misc_feature: GZ8MTXP02IRLJ2.17.35.D02.1.454.CMB.2.raw
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtaggagacagagtcaccatcacttgccgggccagtcagaatattaataggtgttggctggtatcagcagaaacagggaaagcccctaaggtcctgatatatgagtacttctactttagaaagtggggtcccatcaaaggttcacgcgcagtggatcgtgggacagaattcactctcactatcaccagcctgcaaaccctgacttgtattttgacaactttagttaactgacctaacagttatacatcattacgatttgtaaatttcgggtgggtaacgggaccgtaaagggttcggggtaaaggtaccgtaaaacggtaaaccgtggtacgggcttacggctaaaccctatcctttcggttacctttacg

SEQ ID NO: 385240 - DNA, 591 bp, Homo sapiens
  misc_feature: GZ8MTXP02JTN9M.17.35.D02.1.454.CMB.2.raw
  modified_base (247)..(248): a, c, t, g, unknown or other
  modified_base (265)..(265): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggcagtcagaatatataggtgtgctgtannagcagaaccaggaaacncccctaaggtcctagatatatgagtacttctaatttagaaagttgggtcccagtcaaggttcaggcgcaggtggatcgtagggacagtaattcactctcactatcaccagcctgaccaacctgattagtattttcgactaaactttattacctcgaccctaaagtacttatacctattactattactaatttaggttaaagttttcggggtaaggggtaacggggtaaccgtaaagggggttacgggtaaagggttaaccgaaaacggtaacgttgggtacgggtcttacggacctaaccgtatttccgtacggtttcctttaccg

SEQ ID NO: 385241 - DNA, 580 bp, Homo sapiens
  misc_feature: GZ8MTXP02JRU3U.17.35.D02.1.454.CMB.2.raw
  modified_base (247)..(248): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggcagtcagaatatataggtgtgctgtannagcagaacaggaaacgcccctaaggtcctagatatatgagacttctactttagaaagtggggtcccagtcaaggttcagcgcagtgatcgtgggacagaattcactctacactactcaccagccctgaccaacctgatgtatttcgacttaactttattactacgaccctaaactagtactacaacttacctaattacctaatttaggttaaacgttttacggggtagggtaacggggtaaccgtaaaggggttacgggaaagggttaaccgaaaacggtaacgtggtacggaacgttacggacctaccgtactccgttcgttacctttacg

SEQ ID NO: 385242 - DNA, 574 bp, Homo sapiens
  misc_feature: GZ8MTXP02FU2TE.17.35.D02.1.454.CMB.2.raw
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgcccgggccagtcagaatattaataggtggttggcctggtatcagcaagaaaccaggggaaacgacccctaaggtcctgatatatgagtacttcttactttaagaaagtggggtacccatacaaggttcagcggcagtggatcgtggggacagaatcactctacactatcaccagcctgcaacctgatgtattttgactaactttattactcgtaccaaacagttatactaatctaacttctaagtttgttaaagttttcggggtaggtaacggggtaccgtaaaggggtgggtaacggttaaccgaaaacggtaaacgtggttaggcgttaggaccaaccattactcggttctttacc

SEQ ID NO: 385243 - DNA, 549 bp, Homo sapiens
  misc_feature: GZ8MTXP02I4XXJ.17.35.D02.1.454.CMB.2.raw
  modified_base (199)..(199): a, c, t, g, unknown or other
  modified_base (252)..(252): a, c, t, g, unknown or other
  modified_base (254)..(254): a, c, t, g, unknown or other
  modified_base (336)..(336): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccggccagtcagaatataatggtgtgctggtatnancagaacaggaacgcccctaaggtcctgatatatgagtacttctactttagaaagtcgggtacccatctaaggttccagcggnaggtgatcgtggggacagaattcactctcactatcaccagcctgcctaactgattgtatttgactaaactttagttactcgtaccaaactagttaactcatctatacgttatttagtaaacgtttcgggtaggaggggaaacctaaggggttacggaacggtaaccgaaaacggtcgtaggtaacggcttacggacacctatccgttgtttac

SEQ ID NO: 385244 - DNA, 554 bp, Homo sapiens
  misc_feature: GZ8MTXP02H2YCT.17.35.D02.1.454.CMB.2.raw
  modified_base (271)..(271): a, c, t, g, unknown or other
  modified_base (279)..(279): a, c, t, g, unknown or other
  modified_base (284)..(284): a, c, t, g, unknown or other
  modified_base (329)..(329): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccacgatgacccagtctccttccacctgtctgcatctgtagagacagagtcaccatcacttgccggcagtcagaatattaataggtgttggctggtatcagcagaacctaggaaaccncctagcanatatngatcttactagttaggaacggtcggaccatacgtaagtcacgcgntaggtgactcggaggacagtactcactctacactactaccacgtacgcctacgactacgtagatagttagtttacgtactaacttaacttacgtactactaactactactactactactatactacgttagttacgttacggtacggtaacggtacgtaggtacggtaacggtaacgtaaacgtaacgtagtacgtaacgtacgactactactactactactacg

SEQ ID NO: 385245 - DNA, 606 bp, Homo sapiens
  misc_feature: GZ8MTXP02H3YBI.17.35.D02.1.454.CMB.2.raw
  modified_base (336)..(336): a, c, t, g, unknown or other
  modified_base (346)..(346): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtaggagacagagtcaccatcacttgccggcagtcagaatataataggtgtgctgatcagcagaaacaggaaacgcccctaaagtcctgatatatgagactttctaactttagaaagttggggtccaatcgaaggttcagtcggnagtggatcgnggacagaatcactctcacatcagcagtctagccaactagaagtatttacgtctaaacttactaaccttgtacctaacaagtaacgttaacctaaactacccccttcggtaccgttactaaccgttttaccggggacgggttaaaaccggggacctaaaacgggtccgtaggggtaaacgtaacgttaaaccgaaaaccggttaacgtacggttaacggacgttaccggactaaacccgtacttccgtttacggtttaccc

SEQ ID NO: 385246 - DNA, 584 bp, Homo sapiens
  misc_feature: GZ8MTXP02ITYAF.17.35.D02.1.454.CMB.2.raw
  modified_base (272)..(272): a, c, t, g, unknown or other
tcagcgtagactagcacgaccggtgctcgatttagcacacgataggttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtaggagacagagtcaccatcacttgccgggcagtcagaatattataggtgtggctggtatcagcagaaaccagggaaancccctaaaggcctgatatatgagtacttctactttagaaagtggggtcccagtcaaaggttcacgcggcagtggatcgtagggacagattcactctcactatcacagcctagctaacctgactgtatttgactaatttatactgactaatagtatacatacatactaatttggttaaatttcgggggtacggtaaaacggggtaccgtaaagggggtttcgggaaaacgggttaaccgtaaaacggtaaacgttgggtacgggtaacttacggaccgtaaaccgtacttccgtttacggttccttttaaccg

SEQ ID NO: 385247 - DNA, 546 bp, Homo sapiens
  misc_feature: GZ8MTXP02FMBJS.17.35.D02.1.454.CMB.2.raw
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggcagtcagaatattaataggtggttgctggtatcagcagaaccaggaaagcccctaaaggtcctgatatatgagacttctactttagaaaggtggggtcccagtcaaggttcagcggcagtggatcgtgggacagaattcactctcactatcaccagccctgcaacctgatgacttttgactaactttattactagtaccaactagtaatcaatcaatctaattgttaaagtttcggtaggtacgggaccgtaaaggggtaggaaggtaactaaaacggaaacgtggttaacgggcttacggaccaactattacctgttactttccg

SEQ ID NO: 385248 - DNA, 586 bp, Homo sapiens
  misc_feature: GZ8MTXP02JUT0M.17.35.D02.1.454.CMB.2.raw
  modified_base (199)..(199): a, c, t, g, unknown or other
  modified_base (280)..(280): a, c, t, g, unknown or other
  modified_base (581)..(581): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtagganacagagtccaccatcacttgccggcagtcaagtaatattaagtaggtggttgctggtatcagcaagaaaccgagggaaacnccccgtaaggtcctagatatatgaagtactttactaacgtttaaggaaaggttcggggtaccctaagtaccgtaaaggttccgaggcggactaggtggacttcgtggggaactaagtaacttcaactcgtacactactacacctagcctagaccaactgattgtatttcgactaaatttatacgtacactaacgattatactatactatactattagttaacgttcgggtaggaacgggtacgtaaggggtacggaaacggtacgaaaacgtagttggtaagtcgtagccacctagttctnttacc

SEQ ID NO: 385249 - DNA, 587 bp, Homo sapiens
  misc_feature: GZ8MTXP02IMOFO.17.35.D02.1.454.CMB.2.raw
  modified_base (406)..(406): a, c, t, g, unknown or other
  modified_base (439)..(439): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcatctgtaggagacagatcaccatcacgttgccggccagtcaagaatattaagtaggtggttgctggtatcagcaagaaaccgagggaaacacccctaaggtcctagatatatgatacttctaacgtttagaaaggtcgggtaccagtacgtaaggttccaggcgacgtaggtggatcgtggggacaagtaacttcactctactactatccaccagccngaccaactgaattgtatttagacttaaactttnttaacacgtaccaacgtattactacctatactattactatttacgtaagtttcgggtacggaacggggtaactaaggggttacggaaacggtacgtaaaacggtagttacggtgacgttacgaccctaactacgttcgttacgttccc

SEQ ID NO: 385250 - DNA, 550 bp, Homo sapiens
  misc_feature: GZ8MTXP02FG02H.17.35.D02.1.454.CMB.2.raw
  modified_base (256)..(256): a, c, t, g, unknown or other
  modified_base (271)..(271): a, c, t, g, unknown or other
  modified_base (384)..(384): a, c, t, g, unknown or other
  modified_base (403)..(403): a, c, t, g, unknown or other
  modified_base (538)..(538): a, c, t, g, unknown or other
  modified_base (545)..(545): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtcctccttccaccctgtctgcatctgtaggagacagagtcaccatcacttgccgggccagtcagaatataataggtggttgctgtatnagcagaaacaggaancccctaaggtcctgatatatgagtacttactacttaggaaaggttcggggtacccagtctaaggttaccaggcggacagtggatcgtgggacaagtaattcactctacactancaccagcctgactaacctnattagtatttagactaaacttatactacgtaccaataagtatcctaatacattacattagttaaagtttcggaggtacgggacgaaagggtggaacggtaacaaaacggtatcggtaaggctacggaccaccgtntaccgtnttacc

SEQ ID NO: 385251 - DNA, 571 bp, Homo sapiens
  misc_feature: GZ8MTXP02GQDRL.17.35.D02.1.454.CMB.2.raw
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggcagtcagaatattaataggtgtgctggtatcagcagaaaccagggaaacgcccctaaggtcctagatatatagagtacttctaactttagaaaggtcggggtacccagtacaaggttcaggtcgcagtggatcgtagggactagtaaattcactctacactactccgacctacgccctagacaaacctgactgttattttcgacttaacttattactagaccctaatatatcatcctatcgtaatttagtaaacgttttcggggaggtaacgggtaaccgtaaggggttacggaaggttaacgaaaacgtaacgtggtaggctcggactacctactcttacgtactttac

SEQ ID NO: 385252 - DNA, 632 bp, Homo sapiens
  misc_feature: GZ8MTXP02I2SAQ.17.35.D02.1.454.CMB.2.raw
  modified_base (356)..(356): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtcctccttccaccctgtctgcatctgtaggagacagagtcaccatcacttgccggcagtcagaatattaataggtggttggcctggtatcagcagaaaccagggaaacgcccctaaaggtcctgatatatagagacttctactttagaaagttggggtacccatacaaggttccagtcgcagtggatntggggacaggaattcactctacactactcaaccacgcctagaccaacctgatacggtatttgacttaaacttatttaactacgtaccaaaccgtataacttacatactaactacctaagtttagtaaacgttttccggggtaaggggtaacgggtaacccggtaaaacgggttagggggtaaacggttaccgtaaaaaacgggtacccgttaagggttcgggtaaccgtttacggggtacccgaacccgtaacttccggtttaaacggttttcccg

SEQ ID NO: 385253 - DNA, 535 bp, Homo sapiens
  misc_feature: GZ8MTXP02FGXSO.17.35.D02.1.454.CMB.2.raw
  modified_base (420)..(420): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcacatcacttgccggcagtcagaatattaataggtgttgcctggtatcagcaagaaaccagggaaacgcccctaaaggcctgatatatgagacttctactttagaaagtggggtcccatacaaggttcagcggcagtggatctggggacagaattcactctcactatcaccagcctgcaacctgatgtaatttgactaacttattactgaccaaanagtatctatcaattctattagtaaagtttcgggtaggacgggtaccgaagggttagggaaacgggttacaaaaacgtacgtaggtacggcgtacggccactatcgtcgtctttcc

SEQ ID NO: 385254 - DNA, 540 bp, Homo sapiens
  misc_feature: GZ8MTXP02F47UZ.17.35.D02.1.454.CMB.2.raw
  modified_base (246)..(247): a, c, t, g, unknown or other
  modified_base (249)..(250): a, c, t, g, unknown or other
  modified_base (262)..(262): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtcctgcatctgtaggagacagagtccacatcacttgccggcagtcagaatatatggtgtgctgannannagaacaggaacnccctagtctgatatatgatacttctactttagaaaggtcgggtacccagtacaaggttcacgcggacaggtggatcgtgggactagtaattcactctacacttataccacacgcctacgactaaccgtgattagttactttgaacttaactttattactcgaacctaatagtactacactcatcttatttagttaagtttcgggaggtaacggtacgtaagggtacggaagtacgaaaacgtacgtggtagcgtagccgactattctacgttcttacg

SEQ ID NO: 385255 - DNA, 577 bp, Homo sapiens
  misc_feature: GZ8MTXP02IGCZM.17.35.D02.1.454.CMB.2.raw
  modified_base (198)..(198): a, c, t, g, unknown or other
  modified_base (252)..(252): a, c, t, g, unknown or other
  modified_base (368)..(368): a, c, t, g, unknown or other
  modified_base (436)..(436): a, c, t, g, unknown or other
  modified_base (444)..(444): a, c, t, g, unknown or other
  modified_base (448)..(448): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtagganacagagtcaccatcacgttgccggcagtcagaatatataggtgtgctggatcancagaaaccaggaaacgcccctaaggtcctgatatagtgaagtacttacttaactttaggaaaggttcggggtaccccaagtacgtaaaggttcaggaccggacgagttggattcgngggacagtaattcactctacactatccgacagcctagacaactgatgtatttgactaattagttactnacctaagnttancatctaagtctaagtttgttaaagtttcggggaggtaacgggtaaccgtaaggggtacggtaacgggtaacaaaacggaacgtttggacggaactcggaacgaaccctagtcctttacgtacctttccg

SEQ ID NO: 385256 - DNA, 567 bp, Homo sapiens
  misc_feature: GZ8MTXP02GF1GZ.17.35.D02.1.454.CMB.2.raw
  modified_base (284)..(284): a, c, t, g, unknown or other
  modified_base (366)..(366): a, c, t, g, unknown or other
  modified_base (383)..(383): a, c, t, g, unknown or other
  modified_base (388)..(388): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggcatcagaatattaatagtaggttgctggtatcagcagaaaccagggaaagcccctaaggtcctnagtatatgagacttctactttaagaaagtggggtcccatctaaaggtttagacgcagtggatcgtggacagaattcactacncctataactcaaacccncgccncacaactgtatattatttacactaaacttattactacgaccaacgtatatactactactattatacgtttagttaagttccgggtagggaacggtaaacggtaagggtaggtaaacgtaacgaaaacgtaacgttcggtcggtacgtaacgaactaacgtactcgtacttcttactacg

SEQ ID NO: 385257 - DNA, 559 bp, Homo sapiens
  misc_feature: GZ8MTXP02HQ0NO.17.35.D02.1.454.CMB.2.raw
  modified_base (199)..(199): a, c, t, g, unknown or other
  modified_base (238)..(238): a, c, t, g, unknown or other
  modified_base (254)..(254): a, c, t, g, unknown or other
  modified_base (272)..(272): a, c, t, g, unknown or other
  modified_base (283)..(283): a, c, t, g, unknown or other
  modified_base (384)..(384): a, c, t, g, unknown or other
  modified_base (401)..(401): a, c, t, g, unknown or other
tcagcgtagactagcacgaccggtgctcgatttagcacacgatagttgggtttggggaggagtcagacccagtcaggacacagcatggacatgagggtcccccgctcagctcctggggctcctgctgctctggctcccaggtgccagatgtgacatccagatgacccagtctccttccacctgtctgcatctgtagganaacagagtcacatcacttggccggcagtcagaatattanaggtggtgctggtacnagacaagaacgaggaacncctaagtctanatatatagatacttactaagttaggaagtcggaccatagtagtcgagcgagaggtgataggtgaactaagtaactctactctacaactactaccgactacnccgacgtaacctacgtntaattacttagttacgtaacttaacgtttatactacgaactaaactataatcactactactactattagttaagttaggtacggtaaggtaacggaacggtaaggtaacgtaacgtaaacgtaacgtacgtcgtacgtacgacactactacgttcgtc

SEQ ID NO: 385258 - DNA, 586 bp, Homo sapiens
  misc_feature: GZ8MTXP02HI4HX.17.35.D02.1.454.CMB.2.raw
  modified_base (438)..(438): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatcgacccagtcctccttccaccctgtctgcatctgtaggagacagagtcaccatcacgttcggccgggccagtcaagtaatattaagtaggtggtggcctggtatcgagacaacgaaaccgagggaaacgcccgtaaggtcctagatatagtagaagtactttacttaacgtttaaggaaacggttcggggtacccctaagtaccgtaaaggtttcgaacggcgggactaggtcggagttacgaggggactagtaaacttcactctacactactacaccngctgcaactgattgtattcgactaattatcagccaatatatacatacgatactattagttagttcggaggtacgggacgtaagggtggaaagtaacgtaaccgaatggtacgcgtcgaacctaccgtattccttcgtttacgtttacc

SEQ ID NO: 385259 - DNA, 597 bp, Homo sapiens
  misc_feature: GZ8MTXP02GO0DL.17.35.D02.1.454.CMB.2.raw
  modified_base (280)..(280): a, c, t, g, unknown or other
  modified_base (485)..(485): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtaggagacagacgtccacatccacttcggccggcagtcaagaattattaagtggtggtgctggtatcagcaagaaaccgaggaaaccncccgtaaggtcctagatatatgacgtactttacttaagtttaagaaacggttcgggtacccaagtacgtaaaggttcaacggtcggtacaggtacggtacgtcgttagggactagtacttacactctacacttacaccaccacgctacgactaacctgagttagtatttcgaacttaactttaattctacgacctaaagtactanactaagtctagtactagtttagtaaacgttgggacggtaacggaccgtaaaggtcggtaaacgtacgaaaaccgtagcggtaggctacggactaccgatctcgtactttacc

SEQ ID NO: 385260 - DNA, 571 bp, Homo sapiens
  misc_feature: GZ8MTXP02IIXBL.17.35.D02.1.454.CMB.2.raw
  modified_base (200)..(200): a, c, t, g, unknown or other
  modified_base (257)..(257): a, c, t, g, unknown or other
  modified_base (279)..(279): a, c, t, g, unknown or other
  modified_base (408)..(408): a, c, t, g, unknown or other
  modified_base (474)..(474): a, c, t, g, unknown or other
tcagcgtagactagcacgaccggtgctcgatttagcacacgatagttgggtttggggaggagtcagacccagtcaggacacagcatggacatgagggtccccgctcagctcctggggctcctgctgctctggctcccaggtgccagatgtgacatccagatgacccagtctccttccaccctgtctgcattctgtagganacagacgtccacatcacttcggccggcagtacagaatataataggtgttgctggtancagacaagaaaccgaggaaccnccccgtaaggtccagtatagtatgagtacttactaactttaggaaagtcgggtacctagtacgtaggtccaggcgacgagtgatcgaggggacaagtaacttccacttcacactactacaccagcctanacgaactgtattagttactttacgacttaaacttactaacgacgtaccaaacgtataactacgtanactagtatatttagtaacgttggggaacgaaggtacgagggttaggaacgtaccgaaaaggtcgtaggtaacgctacgaaccactactccgttactc

SEQ ID NO: 385261 - DNA, 592 bp, Homo sapiens
  misc_feature: GZ8MTXP02IAFZQ.17.35.D02.1.454.CMB.2.raw
  modified_base (291)..(291): a, c, t, g, unknown or other
  modified_base (345)..(345): a, c, t, g, unknown or other
  modified_base (384)..(384): a, c, t, g, unknown or other
  modified_base (391)..(391): a, c, t, g, unknown or other
tcagcgtagactagcacgaccggtgctcgatttagcacacgatagttgggtttgggggagtcagacccagtcaggacacagcatggacatgagggtcccccgctcagctcctggggctcctgctgctctggctcccaggtgccagatgtgacatccagatcgacccagtcctccttccaccctgtctgcatctgtaggagacagatcaccatcacttggccgggcagtacaagtaatattaagtaggtgtgctgatcagcaagaacaggaactcctaaggtctagatatangagtcttacttaagtttaggaaacgttcgggtacccagtacgaaggttcacggngacgagtggattcgagggactagaatcactcacactacncctaacngtctcgacctactgatgttaattcgacttaacttatctacgactaatgtactatatatacgttatagtttagttagttacggggtaggtaacggtaaccggtaggggtaaacgtacggtaaaccgtaaaacggtacggtttacgacggtccgttaacgacccgtaacttaaccgtttccgttacgtttaccctttaacccg

SEQ ID NO: 385262 - DNA, 584 bp, Homo sapiens
  misc_feature: GZ8MTXP02J17S4.17.35.D02.1.454.CMB.2.raw
  modified_base (360)..(360): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtcctccttccaccctgtctgcatctgtaggagacagatcaccatcacttgccgggcagtcagaatattaagtaggtggtgctgatcagcaagaaaccaggaaaccgccccgtaaggtcctagatatatgagtacttctaactttaaggaaacggtgggtacccagtacgaaggttcacgcggctaggtgatcgngggacagtaacttcactcacactataccaccagccctagacctaaaccgtgtatggttaacttttacacttaaactttacttaactcgaactaacgtattactactacttactaacgtacttagtttaggttaaacgtttcgggggtaagggtaacggtaaaccggagggtaggtaacggtaacaaaacgtacgtaggtgcgtcgactacgcttcgtctctccg

SEQ ID NO: 385263 - DNA, 573 bp, Homo sapiens
  misc_feature: GZ8MTXP02IEQV1.17.35.D02.1.454.CMB.2.raw
  modified_base (199)..(199): a, c, t, g, unknown or other
  modified_base (229)..(229): a, c, t, g, unknown or other
  modified_base (250)..(250): a, c, t, g, unknown or other
  modified_base (268)..(268): a, c, t, g, unknown or other
  modified_base (445)..(445): a, c, t, g, unknown or other
tcagcgtagactagcacgaccggtgctcgatttagcacacgatagttgggtttggggaggtcagacccagtcaggacacagcatggacatgagggtcccccgctcagctcctggggctcctgctgctctggctcccaggtgccagatgtgacatccagatgacccagtcctccttccaccctgtctgcatctgtagganacagagtcaccatcacttgccgggcatcanaatatataggtggtgctgatnagcaagaaccaggaaacnccctaaggtctgatatatagaatactttactaattagaaaggttcgggtacccaatcgaaggttcacggtcggactaggtggatcgtagggactaagaaattcacttctacactagccaacagtccctgacctaacgtgaattgtaatttcactaatttacttaactcgacctaaanagttacatatacgtaattctaagtttagttaacgttacggggtaggtacggaaccgtaaagggcggtaaaagtccgaaaagtacttcgagggttaaccgcgtaaccactacgttccgtacgttctacg

SEQ ID NO: 385264 - DNA, 612 bp, Homo sapiens
  misc_feature: GZ8MTXP02G1HKA.17.35.D02.1.454.CMB.2.raw
  modified_base (202)..(202): a, c, t, g, unknown or other
  modified_base (259)..(259): a, c, t, g, unknown or other
  modified_base (307)..(307): a, c, t, g, unknown or other
  modified_base (355)..(355): a, c, t, g, unknown or other
  modified_base (377)..(377): a, c, t, g, unknown or other
  modified_base (389)..(389): a, c, t, g, unknown or other
  modified_base (436)..(436): a, c, t, g, unknown or other
  modified_base (458)..(458): a, c, t, g, unknown or other
tcagcgtagactagcacgaccggtgctcgatttagcacacgatagttgggtttgggggaggagtcagacccagtcaggacacagcatggacatgagggtcccccgctcagctcctggggctcctgctgctctggctcccaggtgccagatgtgacatccagatgacccagtcctccttccaccctgtctgcatctgtagganacagagtcaaccatcacttgccgggcagtcagaatattaataggtggtggctggtancagacaagaaaccagggaaacgcccctaaggtcctagataatatgaanactttctaactttagaaaggtgggtacccatacgaaggtccagcgganagtgatcgtgggacagtaattnctactcaactancgaaccagcctagacctaacgtagatagtatttagaccttaaatttntacagtaaccaaattagactanactacgaattacaacgttttataaacgtttacggggtaggggaacgggtaaaaccggtaaagggtaggggaaacggtttaaacccaaaaacggtaacgtttaaggtcgggtacctacggtaaacccaaccgttattacccgttaggtttacccc

SEQ ID NO: 385265 - DNA, 701 bp, Homo sapiens
  misc_feature: GZ8MTXP02F9TUT.17.35.D02.1.454.CMB.2.raw
  modified_base (141)..(141): a, c, t, g, unknown or other
  modified_base (505)..(505): a, c, t, g, unknown or other
tcagcgtagactagcacgaccggtgctcgatttagcacacgatagttggggtttgggggagtcagacccagtcaggacacagcatggacatgagggtccccgctcagctcctggggctcctgctgctctggctcccaggtnccagatgtgacatccagatcgacccagtcctccttcccaccctgtctgctatcgtggtaggagacagactccacatccacgttcggcccgggaccagtacaagtaaattaagttaagtagggttggttcggccgtaggtatcagacaaacgaaaccgaagggaaccgacccgtaagtcctagactatatgtacgtactttacttaacgtttaaggaaacggtcgggtaccctaagtacggtaaggttcaacgggccggtacgtaggtacggtatacggtagggacgtagtaacttacgtaccttcctactaactaactccaaccgtacgtccgtacgactaaccttggtacttagttactttanaaccttaaatttacgtactactaaccgtaaatattaactactaaactctaacgttacgttaagtttacggttaacggtttacggggaaggggtaaaacggacggttaaaggggtacggtaaaacggtaaccgtaaaacggtacgtggtaccggtaacgtacgtactaccgttattccggtacgtttcctttaaccc

SEQ ID NO: 385266 - DNA, 751 bp, Homo sapiens
  misc_feature: GZ8MTXP02FFSWS.17.35.D02.1.454.CMB.2.raw
  modified_base (192)..(192): a, c, t, g, unknown or other
tcagcgtagactagcacgaccggtgctcgatttagcacacgatagttgggtttgggggagtcagacccagtcaggacacagcatggacatgagggtccccgctcagctcctggggctcctgctgctctggctcccaggtgccagatgtgacatccagatgacccagtctcctccacctgtctgcatctgagnacagatcacatcacgtcgccggcagtcaagtaatagttagtaggtggtgctggtatcagacaagaaaccgaggaacgccctaagtcctagatatagtgtagtactttactaacgttaagaaaggtcggggtaccctagtacgtaaaggttcaacggtcgacgagtggactcggtagggaccagaaacttcgaccttctacacctaagtacccacccgtaacgtcccgtacgtaccctaaaccgtttgaaacgtttacgtttaacgtttttaccggaaaccctttaaaaaccgttttaacctttacccggttaaacggtaaccccctaaaaagttaaccggtttaaacgttaaacctaaccgttaacgtaaactttacccgttaaaaggttttacgggttaaaaaccggtttttcgggggggaaaccgggtaaaacggggggtaaaaccgtttaaagggggtaacggtaaaccggttaaaaccggaaaaccgggttaaccggtgtaacggggaaccgttaccggaacctaacgtctttacgtcggttacccctttaaccg

SEQ ID NO: 385267 - DNA, 513 bp, Homo sapiens
  misc_feature: GZ8MTXP01DRP60.10.50.E06.1.454.CMB.2.raw
  modified_base (229)..(229): a, c, t, g, unknown or other
  modified_base (259)..(259): a, c, t, g, unknown or other
  modified_base (505)..(505): a, c, t, g, unknown or other
tcagcatagtagtgcacgaccggtgctcgatttagatctactgacaacacacaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttatactatgtctcngtacaacaacaccaggcaaacgccccaaatcataattcatgatgtacaataatcggccctctaggggtttctaactccgctttctctggtcttccaagtcgtggccaaacgcggcctcctgaccatctcgtgggctccgaggctgaggacgaggctgattattactgcagctacatactacaaccagcagcacgtcgggtgttcggcggaggaccaagcgttgaccgtctaggtcacgccaggtcncgtccccg

SEQ ID NO: 385268 - DNA, 520 bp, Homo sapiens
  misc_feature: GZ8MTXP01B8HMZ.10.50.E06.1.454.CMB.2.raw
  modified_base (259)..(259): a, c, t, g, unknown or other
  modified_base (424)..(424): a, c, t, g, unknown or other
  modified_base (454)..(454): a, c, t, g, unknown or other
tcagcatagtagtgcacgaccggtgctcgatttagatctactgacaacacacaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctccnggtaccaacaacacccaggcaaacgccccaaatcataattcatgatgtcaataatcgcctcaggggtttctaatccgacttctctggcttcaagtctggcaaacacggcctccctgacccatctctgggctccaggctgaggacgaggctgattattacgtgacngctcatactaacaacagcagtcacgtttcngttagtcgggcggaaggcccaagcttcggaaccgtctaacgggtcacggaccctaaggcctcccgg

SEQ ID NO: 385269 - DNA, 507 bp, Homo sapiens
  misc_feature: GZ8MTXP01BG478.10.50.E06.1.454.CMB.2.raw
  modified_base (227)..(227): a, c, t, g, unknown or other
  modified_base (258)..(258): a, c, t, g, unknown or other
  modified_base (432)..(432): a, c, t, g, unknown or other
tcagcatagtagtgcacgaccggtgctcgatttagatctactgacaacacacaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcnggtacaacaacaccaggcaaacgcccccaaatcataattcatgatgtcaataatcggcctcaggggtttctaatccgcttctctggcttcaagtctggcaacacggcctcctgaccatctctgggctccagctgagacgaggctgattatacgtgcagctacatactacaaccngcagcacgtcgggtgttccgggcggaggggaccaaggcgttgacccgtcaggtcacgcccaagccgttcgccccg

SEQ ID NO: 385270 - DNA, 532 bp, Homo sapiens
  misc_feature: GZ8MTXP01B6CKT.10.50.E06.1.454.CMB.2.raw
  modified_base (306)..(306): a, c, t, g, unknown or other
  modified_base (460)..(460): a, c, t, g, unknown or other
  modified_base (474)..(474): a, c, t, g, unknown or other
tcagcatagtagtgcacgaccggtgctcgatttagatctactgacaacacacaagggggggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcgatcaccatctcctgcactggcacagcagtgacataggtgcttataactatgtctcctggtaccaacaacacccgaggccacggccccagactcatcatttcngatgtcagtgacgtcggtcccctttgggtatttctaatcgtcttctctgcctcaagtctcggacacacgtcttcctcgaccactccgtccggtctccacgctacggaggacgacggcgtctaattactacgtgcagtctacatactacgaccgngggctacttctcgngtagtcgttcgggcggacgggtaactcggctcggaccgttcctaacgttcgaacccgg

SEQ ID NO: 385271 - DNA, 602 bp, Homo sapiens
  misc_feature: GZ8MTXP01EOD0N.10.50.E06.1.454.CMB.2.raw
tcagcatagtagtgcacgaccggtgctcgatttagatctactgacaacacacaaggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactggaaccagcagtgacgttggtgttataactatgtctctgtaccaacaacaccaggacaaacgccccaactcatgtatttttgattgtactagtaactccggtccctcgtaggggtttctaagtcgtccttctcgtggctcctaaagtctggaccaaaccgaccgtccctcccgtcgacctacttcctcgtgggcctccgaggtctaggacgggacggtacggcttagtaatttactacgtgggctaagtcctacaatactaaccaaccgagccaagtcctaacgttctggttaacgttccggggacggttaacgggaccctaagccgttcggttacccggttcgtaggtccgacgaccccgagtcccgttcccgtcccccg

SEQ ID NO: 385272 - DNA, 543 bp, Homo sapiens
  misc_feature: GZ8MTXP01BAME7.10.50.E06.1.454.CMB.2.raw
  modified_base (229)..(229): a, c, t, g, unknown or other
  modified_base (262)..(262): a, c, t, g, unknown or other
  modified_base (295)..(295): a, c, t, g, unknown or other
  modified_base (376)..(376): a, c, t, g, unknown or other
tcagcatagtagtgcacgaccggtgctcgatttagatctactgacaacacacaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtagttataactatgtctccnggtaccaacaacacccaggcaaacgccccaaancataatcatgatgcaatatcgccctgaggggtttctaatcccgcttctctggcttacaagtctgggcaacaccggctcccngaccatctctgggcttccgaggtctgaggacgaggctgtattatacgtgcagctaccatactacgaaacctgacacgtcacgtcgggtgttccgggcggttacgggaccaaggcgttcgacccgtcgtacggtccacggtcccgaaggtccgttcgtaaccccccgg

SEQ ID NO: 385273 - DNA, 503 bp, Homo sapiens
  misc_feature: GZ8MTXP02FRYN9.10.50.E06.1.454.CMB.2.raw
  modified_base (332)..(332): a, c, t, g, unknown or other
tcagcatagtagtgcacgaccggtgctcgatttagatctactgacaacacacaaggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaatgatgatttatgatgtcagtaatcgacctcaggggtttcngatcgcttcttgcctcaagtctggcaacacggcctccctgaccatctctggctcagactgagcgaggctgattatactgcagctcacatacaagcgcagcggtggtgttcggcgggggaccacgactgaccgtcgtacggtcacgccgaaggctcgcccctcggtcactcg

SEQ ID NO: 385274 - DNA, 509 bp, Homo sapiens
  misc_feature: GZ8MTXP02GHU5N.10.50.E06.1.454.CMB.2.raw
tcagcatagtagtgcacgaccggtgctcgatttagatctactgacaacacacaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacaacacccaggcaaacgcccccaaatcataattcatgatgtcaataatcggccctcgaggggtttctaatccgtcttctctggcttcaagtctggcaacacgcctcctgaccatctctgggctccgagctgaggacgaggctgtattatactgcagctcatatacaacagcagcacgtcgggtgttcgggacggtagggaccaagctgaccgtcgtaggtcacgccaacggcctcgcccccg

SEQ ID NO: 385275 - DNA, 548 bp, Homo sapiens
  misc_feature: GZ8MTXP02G0YQO.10.50.E06.1.454.CMB.2.raw
  modified_base (424)..(424): a, c, t, g, unknown or other
tcagcatagtagtgcacgaccggtgctcgatttagatctactgacaacacacaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatactatgtctcctgtaccaacaacacccaggacaaagcccccaaatcataattcatgatgtacaaataactcggccctacgtaggggtttctaatccgtcttctctggcttacaagtcgtgcaacaccgcctccctgaccatctctcggctccagctgaggcgagctagattagtacngtcagctacatactaacaacgagctagctaacgtcggggttcgtacgggacggacgggaaccaacgtccgtccggtacccgtcgttaacggccgaacggcccgaacggccgtaccgtcccccgg

SEQ ID NO: 385276 - DNA, 514 bp, Homo sapiens
  misc_feature: GZ8MTXP02G8JT9.10.50.E06.1.454.CMB.2.raw
  modified_base (228)..(228): a, c, t, g, unknown or other
  modified_base (391)..(391): a, c, t, g, unknown or other
tcagcatagtagtgcacgaccggtgctcgatttagatctactgacaacacacaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcctggtaccaacaacacccaggcaaagcccccaaatcataatcatgatgtcaataatcggccctcgaggggtttctaatccgtcttctctggcttcaagtctggcaacacgcctcctgaccatctctggctcngctgagacgagctgattatactgcagctacatactacaacagcagcacgtcggtgttcgggcggacgggaccaacgcctacggtaccgtcgttaggccacggcccgaacggcctccgcccccg

SEQ ID NO: 385277 - DNA, 619 bp, Homo sapiens
  misc_feature: GZ8MTXP02JAJFG.10.50.E06.1.454.CMB.2.raw
tcagcatagtagtgcacgaccggtgctcgatttagatctactgacaacacacaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcacatctcctgcactggaaccagcagtgacgttggtgttataactatgtctcctggtaccaacaacacccaggcaaacgcccccaaatcataatcatgatgtcaataatcggcctgacggggtttctaatcccgtcttctctaggtcttcaagtcgtgacaacgaccggcctcctgaccctatcctcgtcggctccgaggctggaggaccgagggcctagtattacttaatcggtcaaggtctacctaattaacctaacaaaccccgaaggcaacgaccgtaacgttcggggttacggtttccggggacggggttaaacgggaacccgaaacgggtaccgttcccggaaccggtttaaccgtaacggggttaccaacggccccgaaaacgggtccctaccgggttccccccccgg

SEQ ID NO: 385278 - DNA, 531 bp, Homo sapiens
  misc_feature: GZ8MTXP02I87YD.10.50.E06.1.454.CMB.2.raw
  modified_base (229)..(229): a, c, t, g, unknown or other
  modified_base (452)..(452): a, c, t, g, unknown or other
tcagcatagtagtgcacgaccggtgctcgatttagatctactgacaacacacaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcctggtaccaacaacacccaggcaaacgcccccaaactcataattcatgatgtacaataatcggccctcgtaggggtttctaatccgtcttctctggcttcaagtctggcaacacggcctccctgaccctatctcgtggcctccgaggctggaggacgaggctgattattacgtgcagctcatataacaacgngcagccacgttcgggtcgttcgggcgggaggaccaagcctcgacccgtcgtaggtcacgccgaacggctccgtcccccg

SEQ ID NO: 385279 - DNA, 533 bp, Homo sapiens
  misc_feature: GZ8MTXP01E17BL.52.68.G02.1.454.CMB.2.raw
  modified_base (244)..(244): a, c, t, g, unknown or other
  modified_base (345)..(345): a, c, t, g, unknown or other
  modified_base (425)..(425): a, c, t, g, unknown or other
  modified_base (431)..(431): a, c, t, g, unknown or other
  modified_base (449)..(449): a, c, t, g, unknown or other
tcagcgcagtacgacacgaccggtgctcgatttagtcgatagtgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggcaccaacagtgattttggngttatgattctgtcttctggtaccaacggcacccaggcaaagtccccaaatcatgattactgatatcaatagagccctgaggggtccccctgatcgcttcnctgctccaagtctggcaagtaccggccctccctgacccatctcgtgggcctccgaggcctgaggatgaggctagaaattntttcgngtctgtctacatgcgcgnggtcgtcttacgtactttcgtcgttccgttacggacgttccgggaaccctaggtccctaccggtcgttacggtccgaacgcccg

SEQ ID NO: 385280 - DNA, 510 bp, Homo sapiens
  misc_feature: GZ8MTXP01CSH4G.52.68.G02.1.454.CMB.2.raw
  modified_base (232)..(232): a, c, t, g, unknown or other
  modified_base (243)..(243): a, c, t, g, unknown or other
  modified_base (327)..(327): a, c, t, g, unknown or other
  modified_base (352)..(352): a, c, t, g, unknown or other
  modified_base (389)..(389): a, c, t, g, unknown or other
  modified_base (403)..(403): a, c, t, g, unknown or other
  modified_base (407)..(407): a, c, t, g, unknown or other
  modified_base (418)..(418): a, c, t, g, unknown or other
  modified_base (422)..(422): a, c, t, g, unknown or other
  modified_base (430)..(430): a, c, t, g, unknown or other
  modified_base (435)..(435): a, c, t, g, unknown or other
  modified_base (439)..(439): a, c, t, g, unknown or other
  modified_base (443)..(443): a, c, t, g, unknown or other
tcagcgcagtacgacacgaccggtgctcgatttagtcgatagtgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactgcaccaacngtgattttggnggttatgattctgtcttctggtaccaacggcacccaggcaaagtccccaaactcatgattactgatatacaataagacgccctnacggggtccccctggatcgtcttcnctggctccaagtctgcaacacgccctcctgaccatcnctgggctccaggcngagntgaggctgatntttngtctgctntatgngcgnggcncttactacttgtcgtcgttacgacgttcgggaacctacgtccaccgtccgttacgtccgcgaacccg

SEQ ID NO: 385281 - DNA, 539 bp, Homo sapiens
  misc_feature: GZ8MTXP01BOSMS.52.68.G02.1.454.CMB.2.raw
  modified_base (228)..(228): a, c, t, g, unknown or other
  modified_base (241)..(241): a, c, t, g, unknown or other
  modified_base (306)..(306): a, c, t, g, unknown or other
  modified_base (349)..(349): a, c, t, g, unknown or other
  modified_base (369)..(369): a, c, t, g, unknown or other
  modified_base (404)..(404): a, c, t, g, unknown or other
  modified_base (417)..(417): a, c, t, g, unknown or other
tcagcgcagtacgacacgaccggtgctcgatttagtcgatagtgaagggaaaggggctggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctctgcactgcaccaanagtgtattttggnggttatgattctgtcttcgtgtaccaacggcaaccccaggcaaacgtccccaaatcatgattacngatatcaaagtagcgccctgacggggtccccctgatcgcttcnctgctcaagtctggacaacncgtccctcctgaccatctctggctccgagctgagntagagctagattntctgctgtctcaattctacggcgacgggtcgtcttaacgtaccttagtcgttcgttacgggaaccgttcgggaacccctaggtcccgaaccggttccgttaacgggtccaacggaacccccg

SEQ ID NO: 385282 - DNA, 589 bp, Homo sapiens
  misc_feature: GZ8MTXP01EB9WV.52.68.G02.1.454.CMB.2.raw
  modified_base (218)..(218): a, c, t, g, unknown or other
  modified_base (230)..(230): a, c, t, g, unknown or other
  modified_base (233)..(233): a, c, t, g, unknown or other
  modified_base (242)..(242): a, c, t, g, unknown or other
  modified_base (356)..(356): a, c, t, g, unknown or other
  modified_base (402)..(402): a, c, t, g, unknown or other
  modified_base (408)..(408): a, c, t, g, unknown or other
  modified_base (457)..(457): a, c, t, g, unknown or other
tcagcgcagtacgacacgaccggtgctcgatttagtcgatagtgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcacctatctcngcactgcacacngtntattttggnggttatgtattctgtcttcacggtaccaacggccaacccgaggacaaacgtaccccaaactcatgattactagtaatactacaaataacggcgtccctacgacggggtcccccngtactcgtcttctctggctcaagtctgaccaacgccgccttacccngaaccnctctcgacgggcctccgaggcctggacggtatggagcgtagtaaatttnttcgtcgtcctgtacctatattagcgacgacgggcgtacttacggtaactttcgtcgttccgttaacggttcgttacccgggcctaggtaacccaccggttaccgttacggtaaccgaacccgtaaacccgg

SEQ ID NO: 385283 - DNA, 490 bp, Homo sapiens
  misc_feature: GZ8MTXP02FQKXB.52.68.G02.1.454.CMB.2.raw
  modified_base (244)..(244): a, c, t, g, unknown or other
  modified_base (348)..(348): a, c, t, g, unknown or other
  modified_base (417)..(417): a, c, t, g, unknown or other
tcagcgcagtacgacacgaccggtgctcgatttagtcgatagtgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggcaccaacagtgattttggnggttatgattctgtcttctggtaccaacggcacccaggcaaagtccccaaactcatgattactgatatcaataagagccctcaggggtccccctgatcgcttcnctggctcaagtctgcaacacggcctccctgaccatctctggctccaggctgagatgagctgatatttcngctgctcatatgcaggcgctacacttatgtcttcggaactgggaaccaggtcaccgtcctaggtcagaccccg

SEQ ID NO: 385284 - DNA, 521 bp, Homo sapiens
  misc_feature: GZ8MTXP02I9E2M.52.68.G02.1.454.CMB.2.raw
  modified_base (375)..(375): a, c, t, g, unknown or other
  modified_base (415)..(415): a, c, t, g, unknown or other
  modified_base (431)..(431): a, c, t, g, unknown or other
  modified_base (446)..(446): a, c, t, g, unknown or other
  modified_base (461)..(461): a, c, t, g, unknown or other
  modified_base (493)..(493): a, c, t, g, unknown or other
tcagcgcagtacgacacgaccggtgctcgatttagtcgatagtgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggcaccaacagtgtattttggtggttatgattctgtcttctggtaccaacggcacccaggcaaacgtccccaaatcatgattactgatatcaaataagacggccctcgacggggtccccctgactcgcttctctggcctcaagtctgcaacncggccctccctgacccatctcgtggctcccaggctggagntggaggctagtaattnttctgctgctcaatntgcaggcgcttaacnctttatcgttcttacggaacttcgggaacccnggtccaccgtcgttacggccacgacccg

SEQ ID NO: 385285 - DNA, 557 bp, Homo sapiens
  misc_feature: GZ8MTXP02GHFDN.52.68.G02.1.454.CMB.2.raw
  modified_base (244)..(244): a, c, t, g, unknown or other
  modified_base (394)..(394): a, c, t, g, unknown or other
  modified_base (421)..(421): a, c, t, g, unknown or other
  modified_base (443)..(443): a, c, t, g, unknown or other
tcagcgcagtacgacacgaccggtgctcgatttagtcgatagtgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggcaccaacagtgtattttggnggttatgtattctgtcttctggtacccaaggccacccgaggaccaaacgtccccaaatcatgatactgatatacaataagacgccctagacggggtccccctgactcgcttctctggcctacgagtctgcaacgcgtcctcctagacctntctcgtcggctccgaggtctagacggntaggagctagtaattcgtttcngtctcgactctagtatcgacgacggtcgtactactacgtttacgtcgttaccgtacggtaacgtcgggaacccgtaggttcccaccggttccgtaacggtccaacgaaccccgg

SEQ ID NO: 385286 - DNA, 684 bp, Homo sapiens
  misc_feature: GZ8MTXP02HOQMA.52.68.G02.1.454.CMB.2.raw
  modified_base (227)..(227): a, c, t, g, unknown or other
  modified_base (237)..(237): a, c, t, g, unknown or other
  modified_base (294)..(294): a, c, t, g, unknown or other
tcagcgcagtacgacacgaccggtgctcgatttagtcgatagtgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctctgcatgcacangtgatttggngtatgtatctgtctctgtaccacgcaccaggacaaacgtccccaaatcatgattacngatatacaatagacgtccctcgacgggtcccccagtacgtcgtcttctctggccttacgaaagttctacggaccaaacgaccggtccctaccctacgaccctacgttcccgtcggtcgggtccctaccggaacgggtcctgggaaaggacgttaggacgggtaccttaacggtaaaatttacgtttcgtacggtcctttaggcccttagtaattaacgttccgaaaccggaacgggtcccggtaaactttaaccgtaaaccttttaggtaccgtttacccggtttaaccggggaaacccggtttaccgggggaacccccgttaaacggggtccccgtaaccccgggttaacccgtttaacggggtaccctaaaccccggtaaacccccgg

SEQ ID NO: 385287 - DNA, 560 bp, Homo sapiens
  misc_feature: GZ8MTXP02GEW07.52.68.G02.1.454.CMB.2.raw
  modified_base (218)..(218): a, c, t, g, unknown or other
  modified_base (229)..(229): a, c, t, g, unknown or other
  modified_base (240)..(240): a, c, t, g, unknown or other
  modified_base (349)..(349): a, c, t, g, unknown or other
  modified_base (454)..(454): a, c, t, g, unknown or other
tcagcgcagtacgacacgaccggtgctcgatttagtcgatagtgaagggaaagggggctggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccatctcngcatgcacaangtgtatttggngttatgattctgtctcgtgtaccaacggccacccgagacaaacgtccccaaatcatgattacagatatacaagtaagcgccctagacggggtccccagactcgtcttcncgtgcctcaagtcgacgacaaacgcgtccctcccgtagaccctatccgtccgtcggtaccctcccgaggcgtaggaacggtataggaacggtcgtaagtaaattntttccgtatcctagtctactaatgtacgcgacggtcgtactacgtacttagtcgttacgtacgacgtcgggaaccctggacctaccgtcgtacgtcgacgtacccg

SEQ ID NO: 385288 - DNA, 540 bp, Homo sapiens
  misc_feature: GZ8MTXP02JG17C.52.68.G02.1.454.CMB.2.raw
  modified_base (233)..(233): a, c, t, g, unknown or other
  modified_base (352)..(352): a, c, t, g, unknown or other
  modified_base (439)..(439): a, c, t, g, unknown or other
tcagcgcagtacgacacgaccggtgctcgatttagtcgatagtgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggcaccaacngtgattttggtggttatgattctgtcttctggtaccaacggccacccaggcaaagtccccaaatcatgattactgatatcaataagacgccctcgaggggtcccccctgactcgcttcnctggctccaagtctggcaacgacggccctcccagacccatcctctgggcctccgaggctggaggactggagctagaagttatttcgngtctgcttcatatcgactaggcggtctacgtacttagtacgtcgttaccggaacgtcggaacccctaggtaccacccggtaccgtagtcccgacgaccccg

SEQ ID NO: 385289 - DNA, 746 bp, Homo sapiens
  misc_feature: GZ8MTXP02H8N47.52.68.G02.1.454.CMB.2.raw
  modified_base (229)..(229): a, c, t, g, unknown or other
tcagcgcagtacgacacgaccggtgctcgatttagtcgatagtgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcacatctctgcactggacacaanagtgtagtttggtgttatgtattctgttctcgtaggtaccagtcggaccaccgaggaccaaaccgtaccccaaactcatagattacgagtataactacaaagtaacgacgtccctacggtacccggggtccctaaagtctcgtctttcgtcgtcgtcctacgtaacgttccgtacggaccaaacgtcccggacccttcccgacgtaccctacttccgtaccgtcggggtaccctccgacgggtaccgttagggaacggtaacgttcgggaacgggttacctttaaggttaaaactttccgttttaccggtacggttacccgttacgtacctttaacgtaacgttacggtaccggtaaccgggtaccgggttaccggtaaccctttaaaccgtttaccggttttacggtttaccggtttaacccggttaacccgggtaaaccgggttaacccggtaaaccccggtacggttacccccgtaacccggtttacccggtaaccggttaacccgaaccccgg

SEQ ID NO: 385290 - DNA, 565 bp, Homo sapiens
  misc_feature: GZ8MTXP02FXDTA.52.68.G02.1.454.CMB.2.raw
  modified_base (202)..(202): a, c, t, g, unknown or other
  modified_base (232)..(232): a, c, t, g, unknown or other
  modified_base (311)..(311): a, c, t, g, unknown or other
  modified_base (410)..(410): a, c, t, g, unknown or other
  modified_base (468)..(468): a, c, t, g, unknown or other
  modified_base (476)..(476): a, c, t, g, unknown or other
tcagcgcagtacgacacgaccggtgctcgatttagtcgatagtgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctccgtggacngtcagtcacatctcctgcactggcaccaangtgtattttggtggttatgattctgtcttctaggtaccaacggcacccgagtcaaacgtccccaaagtcactgattacngactatcaaagttaagcggcctacaggggtccccctaggactcgtcttctcgttggtccttaccaaggtctacggactaaacgaccggtccctcccgtnacccgtactctcgtagggcctcgtaagctagacgatacgaaggctagtaattactttngtaccgtntctctatcgacgcgacgtcgactactacttagtcgtacgttacggaccgtcggaaccgtacgtaccgtacgtactacggccacgacccg

SEQ ID NO: 385291 - DNA, 352 bp, Homo sapiens
  misc_feature: GZ8MTXP01DIQN1.39.60.F05.1.454.CMB.2.raw
  modified_base (348)..(352): a, c, t, g, unknown or other
tcagtcgcactagtcacgaccggtgctcgatttagtacgtcatcagggaaagggccgattcaccatctccagagacgacgccaagaactcagtgtttctgcaaatgaacagcctgagagccgaggacacggctctttattactgtgcgagagagggtactaaggactactacctggacgtctggggcaaagggaccacggtcaccgtctccttagcttccaccaagggcccatccgtcttccccctggcgccctgctccaggagcacctccgagagcacagccgccctgggctgcctggtcaaggctacttccactagtgcgactgagcggctggcaaggcgcatagnnnnn

SEQ ID NO: 385292 - DNA, 531 bp, Homo sapiens
  misc_feature: GZ8MTXP01BJKI0.39.60.F05.1.454.CMB.2.raw
  modified_base (439)..(439): a, c, t, g, unknown or other
  modified_base (447)..(447): a, c, t, g, unknown or other
  modified_base (473)..(473): a, c, t, g, unknown or other
  modified_base (484)..(484): a, c, t, g, unknown or other
tcagtcgcactagtcacgaccggtgctcgatttagtacgtcatcagggaaaggggagagaggagccttagccctggattccaaggcctatccacttggtgatcagcactgagcaccgaggattcaccatggaactggggctccgctgggttttccttgttgctatttagaaggtgtccagtgtgaggtgcagctggtggagtctgggggagcctggtcaagcctgggggtccctgagactctcctgtgcagcctctggattcgccttcagcagctattccatgcactgggtccgccaggctccgaggggaaggggctggagtgggtctcatccattagtagtagttctagttacatatcttatgcagtcctcagtgaagggcccgattcaccatctccagacgacgacgccaagaactcagtgtttctgcaaatgaacngcctgagngccgagcacgggcttcgttattacgngtacgcgaagngaagggtaactaagggaactactaccgttggaacgttcgtaaggggg

SEQ ID NO: 385293 - DNA, 347 bp, Homo sapiens
  misc_feature: GZ8MTXP01DV5CQ.39.60.F05.1.454.CMB.2.raw
  modified_base (335)..(335): a, c, t, g, unknown or other
  modified_base (341)..(347): a, c, t, g, unknown or other
tcagtcgcactagtcacgaccggtgctcgatttagtacgtcatcagggaaagggccgattcaccatctccagagacgacgccaagaactcagtgtttctgcaaatgaacagcctgagagccgaggacacggctctttattactgtgcgagagagggtactaaggactactacctggacgtctggggcaaagggaccacggtcaccgtctccttagcttcaccaaggcccatccgtctcccctgcgcctgctccaggagcacctccgagagcacagccgccctgggctgccctggtcaaggctactccactagtgcgatgagcggctggcaaggcncatagnnnnnnn

SEQ ID NO: 385294 - DNA, 633 bp, Homo sapiens
  misc_feature: GZ8MTXP01ETDHY.39.60.F05.1.454.CMB.2.raw
  modified_base (381)..(381): a, c, t, g, unknown or other
  modified_base (445)..(445): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctattccatgcacgtcgggtccgccaggctccgaggggaagggctgggagtgggtctcatccagttagtagtacgttctagttacatatcttatgcagcctnagtggaaggccgattcacctatctccagacgacgacgaccaagacctcgtaagttcgtttacgngtactaaagtcgaaacacgcccgttaggaacgcggtacccgggaaggaccgaccgggtcctttacgtttttacgttaaccgttggttacggaccgggttaagggttacgggttaacgggggttaacctaaacggggtaaccttaaccggtacccggttacggggtaaccgtttcgggttaaccggggg

SEQ ID NO: 385295 - DNA, 555 bp, Homo sapiens
  misc_feature: GZ8MTXP01CYG4R.39.60.F05.1.454.CMB.2.raw
  modified_base (272)..(272): a, c, t, g, unknown or other
  modified_base (298)..(298): a, c, t, g, unknown or other
  modified_base (378)..(378): a, c, t, g, unknown or other
  modified_base (435)..(435): a, c, t, g, unknown or other
  modified_base (448)..(448): a, c, t, g, unknown or other
  modified_base (456)..(456): a, c, t, g, unknown or other
  modified_base (480)..(480): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtgggggtccctgagactctcctgtgcagcctctggattcgccttnagcagctattccatgcactgggtccnccaggctccgaggggaagggctgggagtgggtctcgatcctattagtagtacgttctagttacatatcttatgcagcctnagtgaagggccattcaccatctccagagaccgacgaccaaagaactcagttgtttcngacaaatgaaacngcctgagngccgagaccacggcttcttatacnggtcgcggaaggcggaggggttaactaaacggggtaacttaaccgtaccgttacgggtaacgttcggtaaggggg

SEQ ID NO: 385296 - DNA, 622 bp, Homo sapiens
  misc_feature: GZ8MTXP01D1GY7.39.60.F05.1.454.CMB.2.raw
  modified_base (553)..(553): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcgccttcagcagctattccatgcactgggtccgccaggctccgaggggaaggggctgggagtgggtctcgatccattagtagtagttctagttacatatcttatgcagcctcagtgagggcatcacatctcagagacgacgcccaagaacctctaagttgtttacgtagtacctaaaattcggaaaaccacgggcccttaggaaacggacggtaccccggaaagggaacccaccggggtaacctttaccgttttaattaacccgttggtacggtacggttaaacggngggttaaggggtaacccttaaaggggaaccttaacgtacccgttagggtaaccgttcggtaaccggggg

SEQ ID NO: 385297 - DNA, 586 bp, Homo sapiens
  misc_feature: GZ8MTXP01D52ED.39.60.F05.1.454.CMB.2.raw
  modified_base (421)..(421): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgacttcagcagctattccatgcacgtcgggtcccgccaggcctaccggagggggaacggggcgtgggaggtcgggtctcgacgcctacgtttccggactaagtgggtggtggcacaacactcgcacgactcgtaggacgggccgtcaccgtcncagagacaatccagaacactctactatacgaggaaatgaaatacgcctaggacgacgaccgaacgacgacggctatataattattgtacgacgaaacgaccccgaagggttcaacccaacgtagttcggtaacttcgtttacgtaaccgtttcggtaaccggggg

SEQ ID NO: 385298 - DNA, 538 bp, Homo sapiens
  misc_feature: GZ8MTXP01BOJ27.39.60.F05.1.454.CMB.2.raw
  modified_base (435)..(435): a, c, t, g, unknown or other
  modified_base (447)..(447): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcgccttcagcagctattccatgcactgggtcccgccaggcctccgaggggaaggggctgggaggtgggtctcatcctattagtagtacgttctagttacatatacttatgcagcctcagtgagggccattcactatctacagagacgacgccaagactcagttgtttcngacaaatgaacngccgtagagacgccgaaggacacggcttacgtttatacgttgtgcgaggacggaggtaactaggctacgacgttggaacgttcgtaagggg

SEQ ID NO: 385299 - DNA, 576 bp, Homo sapiens
  misc_feature: GZ8MTXP01BN50G.39.60.F05.1.454.CMB.2.raw
  modified_base (374)..(374): a, c, t, g, unknown or other
  modified_base (430)..(430): a, c, t, g, unknown or other
  modified_base (458)..(458): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctatttagaaggtgtccagtgtgaggtgcagctggtggagtcgtgggggaggcctggtcaagccgtgggggtccctgagactctcctgtgcagcctctggattcgccttcagcagctattccatgcacgtcgggtcccgccaggcctccgagggggaaggggcgtgggagtgggtctcgatccattagtagtagttctagtacatatcttangcagcctcagtgaagggccattcaccatctaccagacgacgacgaccaaagacctnaagttcgtttacagacaaaatgaaaccngcctagacgacgaccggagacctacggtcttacgtttagtacgttggtagacgaaggaggttaacgggttaactaagggtaacctaaccgtcggttaggtaaccgttcgggtaagggg

SEQ ID NO: 385300 - DNA, 522 bp, Homo sapiens
  misc_feature: GZ8MTXP01AL537.39.60.F05.1.454.CMB.2.raw
  modified_base (298)..(298): a, c, t, g, unknown or other
  modified_base (430)..(430): a, c, t, g, unknown or other
  modified_base (442)..(442): a, c, t, g, unknown or other
  modified_base (459)..(459): a, c, t, g, unknown or other
  modified_base (481)..(481): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcgccttcagcagctattccatgcactgggtccnccaggctccgaggggaaggggctgggagtgggtctcatccattagtagtagttctagttacatatcttatgcagcctcagtgaagggccattcaccatctccagagacgacgaccaagactcagttgtttcngacaaatgaacngcctgagagccgagacncggctcttatacttgtgcgagngagggtaataaggcctactcgttggtaacgttcgtaagggg

SEQ ID NO: 385301 - DNA, 548 bp, Homo sapiens
  misc_feature: GZ8MTXP01E3U6Z.39.60.F05.1.454.CMB.2.raw
  modified_base (393)..(393): a, c, t, g, unknown or other
  modified_base (428)..(428): a, c, t, g, unknown or other
  modified_base (442)..(442): a, c, t, g, unknown or other
  modified_base (469)..(469): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcgccttcagcagctattccatgcactgggtccgccaggctccgaggggagggctggagtgggtctcgatccattagtagtagttctagttacatatcttatgcagctcagtgaagggcattcacatcnccagagacgacgaccaaagactcagtcgtttacgngacaaatcgaaacncgcctaggacgacggcccgaaggaccncgggtcttctttatacgttgtacgcgagaggagggtaaccaaagggaacctacgtacgaggtaaccgttggtaacgggg

SEQ ID NO: 385302 - DNA, 620 bp, Homo sapiens
  misc_feature: GZ8MTXP01BGYMC.39.60.F05.1.454.CMB.2.raw
  modified_base (302)..(302): a, c, t, g, unknown or other
  modified_base (427)..(427): a, c, t, g, unknown or other
  modified_base (488)..(488): a, c, t, g, unknown or other
  modified_base (518)..(518): a, c, t, g, unknown or other
  modified_base (542)..(542): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcgccttcagcagctacttccatgcacgtgggtcccnccgaggcctccgagggggaacggggcgtgggagtcgggtctcgatccgtagttagtagttacgttcttagttacattatacttatgacacgtccctacgaggtggaacggggcctattccaaccntcctaccgagaacgaccgacgaccaaagaactcgaagttcgttctagactaaatgaaaccngtcccgtagaacggacgtccggaacggacnccgggtcttacgtttaacttacgnggttacgacggaagagggttaacgggtaacaacgggtaacctaacggtacccttggggtaaccgttcgggaacggggg

SEQ ID NO: 385303 - DNA, 653 bp, Homo sapiens
  misc_feature: GZ8MTXP01BU2F0.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctattccatgcacgtcgggtcccgccaggcctccgagggggaaggggcgtgggagtgggtctcatccattagtagttacgttctagttacattatacttatgcagcctcaggtggaacggggcctattccaacctatcctaccgagaacggacgaaccgacccaaagaacctcgaagtttcgtttactagactaaagtacgaaacacgtccgtaggaacggacggacccggaacggtaaccgaccgggtcctttaaccgtttttaagttaccgttgggtacggaccggttaaagggttaacgggaacggggttaacctaaacgggaaccttaaccgtacccggttaggggtaacccggttgggtaaccgggggg

SEQ ID NO: 385304 - DNA, 570 bp, Homo sapiens
  misc_feature: GZ8MTXP01ERT8Q.39.60.F05.1.454.CMB.2.raw
  modified_base (259)..(259): a, c, t, g, unknown or other
  modified_base (272)..(272): a, c, t, g, unknown or other
  modified_base (299)..(299): a, c, t, g, unknown or other
  modified_base (492)..(492): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctntggattcgccttnagcagctattccatgcacgtcggtccnccaggcctaccgaggggaagggctgggagtgggtctcatccattagtagttacgttctagttacatagtacttatgcagcctcgagtggaagggcccattccgacatcgtccaagacgacgacgaccaaagactcgaagttcgtttacagacaaaatcgaaacagcctagaacgcgcccgaaggaccacggtnttacgtttatacgttgtagacggagaggacgggttaacaagggtaacctaacgtaccgaggtaaccgttggaacgggg

SEQ ID NO: 385305 - DNA, 585 bp, Homo sapiens
  misc_feature: GZ8MTXP01DG1SS.39.60.F05.1.454.CMB.2.raw
  modified_base (390)..(390): a, c, t, g, unknown or other
  modified_base (461)..(461): a, c, t, g, unknown or other
  modified_base (468)..(468): a, c, t, g, unknown or other
  modified_base (517)..(517): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtggggggaggcctgggtcaagccgtgggggtccctgagactctcctgtgcagcctctggattcgccttcagcagctattccatgcacgtgggtcccgccaggcctccgagggggaacgggcgtgggaggtgggtctcatccattagtagttacgttctagttacatattacttatgcacgcctnagtggacgggcccattcaccatcctacagacgacgaccgacaaagactcgtagttcgtttcagaactaaancgaaacngccgtagaacggcgacggacggaccacgggtctttacgtttattaccgngtggcgaaggttaggttacgggtaataaacggtcctaacgtacccgttaggaaccgttcggaacgggg

SEQ ID NO: 385306 - DNA, 669 bp, Homo sapiens
  misc_feature: GZ8MTXP01DT0CH.39.60.F05.1.454.CMB.2.raw
tcagtcgcactagtcacgaccggtgctcgatttagtacgtcatcagggaaaggggtctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggattcgccttcagcagtctatccatgctacgtcgggtcccgccgaggcctaccggaagggggagggggcgtgggaggtcggggtctcatccagtttacgtagttagtttctagttacaattattctatgccagccctagtagtggaacgggcctaagttccacctatcctaccgagtacgaccgaccgaccaagtaactcgtaggttcgtttccagaactaaagtcgaaactacggtaccgtaggaaacggtaccggaccccgggaaaggaaaccccgtaacggttccttttaacgtttttaaacgttaccgttgggttaccggacggaaagggtaacgggtaaacggggttaaccgttaaacggggtaccctttaacggtaaccccggtttggggtaacccggg

SEQ ID NO: 385307 - DNA, 709 bp, Homo sapiens
  misc_feature: GZ8MTXP01AK66L.39.60.F05.1.454.CMB.2.raw
tcagtcgcactagtcacgaccggtgctcgatttagtacgtcatcagggaaaggggtctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctcgtggattcgccttcagcagctattccatcgcctacgtcggggtccccgccgaggccgtaccggagggggaacgggggcgtgggggaggttcgggggtcctcgatccgtagttaggttagttagttctagttacaattattcttagtgactacgtcctacgaggtaggaacggggtccctattaccacctactcctaccgaaggacgaaccgaccggaaccaaacggtaaccttacctaagggggtttcgttttacgtacgaaaccgtaaaagttcggaaactacggacccgttaaggacggaaccggccgggaaacgggtaacccgtaacgggttcctttacgttttaaacgttaccgttagggttacggttacggaggtaaacggggtaggggttaacctaaacgggggtaaccttacgtaacccggttaagggtaacccgggg

SEQ ID NO: 385308 - DNA, 683 bp, Homo sapiens
  misc_feature: GZ8MTXP01DZCFC.39.60.F05.1.454.CMB.2.raw
  modified_base (557)..(557): a, c, t, g, unknown or other
  modified_base (582)..(582): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtggggggagcctggtcaagccgtgggggtccctgagactctcctgtgcagcctctggattcgccttcagcgagtctatccatcgacacggtcgggtccccgaccgacggtccgtaccggaaggggggaacgggggtccggtaggggtacgggttcggggttctacgtacttacccgttaagtttaggttaagtttaccgttacgttaagttaactattacttaacttagtcgactacgtccctacgtaggtacgggacgggtcctacttaccacactcctacgaaggaaccggacgaccgaaccgaaagtaacctgtaacgttcgtttacagtaaacctaaagtacgaacncgcctaggaacgcgtaccgagaccncggttcttacttatcgttgacggacggttaaggacggttaaacggggtaactaaggtaacccttaacgtccggttacgggtccggttaagggaaccggggg

SEQ ID NO: 385309 - DNA, 628 bp, Homo sapiens
  misc_feature: GZ8MTXP01D0UH7.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcgccttcagcagctattccatgcacgtgggtcccgccgaggcctccggagggggaagggggctgggaggtgggtctcatcctattagtagttagttctagttactattatacttatgctacgcctacgagtgggaacggggcctattaccgacctatccgtacaggaacgaccgacgaccgaaagaacctcaagtttcgtttaccgtagtaactaaagtacgaaaccgacgtcctaggaacggacgaccggaaggtaccacgggtcttactttagttcgttaggtcggacggaaggaggttaacggggttaactaaagggtccttaacggaccgttaggggtaaccgttcgggtaacggggg

SEQ ID NO: 385310 - DNA, 684 bp, Homo sapiens
  misc_feature: GZ8MTXP01CX4UR.39.60.F05.1.454.CMB.2.raw
  modified_base (511)..(511): a, c, t, g, unknown or other
  modified_base (579)..(579): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgcttgggttttccttgttgctattttagaaggtgtccagtgtgaggtgcagcgtggtggagtcgtgggggaggccgtggtcaagccgtgggggtccctgagactctcctgtgcagcctctggattcgccttcagcagctattccatcgcacgtcggtcccgccgacggcctccggagggggaagggggcgtaggggaggtcgggtcctcgtactcctaagtttagtagttacgtttactagttacattacttacttatgctacgcctgaggtgaacgggcctattccacctatccgtaccgaggacgacgaaccgaccgaaagtacctctagtttacgtttcacggaaactaaacgtacggaaaccncggccctaggaaaccgtaggacccggtaaggaacccgacgggttccttttaacgttttaagttaccgnggttacggcggaaacggttagggttaaacggggttaaacctaaaccggggtaactttaaccccgttaaccggttggggttaacccgttcggggtaaaccgggggg

SEQ ID NO: 385311 - DNA, 574 bp, Homo sapiens
  misc_feature: GZ8MTXP01AVETH.39.60.F05.1.454.CMB.2.raw
  modified_base (456)..(456): a, c, t, g, unknown or other
tcagtcgcactagtcacgaccggtgctcgatttagtacgtcatcagggaaaggggtctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctatcccatgcactgggtccgccaggctccgaggggagggcgtggagtgggtctcatcattagtagtagttctagttacaattatcttatgcagcctcagtgaacggcattcacatctaccgagacgacgacgaccaaagactcaggttcgtttacgcgactaaaatcgaaacngtccctaggagacggacccggaaggaaccgaccgggttcttaccgtttaagttaccgtgttcggcggaaggtaaggagggtaactaacggaccttaccgtaaccgttggtaacccggg

SEQ ID NO: 385312 - DNA, 623 bp, Homo sapiens
  misc_feature: GZ8MTXP01D1JZD.39.60.F05.1.454.CMB.2.raw
  modified_base (300)..(300): a, c, t, g, unknown or other
  modified_base (499)..(499): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggattcgccttcagcagctattccatgcacgtgggtcccnccaggcctaccggaggggaacgggctgggagtgggtctcatccattagtagttacgttctagttacattactacttatgctacgccctacgaggtagggaacggggccctatttccaacctagtacctaccgaaggaacgaccgacgacccgaaagtaacctgtaagtttcgtttacgagaacctaaaagtcgaaaccncggccgtaggaacggacgccggaaggaccacgggtctttacgtttatacgttggtacgacgaaggcggttaagggtaactaaaggccttaacgcccggttagggtaaccgttcgggtaacgggg

SEQ ID NO: 385313 - DNA, 601 bp, Homo sapiens
  misc_feature: GZ8MTXP01AB61F.39.60.F05.1.454.CMB.2.raw
  modified_base (303)..(303): a, c, t, g, unknown or other
  modified_base (386)..(386): a, c, t, g, unknown or other
  modified_base (518)..(518): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtggggggtccctgagactctcctgtgcagcctctggattcgcttcagcagtctattccatcgcacgtcgggtcccnccgaggcctccgaggggagggctgggagtgggtctcattccattagtagtacgttctagtacatattcttatgcagtcctacnggtagaacgggccattccaacctatccacgaagacgaccgacgaccgaaacgactcgaagttcgtttcgacgaacaaagtacgaaaccagccgtagacgcggaccgtaggccaacgggtcctgttttaaacncgttggtacgacgagggacggttacgggtaactaacgggcctttaaaccggccgttgggtaaccccggttgggtaaccggggg

SEQ ID NO: 385314 - DNA, 681 bp, Homo sapiens
  misc_feature: GZ8MTXP01ASB2Q.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggattccgccttcagcagctattccatgcacgtcggtcccgccaggcctccgaggggaaggggctgggagtcgggtctcgatccattagtagttacgttactagttacattacttacgttatggctaacgtccctacgtagggtacgggaacggggtacccgtaactttcccgaaccattccgacccgaaggaacggaacccgaaccgaacccaaacggtaaccgtacctaaggtttaccgttttacgtacggtaacctaaaatcgtaaaaccgacgtcccgtagaaccggacgtaacccgggaggtaccgaccgggtaacctttacgtttaacttacgttgtacggtcggaaggttacggaacggggtaactaacggtaactaaccgttaccggttggtaaccgttcggggaaccggggg

SEQ ID NO: 385315 - DNA, 637 bp, Homo sapiens
  misc_feature: GZ8MTXP01D2IZ0.39.60.F05.1.454.CMB.2.raw
  modified_base (254)..(254): a, c, t, g, unknown or other
  modified_base (299)..(299): a, c, t, g, unknown or other
  modified_base (473)..(473): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcngcctctgattcgccttcagcagctattccatgcacgtgggtcccnccgaggctaccgagggggaacgggctgggagtgggtctcgatcctagttagtagttacgttctagtacattatcttatgctagcctacagtcgaagggcctattcacctatctaccaagaacgacgacgacaaagtaactcgtaagtttcgtttacagactaaaagtgaaaccncgtctaggaacgacggtaccggaaggacccgtacggttaaccttttacgtttaagttacgttggtaacggacggttaaagggttacgggttaaacgggttaaaccgttaaacggtaaccttaaccggttaccggttacggggtaaccggttcgggtaacggggg

SEQ ID NO: 385316 - DNA, 577 bp, Homo sapiens
  misc_feature: GZ8MTXP01B7BY4.39.60.F05.1.454.CMB.2.raw
  modified_base (301)..(301): a, c, t, g, unknown or other
  modified_base (423)..(423): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctattccatgcacgtgggtccnccaggcctccgagggggaaggggctgggagtgggtctcatccattagtagtacgttctagttacatatcttatgcagcctacaggtggaacgggcccattcaaccatctccagacgacgacnccaaagactcagttcgtttctgacaaatcgaaacagccctgaacgacgcccggaaaggccacgggtcttacttttagtaaccttggagcggttaagaggttaggggttaaccaaagggccttaaacgccgttggtaaccggttcgtaacggggg

SEQ ID NO: 385317 - DNA, 672 bp, Homo sapiens
  misc_feature: GZ8MTXP01BIM6X.39.60.F05.1.454.CMB.2.raw
  modified_base (331)..(331): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcgtgggggaggcctggtcaagccgtgggggtccctgagactctcctgtgcagcctctggattcgccttcagcagctattccatcgcacgtgggtcccgccgaggcctccggagggaagggggctgggnggtgggtctcgatccattagtagtacgttctagttacattatacttatgcaacgtcctcgaggtggaaacggggtcctattccaactagtcctaccgaaggaaccgaccgtaaccgaccaaaggaaccttccgtaagggtttacgttttaccggaggtaaccctaaaagtcggaaaaccacgcccgttaggaaacggacggtaacccgggaggaaccgtacgggtaaccttttaccgttttattaaccgttgggtacgtaacggttaagggacggttaaaccggggttaataaccgggaacttacccgtacggttacgggtaacgttcccggtaagggggg

SEQ ID NO: 385318 - DNA, 570 bp, Homo sapiens
  misc_feature: GZ8MTXP01ACZGF.39.60.F05.1.454.CMB.2.raw
  modified_base (432)..(432): a, c, t, g, unknown or other
  modified_base (472)..(472): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagccgtggggggtccctgagactctcctgtgcagcctctggattcgccttcagcagctattccatgcactgggtcccgccaggcctccgaggggaaggggctgggagtgggtctcatcctattagtagtacgttctagttacatatcttatgcagctcagtgaagggccattcacctatctacagacgacacgacaagaactcagttnttcgtgacaaagtcgaacagcctagagcgaccgaggaccncgggtctcgttttatacttggtacggtacgagggttaggaacgggttaacgtaacgggaacttaaccgacccggttggtaacggttcggtaacggggg

SEQ ID NO: 385319 - DNA, 597 bp, Homo sapiens
  misc_feature: GZ8MTXP01ETPKQ.39.60.F05.1.454.CMB.2.raw
  modified_base (380)..(380): a, c, t, g, unknown or other
  modified_base (469)..(469): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtggggggtccctgagactctcctgtgcagcctctggattcgccttcagcagctattccatgcacgtgggtcccgccagggcctccgagggggaacggggctgggagtgggtctcatccagttacgtagtacgttctagttacattatacttangcagcctcgagtggaacgggccattcgacctatctaccagacgacgacgaccaaagactcagttcgtttcgtagacctaaatcgaaacncgtcctaggaacgcggaccgagggacctacgggtctttacttttagtaccgttgtggaccgaaggacgggaacgggttaacgtaacggtaacttaaccgtacgttgggtaaccgttcggtaacggggg

SEQ ID NO: 385320 - DNA, 706 bp, Homo sapiens
  misc_feature: GZ8MTXP01BC5BB.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctattccatgcacgtcgggtcccgccaggctccggagggggaaggggcgtgggaggtcgggtctcgattccagtttagtagttacgttctagttactattatactttaatcggactacgccctacgaggttacgggaaacgggtcccgtaatttcccgaacctaactcctaccgaggaaacggaccgtaaccgacccgtaaaaggaaccttccgtaaaggtttcggttttacacgtaacgtaaaacgttacgaaaccaccggtaccctaggaaaccggaccgggtaccggaacggggaaccctaccgggtctttaacgtttttactaaaccgttggttacggacggttaagggcgggttaaacgggttaaacgtaacgggtaaccttacggtaccggttacggtaaccggttaacggtaaccggggg

SEQ ID NO: 385321 - DNA, 637 bp, Homo sapiens
  misc_feature: GZ8MTXP01BS0QD.39.60.F05.1.454.CMB.2.raw
  modified_base (176)..(176): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaggtntccagtgtcaggtgcagctgggtggagtcgtgggggagccgtggtcgaagccgtgggggtcccgtgagactctcctgtgcagcctctggattccgccttcagcagctattccatgcacgtcgggtccgccgaggcctaccggagggggaacgggggcgtgggaggtcgggtctcatcctagttagtagtacgttactagttactattattacttatcgactacgtcctacgaggttacggaaacggggtccctattccaacctatcctaccgaaggaacggacgaaccgaccaaagtaacctcgtaagtttcgtttactacgaactaaagtcggaactacgcctaggaacgcgaccggagaccacggtctttactttagtaccgttgcggcgaaggttaggacggggttaaacacgggtaaccttaaccgtacggttcgggtaacgttcgggaaccggggg

SEQ ID NO: 385322 - DNA, 680 bp, Homo sapiens
  misc_feature: GZ8MTXP01ESTH6.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggagcctggtcagccgtgggggtccctgagactctcctgtgcagcctctggattcgccttcagcagctattccatgcacgtcgggtcccgcacggcctccggagggggaacgggcgtgggaggtcgggtctcgattccaattaggtagttacgtttcttaaggttacattacttactttatgactacgtccctacgaagggttacgggaacgggggtcctaacttaccgaaccctaagtcctaccgaaggacgaaccgaccgaccaaagaacctcgtaagtttcgtttactacgaactaaaactacgaaccaacgcccgttaagggaaacgacggacccgaagggaacccaccgggttctttaacgttttactacggttagtaggacggttaagggaacggttacgggtaacgtaaacgggtaaccttaaccggtaaccgttcgggtaaccggtttcgggaaccggggg

SEQ ID NO: 385323 - DNA, 611 bp, Homo sapiens
  misc_feature: GZ8MTXP01AOJ08.39.60.F05.1.454.CMB.2.raw
  modified_base (299)..(299): a, c, t, g, unknown or other
  modified_base (355)..(355): a, c, t, g, unknown or other
  modified_base (433)..(433): a, c, t, g, unknown or other
tcagtcgcactagtcacgaccggtgctcgatttagtacgtcatcagggaaagggggagagaggagccttagccctggattccaaggcccatccacttggtgatcagcactgagcaccgaggattcaccatggaactggggctccgctgggttttccttgttgcttattttaaaaggtgtccagtgtgaggtgcagctgttggagtcgtgggggagcttggtacaggccggggggtccctgagactctcctgtgcagcctctggattccaccttcagcagctatgccatgacctggtccncaggctccgagggaggctggagtgggtctcgtctagttagtggagtggtgccttanacaaactcgcaagccctcggtggaacgggcccgactttccaccactcctaccagtaacgactacttacccaaaggacncaactcgtgttactcgtagacaaagtcgaacacgacccgttgaggtcgacccggaaaggaccgaccggtaccctattaattaagttagttgaacgttaaggtggggtggggggttaggttcgggggactaacgtcgttcgggtccgttttaggacgttaacggttcggggtaacccgg

SEQ ID NO: 385324 - DNA, 747 bp, Homo sapiens
  misc_feature: GZ8MTXP01EX8T5.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggagctggtcaagccgtgggggtccctgagactctcctgtgcagcctctggtacttcgccttcagcagtctattccatgcacgtcgggtcccgccgaggcctccggaggggacggggcgtgggagtcgggtctcgatctagttacgtagttacgttactagttactattacttacttatcgctacgtccctacgaggtacgggaacgggtccctaattaccacctatacctaccgaaggaacgaaccgaaccgaccgaaacgtaaccgtactaagtttccgtttacggttaacggaaacctaaaagttaccggaaaaaccgtcggtaccccgttaaagggaaaccgggtaaaccgggtacccggggaaaccgggtacccgttaacccggggtttaactttttaacccgtttttaaagtacccggtttaggaccgggtaacgggttaaagggttaacgggttaaccggggttaaagtaaacgggtaaacccttaacggtaccggttacgggtaaccggtttcggggaaaaccggggg

SEQ ID NO: 385325 - DNA, 680 bp, Homo sapiens
  misc_feature: GZ8MTXP01EF3CO.39.60.F05.1.454.CMB.2.raw
  modified_base (274)..(274): a, c, t, g, unknown or other
  modified_base (518)..(518): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggtttccttgttgctatttagaaggtgtccagtgtgaggtgcagctgggtggagtcgtgggggagccgtggtcaaggccgtgggggtccctgagactctctgtgcagcctcgtggattccgccttnacgcagctacttccagtcgctacgtcgggtcccgaccgacgggccgtaccggagggggaacgggggtccgttagggggacggttcgggggttcctacgtacttacctaagtttaacggtaggtttaaccgtttacgtaagtttaacatttacgttactttaagtcggtactacgtcccttacgaggttacgggaacggggtcctattccaactactcaccgagaacggaccgacgaacccgaanaacctctaagttccgtttacggacgtaacgtaaatacgaaactcgaccgtaggaacggacgaccggaacggacctaacggtcttacgtttatacgttgtacgaggagaggttaacgggtaacaaggtaacctacggtacgagggtaaccgttggtaacgggg

SEQ ID NO: 385326 - DNA, 710 bp, Homo sapiens
  misc_feature: GZ8MTXP01EWR0F.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaaggcctggggggtccctgagactctctgtgcagcctctggattcgccttcagcagctattccatcgcacgtggtccgccaggctccgaggggagggctgggagtgggtctcgatcctattagtagtacgttctagttacatattacttatgctacgtcctgaggtaggaacgggcccgtaactttcaccctatccgtaccgaaggaacgacgaaccgaccgaaagaaacctccgaaagtttcgttttaccggtaggtaacctaaaagttacgggaaacctacggacccgttagggaaacggtacggggtaacccggaaacgggggaccctaaccgggggtccttttaaccctttttaaagtttaccggtttggtacggtaaccggggttaaaggacggggttaagggggttaaaaccgtaaacggggtaaccttaaaccgggttacccggttagggggtaaaccggtttcccgggttaaacgggggg

SEQ ID NO: 385327 - DNA, 355 bp, Homo sapiens
  misc_feature: GZ8MTXP01EXWCX.39.60.F05.1.454.CMB.2.raw
  modified_base (262)..(262): a, c, t, g, unknown or other
  modified_base (348)..(355): a, c, t, g, unknown or other
tcagtcgcactagtcacgaccggtgctcgatttagtacgtcatcagggaaagggccgattcaccatctccagagacgacgccaagaactcagtgtttctgcaaatgaacagcctgagagccgaggacacggctctttattactgtgcgagagagggtactaaggactactacctggacgtctggggcaaagggaccacggtcaccgtctccttagcttccaccaagggcccatccgtcttcccctggcgccctgctccaggncacctccgagagcacagccgccctgggctgcctggtcaaggactacttccactagtgcgactgagcgggctggcaaggcgcatagnnnnnnnn

SEQ ID NO: 385328 - DNA, 607 bp, Homo sapiens
  misc_feature: GZ8MTXP01A4E6A.39.60.F05.1.454.CMB.2.raw
  modified_base (461)..(461): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtcctgagactctcctgtgcagcctctggattcgccttcagcagctattccatgcacgtggtccgccagctccgaggggaacgggctgggagtcgggtctcgatccgtattacgtagttacgttctagttacattatacttatgcagccctgagtgaacgggccattcacatcctaccgagacgacgacgccaaagactcaagttcgttcgtagactaaaatcgaaacncgacgtaggaacgacgaccggaaggacccgtaacggtctttacgttttactacgttcggtacggacggttaacggttacggttaacgggttaacaaacgggttaacctaaccggtaccggttacggtaaccgggttcggaacgggg

SEQ ID NO: 385329 - DNA, 644 bp, Homo sapiens
  misc_feature: GZ8MTXP01DPY9V.39.60.F05.1.454.CMB.2.raw
  modified_base (503)..(503): a, c, t, g, unknown or other
  modified_base (533)..(533): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcagccgtgggggtcctgagtactctcctgtgcagcctctggacttcgccttcagcagctattccatgcacgtcgggtcccgccgaggcctaccggagggggaacggggtcgtgggggaggttcgggtctcgacgtcctaagttaggtacgttacgttacgttaagttacattattacttattcgcacgtcctcgagtggaaacggggtcctattcacctatcctaccagaacgacgaccgacaacgtaactcgtagttcgtttcagtaactaaatacgaaacncgtcctaggaacgacgccgggaacggtacnccgggttctttcgttttactacgtttggtacgacgggaaggacggggttacgggttaaccgtaacggtaacttaaccgtacggttacgggtaacgttcggggtaacggggg

SEQ ID NO: 385330 - DNA, 640 bp, Homo sapiens
  misc_feature: GZ8MTXP01CG9PH.39.60.F05.1.454.CMB.2.raw
  modified_base (252)..(252): a, c, t, g, unknown or other
  modified_base (270)..(270): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtcctgagctctcctgtgcngcctctgattcgcttcancagctattccatcgcacgtcgggtcccgccgaggcctccggagggggaacgggggtcgtagggggaggttcggggttctacgtacttccgtaagtttaggtagttacgtttactagttactattattacttatcgctacgcctgaggtacggaacgggcctattccacctactccgtacagacgaccgacgacaagactgagttcgttacgagaactaaagtcgaaacgtcgaccgtaggaacgaccggtacggaacgaccgtacggtctttaacgtttacgtacgttggtacggcgttaaggttacgggagggttaaaccgtaggtaaccttaccggtacgttcggggtaaccgttcggggtaacgggg

SEQ ID NO: 385331 - DNA, 645 bp, Homo sapiens
  misc_feature: GZ8MTXP01B24XB.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcgccttcagcagctattccatgcacgtcgggtcccgccgaggcctccggagggggaacgggggcgtgggaggtgggtctcgatcctagttagtagtacgttctagttacattatcttatcgcagtcctgaggtacggaacggggtcctattccaacctactcctaccgaagacggaaccgaccgaccgaaagacctcgtaagttcgtttacgagtaacctaaagtacgaaccacggtcctagggaacgacggtacccgggaaggacctaccgggtctttacgttttacgttacgttggtacggacggttaaggacgggttaacgggttaactaagggtaaccttaacgtacggttcgggtaacgttcgggtaacggggg

SEQ ID NO: 385332 - DNA, 691 bp, Homo sapiens
  misc_feature: GZ8MTXP01BMSMM.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggacttcgccttcagcagctacttccatcgcacgtcgggtcccgccaggcctaccggagggggaacgggggcgtggggaggttcgggtctcgtacttccgtaagttaggttagttacgtttacgttagtttaactagttacttaactttatcggcacgtccctactaggtacggaacggggtcctactttccaacctctcccgtaccgaacggaacgacccgaaccgtaaccccgaaagtaaccctacgtaacggtttcgtttacgtaacggtaacctaaaagtacgaaacacggtcctaaggaacgacggtacccgggagtaacccgcggtctttacgtttagtaccgttggtacgacgttagggacggttaacgggtaactaacggtcttacccgtacggttagggtaaccggttcgggtaacggggg

SEQ ID NO: 385333 - DNA, 810 bp, Homo sapiens
  misc_feature: GZ8MTXP01AFGXI.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgacgactctcctgtgcagcctctggattcgcctcagcagctactcatcgcacgtcgggtcccgccgaggtcctccgagggtagggggacgggtcggtagggtacgggttcggtactacgtacttaccgttaagttaaggttacgtttacgtttacgttaacgttaacttattaaactttacttaacgtcgtaccgtaccgtacccgtacggtacggggtaaacgggtaaccggggttacccttaacttacccaacctacctaccccttacggaaccggaacggaacccgtaacccggaaacccgtaaacgttaacctacggtttacgttttaccggggtttaaccgtaacggtaaaccttaaaacggaccgaaaaccgtccggtaaccggttacgggaacggaccgggtaacccggacgggtaacccggttcggttacctttttaacggttactttcgggtacgtcggggaacggttacggggttaaacgggttaacggttaacccggttaaacgttaaccggttaccccgttaacggggttaaccgggttaacgggtttaacccggggg

SEQ ID NO: 385334 - DNA, 625 bp, Homo sapiens
  misc_feature: GZ8MTXP01AG7CM.39.60.F05.1.454.CMB.2.raw
  modified_base (466)..(466): a, c, t, g, unknown or other
  modified_base (483)..(483): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagccgtggggggtccctgagactctcctgtgcagcctctggacttcgccttcagcagtctacttccatcgcacgtcgggtcccgccgaggcctcccgaagggggaacggggcgtgggaggtggggtctcgactccgtattaggtagttacgttctagttacatattcttatgcagcctcgagtgaacgggtcctattcacctatctaccagacgacgacgccaaagactcgagttcgttacngaactaaagtcgaaacncgtaccgtagacggacgtccccggaaggacccgcgggtcttacgttttaaactccgttaggtcgacggttaggttacgggaacggggttaacaacgggtaaccttaacgtaccggttagggtaaccggttcggtaacggggg

SEQ ID NO: 385335 - DNA, 796 bp, Homo sapiens
  misc_feature: GZ8MTXP01AN6VC.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactgggctccgctgggttttccttgttgcttattttagaaggtgtccagtgtgaggtgcagcgtggtggagtcggtgggggaggcctggcaaggccggtcgggggtccctgacgtactctccgtgtcgcacgcctcgtgtacttccgccttcagtcagtctactccatcgactacgtcggtcccgcgacggccgtaccggaagggggacgggcgtaggggtacggtcgggtttcctacgtacttaccgtagtttaacggtaggtttaacgtttaccgttaaaggtttaacctaatttactttaacgtttactcggtaccgtacgtcccgtacggtaagggtacgggaacgggtacccgtactttacccaactactccctacgaaggaacccggacgtaacccgaccgtaaaacgtaacccttcggtaaacgttttcgtttacggtaaaccgtaaacgtaaaacgttaccgaaaaccgtccgggtacccgttaagggaaaccgggacccggtaccgggaacgggtaacccgtaccgggtttcctttaaccgttttaaacgtaccggttggtacggaacggttaaggggttacggttaaacgggttaacgtaacggtaacccttacggtaaccggttacgggtaaccggttcgggaaaccggggg

SEQ ID NO: 385336 - DNA, 672 bp, Homo sapiens
  misc_feature: GZ8MTXP01D8NCE.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactgggctccgctgggttttccttgtttctattttagaaggtgtccagtgtgaggtgcagctggtggagtcgtgggggagcctggtcaaggccgtgggggtccctgagactctctgtgcagcctctggacttcgccttcagcagctattccatcgcacgtcggtccgccgaggcgtccgagggggaaggggcgtggagtgggtctcatccagtttagtagtacgtttcctagttacagttattcttaaatgctgtccgtacgtaggtacggaacgggtccgtaactttccaacctacttccaccgaaaggacgaaaccgaccgaacaaacggaaccttacgaacgtttcgtttactaggtaaaccgtaaagttacgaaaccgtacgccgtagacggaacgccggtaaaggacccgtacggtaccttaacttttaacttgttacgttacgaacggtaagggttaaggttaacgggttaaacgtaaacggtaccttaaccgtaccggtagggttaccgtaacggttaaggggtaaacccgg

SEQ ID NO: 385337 - DNA, 581 bp, Homo sapiens
  misc_feature: GZ8MTXP01E2J8D.39.60.F05.1.454.CMB.2.raw
  modified_base (390)..(390): a, c, t, g, unknown or other
  modified_base (415)..(415): a, c, t, g, unknown or other
  modified_base (489)..(489): a, c, t, g, unknown or other
  modified_base (503)..(503): a, c, t, g, unknown or other
  modified_base (511)..(511): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcgtgggggagccgtggtcaagccgtgggggtccctgagactctcctgtgcagcctcgtggattccgccttcagcagctattccatcgcacgtcgggtcccgccgaggcctaccggagggggaacggggctgggaggtgggtctcgatccattagtagtacttctagtacatatacttatgcagcctnaggtagaacgggtccattcaacctntcacagacgaccgacacctaaagactcgagttgtttacagtaacaaagtcgaacagtccagacgagccgagacncggtcttactttanacgttggngcggaagaggttaacgggtaactaagggaacccttaagtacccgttggggtaaccgttcggaaacggggg

SEQ ID NO: 385338 - DNA, 705 bp, Homo sapiens
  misc_feature: GZ8MTXP01DBF88.39.60.F05.1.454.CMB.2.raw
  modified_base (559)..(559): a, c, t, g, unknown or other
  modified_base (613)..(613): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggagccgtggtcaacggccgtgggggtccctggacgactctcctgtcgcacgtcctcgtggacttccgccttcgagcagtcttactccatcgctacgtcggtcccgcgacggtcctaccggaagggggaacgggggtcgtagggggacggttcgggggttcctacgtacttaccgttaagtttagttacgtttaaccgtttacgttaagtttactattacttacgtttatcgactacgtcctacgaggtacgggaacgggtccctattccaacccgtatcctaccgaagacgaccgaacgtaccaaagtactcgtaagtttcgttacagtaacctaaagtacgaaacncgacgtaggaacggaccgcgggaacgaccgtcggtaactttcttttacgtacgnggttacggacgttaaagggcggttaaacgggttaaccctaaagggtaacccttacgtacggttacggttaacgttaacgggtaaaccggggg

SEQ ID NO: 385339 - DNA, 642 bp, Homo sapiens
  misc_feature: GZ8MTXP01CB10U.39.60.F05.1.454.CMB.2.raw
  modified_base (264)..(264): a, c, t, g, unknown or other
  modified_base (476)..(476): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactgggctccgcttgggttttccttgttgcttattttagaaggtgtccagtgtgaggtgcagcgtgggtggaggtcggtgggggaggccgtggtacgaaggccgtgggggtccctgagactctcctgtgcngcctgtggacttccgccttcagcagtctacttccatcgctacgtcggtcccgccgaggcctcggagggggacgggcgtgggaggtcgggtctcgtattcctaagttacgtagttacgttacttagttactattattacttagtgctacgtcctagaggtacggaacgggtcctattccaccgtatcctaccgaagacgaccgtacacgaaanaccttgagtttcttacgagtaaacaatacgaactcgctaggaacgacgacccgggagaccgtcggttaacctttattttacgtacgttggtacgacgaagggttacggttacggtaacgtaacggtaacttaccgacggttagggtaaccgttcgggaaacggggg

SEQ ID NO: 385340 - DNA, 619 bp, Homo sapiens
  misc_feature: GZ8MTXP01D21RE.39.60.F05.1.454.CMB.2.raw
  modified_base (293)..(293): a, c, t, g, unknown or other
  modified_base (469)..(469): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactgggctccgctgggtttcctgttgctatttagaagtgtccagtgtgaggtgcagctggtggagtcgtgggggagcctggtcaagccgtgggggtccctgagactctcctgtgcagcctctggattcgccttcagcagctattccatgcacgtggtccnccaggctccgaggggaagggctggagtgggtctcgatccattagtagtacgttctagttacattatacttatgcagtccctcgagtggaacgggcctatttccacctatcctaccaagaacgaccgacgacccaagaaacctgaagttcgttttcagactaaaattcggaaaaccncgacgagaacgacggaccggaacggaccgtacggttaactttacgtttacgttacgttggtacggtaacggaagggttacgggttaaacgggtaacgtaaacggtaaccttaaccggtacggttacgggtaaccggttcgggtaacgggg

SEQ ID NO: 385341 - DNA, 646 bp, Homo sapiens
  misc_feature: GZ8MTXP01DQ99Z.39.60.F05.1.454.CMB.2.raw
  modified_base (420)..(420): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcgccttcagcagctattccatgcacgtggtccgccgaggcctcggagggggaacgggcgtgggaggtgggtctcgattcctaattagtagttacgttactagttactattattacttaatcgcagcctcgagtggacggggcctattccaactntcctcgagaacgaccgacgaccaaagaactcgtaagttcgtttacgagtacctaaaagtcgaaacgacgtccgaggaacgacggtccgggaacggaccgtaccgggtaactttcgttttaaactttccggaggttacggacggttaaagggcgggttaaacgggttaacgaaacggttaacccttaaccggtaccggttagggtccggttcgggtaaacccggggg

SEQ ID NO: 385342 - DNA, 369 bp, Homo sapiens
  misc_feature: GZ8MTXP01DI135.39.60.F05.1.454.CMB.2.raw
  modified_base (249)..(249): a, c, t, g, unknown or other
  modified_base (290)..(290): a, c, t, g, unknown or other
  modified_base (345)..(345): a, c, t, g, unknown or other
  modified_base (349)..(369): a, c, t, g, unknown or other
tcagtcgcactagtcacgaccggtgctcgatttagtacgtcatcagggaaagggccgattcaccatctccagagacgacgccaagaactcagtgtttctgcaaatgaacagcctgagagccgaggacacggctctttattactgtgcgagagagggtactaaggactactaccgtggacgtcgtggggacaaagggaccacggtcaccgtctctagcttccacgaaggccatccgtcctccccgtgccncctgctcgagcgcacctccgagcgcacacgccgccgtggcngccgtggacagactactccatgtgcgagtgacggtcggctggacgaaggcgtaanagannnnnnnnnnnnnnnnnnnnn

SEQ ID NO: 385343 - DNA, 753 bp, Homo sapiens
  misc_feature: GZ8MTXP01A24G7.39.60.F05.1.454.CMB.2.raw
  modified_base (275)..(275): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagctctggacttcgccttcancagctacttccatcgctacgtcgggtccgccaggccgtaccggagggggaacgggggtctgggaggtgggtcctactagtcctaatttacggtagttacgtttacttaaggttactattacttacttaagttcgactacgtccctagtaacggtacgggaaacggggtacccgtatttacccaacctacttccctaaccgaagggaaccggaacccggtacccgaaaccgtaaacgggtaaacccttaccgtaaggttttccgtttcgtaacggtaaacccgtaaaagttaaccgggaaaactaccggacccgttagggaaacggaccgggtacccgaaacggggtaccgtacccgggttaacttttcgttttaaagttccgttaggacggtacggttaagggttcgggttaaacgggttaactaacgggtaaccttaaccggtaccggttacgggtcccggttcgggtaaccggggg

SEQ ID NO: 385344 - DNA, 578 bp, Homo sapiens
  misc_feature: GZ8MTXP01E3U7W.39.60.F05.1.454.CMB.2.raw
  modified_base (274)..(274): a, c, t, g, unknown or other
  modified_base (476)..(476): a, c, t, g, unknown or other
  modified_base (486)..(486): a, c, t, g, unknown or other
  modified_base (501)..(501): a, c, t, g, unknown or other
  modified_base (534)..(534): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctgggtcaagccgtgggggtccctgagactctcctgtgcagcctctggattcgcttcancagctattccatgcacgtcgggtcccgcacggcctaccgagggggaagggctgggagtgggtctcatccattacgtagtacgttctagttactatatacttatgctagcctagaggtagaacgggccctaattccaacatcaccgagacgacgacgacctaaagactcagttcgtttcagacaaatgaaccagcctagacgngaccgagacncggtaacttgtttanacgttgtacgacggaagttagggacgggttaanaaacgggtaacctacgaccgttagggaaccgttcggtaaggggg

SEQ ID NO: 385345 - DNA, 594 bp, Homo sapiens
  misc_feature: GZ8MTXP01EQ7T5.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaagtgtccagtgtgaggtgcagctggtggagtcgtgggggagcctggtcaagccgtgggggtccctgagactctcctgtgcagcctctggattcgccttgagcagctattccatcgcacgtcgggtcccgccaggcctccgaggggagggctgggagtgggtctcgatccattacgtagttacttctagtacattatacttatcgacagtcctacgagtgaacgggtcctatttaccacctatcctacagacgacgacaccaagacctgagttcgtttacgacgaactaaagtcgaaacgcgtcctaggacggacgacccggaggaccacggtctttaacgttttatacgttgacgacgagagggttaacggtaactacgggtaaccttacgtaccggttggtaaccggttcggaaccggggg

SEQ ID NO: 385346 - DNA, 679 bp, Homo sapiens
  misc_feature: GZ8MTXP01BRZUI.39.60.F05.1.454.CMB.2.raw
  modified_base (603)..(603): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcgtgggggagcctggtcaagccgtgggggtccctgagactctcctgtgcagcctctggattcgccttcagcagctacttccatgcacgtcgggtccgccaggcctcggacgggggaagggcgtagggaggttcgggtcttcgattaccgtagtttaaggttagttaccgtttacttaagtttaacctatttacttactttaactgtaccaacggtccctacgtaagggttaggaaacggggtccctaatttccaaccgtaactcctaccgaaggaacgaccgaaccaccgaaacgtaactcgtaagttcggttttacagtaacgtaaaacgtcgaaactcgccgttaagacggtacgcccgggaaggacctcgggctttaacgttttataccgttgacgnggaacgttagggttaacgggtaaactaacgggtaacttaacgtcccggttagggtccggttaacggtaaccggggg

SEQ ID NO: 385347 - DNA, 714 bp, Homo sapiens
  misc_feature: GZ8MTXP01AVK9D.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggagcctggtcaagccgtgggggtccctgacgtactctccgtgtgcagcctctggattcgccttcagcagctacttccatcgcacgtcgggtcccgccgaggcctaccggaggggaacgggctgggaggtcgggtctacgactctaagttagtagttacgtttcttaagttacattagttactttaagtcgctaacgccctagacggttagggaacgggtacctactttccaacctacgttacccgaccgaacggaacgaaacccggaacccgtaacccgaaaacggaaccgttacggtaacgttttcggtttacctaggaaactaaaacgttcgaaaccgtgacccgtggaaaggaccggaccggtaacggtacccgtcggtaacttttaaccttttaagttacccgttaggttacggaaccgaaaaccggttaccccggttccgttaacctaggggttccggggtagggtagtttacgtcgggttcgggtaacccggggg

SEQ ID NO: 385348 - DNA, 689 bp, Homo sapiens
  misc_feature: GZ8MTXP01EOLN6.39.60.F05.1.454.CMB.2.raw
  modified_base (561)..(561): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgcttgggttttccttgttgcttattttagaaggtgtccagtgtgaggtgcagcgtggtggagtcggtgggggaggccgtgggtcgaaggtccggtcggggggtccctggacgtactctcctgtgcacgcctcgtggtacttccggccttacgacgcacgtctacttcagtcgcctacggtccggtcccgaccgacggtccgtacgggagggggacgggtcggtgggtagggtcggtctacgtactaccgtagttaggtagtttacgttacttacgttactattacttaacttagtcgactacgtccgtacgaggtacgggaacgggtacctacttaccaacctctccgacgaagaaccgaccggtacaacaaacgtctacgttagtttcttacgacaaacgtaaacgacggtaaacncgtacgaggaacggacggacggtacgtaccgtacgtttaactttagttacgtgttaggacgtacggaaggttacggttacgtaacgacgttaacgtacggtacggttacggtccggttaagggaacgg

SEQ ID NO: 385349 - DNA, 559 bp, Homo sapiens
  misc_feature: GZ8MTXP01D2VD2.39.60.F05.1.454.CMB.2.raw
  modified_base (269)..(269): a, c, t, g, unknown or other
  modified_base (291)..(291): a, c, t, g, unknown or other
  modified_base (403)..(403): a, c, t, g, unknown or other
  modified_base (428)..(428): a, c, t, g, unknown or other
  modified_base (433)..(433): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtggggggtccctgacgactctctgtgcagcctctgatcgctnagcagctatcatgcactggccncgaggctcgaggggaacgggctagggagtgggtctcgatccaattacgtatagttctagtacatatacttatgcagtccctagagtagaacgggtcctaattcaaccagtcnccaagaacgtaccaccggacaaaanaactntagttcgtttacgaagtaactaaaagaagaacaacgacgagagacgacgacgacgacgtaactacttattattgtagagagaggaaggtaagtaagaactactacgttacggtaacgttggtaagg

SEQ ID NO: 385350 - DNA, 535 bp, Homo sapiens
  misc_feature: GZ8MTXP02JY9FO.39.60.F05.1.454.CMB.2.raw
tcagtcgcactagtcacgaccggtgctcgatttagtacgtcatcagggaaaggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcgccttcagcagctatgccatgacctgggtccgccaggctccgaggggaaggactggagtgggtctcgtctattagtggaagtggtgcttatacaactacgcagcctccgtgaacgggccgcttcaccatctccagagactatccaagagcactctgtatctgcaaatgaaacagcctgagtcgaccgaggacacggccctagtacttatgtgacgtaaagtgggtgggggtaggtgggggctacgtccgtggtcgtttacgacttacggg

SEQ ID NO: 385351 - DNA, 554 bp, Homo sapiens
  misc_feature: GZ8MTXP02G53GS.39.60.F05.1.454.CMB.2.raw
  modified_base (448)..(448): a, c, t, g, unknown or other
  modified_base (463)..(463): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctattccatcgcacgtcgggtccgccaggcctccgaggggaacggggctgggagtggggtctcgatcctattagtagtagttctagttacatatcttatgcagcctcagtggaacgggtcctattcacctatctccagacgacgacgaccaaagactcgagttgtttcngtacaaatcgaaacngcctagagacgccgaaggacacggtcttactttatactggtacgcgaggagtaggtaactaaggactactacgtcggtacgtacgacgggg

SEQ ID NO: 385352 - DNA, 595 bp, Homo sapiens
  misc_feature: GZ8MTXP02HE3EE.39.60.F05.1.454.CMB.2.raw
  modified_base (395)..(395): a, c, t, g, unknown or other
  modified_base (464)..(464): a, c, t, g, unknown or other
  modified_base (528)..(528): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctgggtggagtcgtgggggaggcctgggtcaaggccgtggggggtccctgagactctcctgtgcagcctctggattcgccttcagcagctattccatgcacgtcgggtccgccaggcctccgaaggggaaggggctgggaggtggggtctcgactcctaagttagtagtacgttctagttacattattcttatgcagcctnagtgaagggcctattccacctatcgtaccaagacgaaccgacgaccaagaacctcgaagtttcgtttcngaacctaaatcgaaactacggacctaggaagacggcccgaagggaccaacggtcttacttttanacgtgtacggacgaggaaggaggtaacgtaaggaaccttacgaccgtagggaacgttcgaacggggg

SEQ ID NO: 385353 - DNA, 587 bp, Homo sapiens
  misc_feature: GZ8MTXP02GCZYS.39.60.F05.1.454.CMB.2.raw
  modified_base (274)..(274): a, c, t, g, unknown or other
  modified_base (396)..(396): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttnagcagctattccatgcactgggtccgccaggctccgaggggaagggctggagtgggtctcgatccattagtagtagttctagttacatatcttatgcagcctcagtgaagggcatcacatcncagagacgacacaagaactcagttcgtttcagtacaaaagttcgaaaactacgcctaggaacgaacggcccggaagggaaccaacgggtcctttacgttttaacttacgttggtcgaccggaaggtaaggtaaacggggtaacttaaacggggaacttaaccgtaccgtggggaaccgtcggtaacggggg

SEQ ID NO: 385354 - DNA, 526 bp, Homo sapiens
  misc_feature: GZ8MTXP02F16JH.39.60.F05.1.454.CMB.2.raw
  modified_base (483)..(483): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctatccatgcactggtccgccaggctccgagggaaggggctggagtgggtctcgatccattagtagtagttctagttacatatcttatgcagcctcagtgaagggccattcaccatctccagagacgacgccaaagaactcagtgtttcagtcaaatgaaacagcctagagagccgagacacggctctttatactgtgcgaagngaaggggtaactaaggactaactaccgtaggacgtctaggggg

SEQ ID NO: 385355 - DNA, 627 bp, Homo sapiens
  misc_feature: GZ8MTXP02JRN67.39.60.F05.1.454.CMB.2.raw
  modified_base (377)..(377): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcgccttcagcagctattccatgcacgtcgggtccgccaggcctaccgaggggaaggggcgtgggaggtgggtctcatcctattagtagtacgttctagttacatatcttangtcagtcctcagtggaacgggccctattccaacctattccgtaccagaacgaccgaaccgacccaaagtaacctctaggttgtttaccagtaactaaaacgtggaaaaccgcgtaccgtaggacggacggaccggaacggaccgtaccggttactttacgtttagttacgtggacggacggtaaggtaacggtaacgggtaaacgtaacggtaaccttaccgtacggtacggtacggtacggtacggggg

SEQ ID NO: 385356 - DNA, 537 bp, Homo sapiens
  misc_feature: GZ8MTXP02HUH84.39.60.F05.1.454.CMB.2.raw
  modified_base (435)..(435): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctattccatgcactgggtccgccaggctccgaggggaaggggctgggagtgggtctcatcctattagtagtacgttctagttacattatcttatgcagcctcagtgaagggccattcaccatctccagagacgacgacaagaactcagttgtttcngacaaatgaacctgcctgagagccgagggtacacgggtctcgttttatactgtcgcgtagagagggtaactaaggacttacgaccgtggacgtcgtacgggg

SEQ ID NO: 385357 - DNA, 351 bp, Homo sapiens
  misc_feature: GZ8MTXP02FY6ZD.39.60.F05.1.454.CMB.2.raw
  modified_base (349)..(351): a, c, t, g, unknown or other
tcagtcgcactagtcacgaccggtgctcgatttagtacgtcatcagggaaagggccgattcaccatctccagagacgacgccaagaactcagtgtttctgcaaatgaacagcctgagagccgaggacacggctctttattactgtgcgagagagggtactaaggactactacctggacgtctggggcaaagggaccacggtcaccgtctccttagcttccaccaagggcccatccgtcttcccctggcgccctgctccaggagcacctccgagagcacagccgccctgggctgcctggtcaaggactacttccactagtgcgactgagcgggctggcaaggcgcatagnnn

SEQ ID NO: 385358 - DNA, 612 bp, Homo sapiens
  misc_feature: GZ8MTXP02HZT1F.39.60.F05.1.454.CMB.2.raw
  modified_base (303)..(303): a, c, t, g, unknown or other
  modified_base (534)..(534): a, c, t, g, unknown or other
  modified_base (591)..(591): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattccgccttcagcagctattccatgcacgtgggtcccnccagggcctccgaaggggaaggggcgtgggaggtgggtctcatcctattagtagtagttctagttacattattctttatgctacgtcctacgaggtacggaaacggggtccctaattccaacctatcctacccgaagaacgacccgacgacccaaaagactcgtaagtttgtttacagacaaagtcgaaactgcctagacgacgaccgaggaccacggtcttacttttaancgttagtcggacgaaggtaggtaacgggttaactaaagggtaccttacgtaacccgngggtaacgttcggaacggggg

SEQ ID NO: 385359 - DNA, 532 bp, Homo sapiens
  misc_feature: GZ8MTXP02F04S5.39.60.F05.1.454.CMB.2.raw
  modified_base (395)..(395): a, c, t, g, unknown or other
  modified_base (398)..(398): a, c, t, g, unknown or other
  modified_base (403)..(403): a, c, t, g, unknown or other
  modified_base (492)..(492): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtgggagtcgtgggggaggcctggtcaagccgtggggggtccctgagactctcctgtgcagcctctggattcgccttcagcagctattccatgcacgtggtccgccaggcctccgaggggaggggctgggagtgggtctcatccattagtagtacgttctagtacatatcttatgcagcctcagtgaggccattcacntcncaganacgacgaccaagaactcaagttcgtttcagacaaatgaaacacgcctagagacgccgaagacacggtcttactttatctgtacgcgagngaggtaacaaggacctacgtacgtacggacgtcgtacggg

SEQ ID NO: 385360 - DNA, 550 bp, Homo sapiens
  misc_feature: GZ8MTXP02GT57B.39.60.F05.1.454.CMB.2.raw
  modified_base (532)..(532): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctattccatgcacgtgggtccgccaggctccgaggggaaggggctgggagtgggtctcatccattagtagtagttctagttacatatcttatgcagcctcagtgaagggccattccacatcgtccaagacgaccgacgacctaaagaactcagttgtttcagactaaagtcgaacagcctagagacgccggaaggacacggtcttactttatactgtcgacgaggagtagggtaactaacggactactaccgnggtacgtcgtaacggggg

SEQ ID NO: 385361 - DNA, 537 bp, Homo sapiens
  misc_feature: GZ8MTXP02FXGJW.39.60.F05.1.454.CMB.2.raw
  modified_base (299)..(299): a, c, t, g, unknown or other
  modified_base (376)..(376): a, c, t, g, unknown or other
  modified_base (497)..(497): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgtgcagcctctggattcgccttcagcagctattccatgcactgggtccnccaggctccgaggggaagggctgggagtgggtctcgatccattagtagtagttctagtacatatcttatgcagcctnagtgaagggccaaattcaccatctaccagacgaccgacgcccaaagaactcagttgtttcctgactaaatgaaacacgcctagagagccgaagacacggctctttatactgtacgcgaagngaggtaacgtaaggactacgtaccgtaggacgtcgagggg

SEQ ID NO: 385362 - DNA, 706 bp, Homo sapiens
  misc_feature: GZ8MTXP02J0YMP.39.60.F05.1.454.CMB.2.raw
  modified_base (546)..(546): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagcgtggtggagtcggtgggggacggccgtggtcaagccgtgggggtccctgagactctccgtgtgcagcctcgtggacttccgccttcgagcagtctattccatcgcacgtcgggtcccgccgacggcctaccggaggggacgggcgtgggaggtgggtctcatcctaagttagtagttacgttacttagttaactattacttcttaagtcgactacgtccttacgtaggttacgggaaacggggtcccgtaactttacccgaaccctactccctaccgaaggacgacccgaaccgacccaaaagtaacctcgtaacggtttcgtttaccaggaactaaaagtcggaaaaccncgtaccgtaggaacggacggacccgggaacgaaccgtaacggtccttttacgtttaaacgtccgtaggtaccggacgaagggtaacgggtaacgggttaaaccgtaaaccggtacctttaacccggacccggttagggtaccggttacggtaaccggggg

SEQ ID NO: 385363 - DNA, 568 bp, Homo sapiens
  misc_feature: GZ8MTXP02GOZZS.39.60.F05.1.454.CMB.2.raw
  modified_base (334)..(334): a, c, t, g, unknown or other
  modified_base (377)..(377): a, c, t, g, unknown or other
  modified_base (440)..(440): a, c, t, g, unknown or other
  modified_base (521)..(521): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcgccttcagcagctattccatgcacgtgggtccgccaggctccgaggggaaggggctggagtgggtctnatccattagtagtacgttctagttacatatcttatgcagcctnagtgaagggccattcacccatctccgagacgacgacgacctaagaaacctcaagttgtttacngacctaaaatggaaaacaggcccttaggaacgacggccgaaagggtacaacgggtcttactttaatacgtgtcgcgtaagngtaaggggtaactaacggacttacgtaccgtggaccgtgtacggggg

SEQ ID NO: 385364 - DNA, 535 bp, Homo sapiens
  misc_feature: GZ8MTXP02IAUDG.39.60.F05.1.454.CMB.2.raw
  modified_base (342)..(342): a, c, t, g, unknown or other
  modified_base (477)..(477): a, c, t, g, unknown or other
  modified_base (520)..(520): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagccgtggggggtccctgagactctcctgtgcagcctctggattcgccttcagcagctattccatgcacgtcgggtcccgccaggcctccggaggggaaggggctgggagtgggtctnatccattaggtagttacgttctagttacatatcttatgcagcctcaggtgaacgggccgattcaccatctaccagacgacgacacgtaaagactcagttgtttcagacaaatgaacagctagagacgcgtagacncggtctgtttatctgctcgagagaggtaacacggactacgacncggacgtcgacgggg

SEQ ID NO: 385365 - DNA, 565 bp, Homo sapiens
  misc_feature: GZ8MTXP02H1GDM.39.60.F05.1.454.CMB.2.raw
  modified_base (374)..(374): a, c, t, g, unknown or other
  modified_base (378)..(378): a, c, t, g, unknown or other
  modified_base (436)..(436): a, c, t, g, unknown or other
  modified_base (440)..(440): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgcttgggttttccttgttgctattttagaaggtgtccagtgtgaggtgcagctggtggagtcgtgggggatcctggtcaagccgtgggggtccctgagactctcctgtgcagcctctggattcgccttcagcagctattcccatgcacgtggtcccgccaggctcccgaggggagggctgggagtgggtctcatccattagtagttgtctagttacattatcttatgcancctnagtgaagggcctatccactatcctacagacgacgacgaccaaagactcagttctttcngtanaatgaacaggcctagagacgccgaggaccacggtacttacttttatacgttgacggacgaacggtaggaacggggttaactaaacgggaccttacgtacccgtgggtaccgttacggaacggggg

SEQ ID NO: 385366 - DNA, 578 bp, Homo sapiens
  misc_feature: GZ8MTXP02J0R1W.39.60.F05.1.454.CMB.2.raw
  modified_base (465)..(465): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctgggtcaagcctggggggtccctgagactctcctgtgcagcctctggattcgccttcagcagctattccatgcactgggtccgccaggctccgaggggaaggggctggagtgggtctcatccgattagtagtacgttctagttacatatcttatgcagcctgagtagaacgggccattccacctatcctaccgagacgaccgaacgaccaaagaacctcgaagttcgtttcagacaaaatcggaaaccngaccctaggaacgacggcccgaaggaccgaacggttcttaccgtttaataccgtgtcgacgagacggtaaggtaacgtaaggacctacgtaccgcggtacgtcggtaacgggg

SEQ ID NO: 385367 - DNA, 558 bp, Homo sapiens
  misc_feature: GZ8MTXP02IRAE1.39.60.F05.1.454.CMB.2.raw
  modified_base (336)..(336): a, c, t, g, unknown or other
  modified_base (423)..(423): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctattccatgcacgtggtccgccaggctccgaggggaaggggctgggagtgggtctnatccattagtagtagttctagttacattatcttatgcagcctcagtgaaagggccattcaccatcacagagacgacgaccaaagacncagttgtttcagacaaatcgaacagcctagagagccgagacacggtcttacgtttattacgtggtcgaccgtaaggacggtaacggtaacgtaaacggacctacgtaccgtacgggtaccttacgggtaacgggg

SEQ ID NO: 385368 - DNA, 555 bp, Homo sapiens
  misc_feature: GZ8MTXP02HSU4Q.39.60.F05.1.454.CMB.2.raw
  modified_base (381)..(381): a, c, t, g, unknown or other
  modified_base (399)..(399): a, c, t, g, unknown or other
  modified_base (402)..(402): a, c, t, g, unknown or other
  modified_base (407)..(407): a, c, t, g, unknown or other
tcagtcgcactagtcacgaccggtgctcgatttagtacgtcatcagggaaaggggagagaggagccttagccctggattccaaggcctatccacttggtgatcagcactgagcaccgaggattcaccatggaactgggctcgctgggtttccttgttgctattttagaaggtgtccagtgtgaggtgcagctggtggagtcgtgggggaggcctggtcaagccgtggggggtccctgagactctcctgtgcagcctctggattcgccttcagcagctattcccatgcacgtcgggtccgccgagggcctccgaggggaaggggcgtgggagtgggtctcgatccattagtagtacgtctagtacatatcttatgcagcctnagtgaagggccatcaacntcncaganaccgacgaccaaagactcagttcgtttcagacaaatcgaaacagcctagagaacgcccgtaagggaccacggtccttactttaatacctggtcgacggaagaaggagggtaactaaacggacttacgtaccgtggacgtcgtacgggg

SEQ ID NO: 385369 - DNA, 624 bp, Homo sapiens
  misc_feature: GZ8MTXP02FWTQX.39.60.F05.1.454.CMB.2.raw
  modified_base (410)..(410): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcgccttcagcagctatccatgcacgtcggtccgccacggcctccggaggggaaggggcgtgggaggtgggtctcgactccattagtagtagttctagttacatatcttatgcagtctcagtaggaacgggcctattccaacctntcctaccagaacgaccgacgaccaaagaacctcgtaaagtttcgtttacagaactaaaatacggaaaccacgtaccctaggacggacggacccggaaagggacccgacggtcttaccgtttaaattccgtggtaccgcggtaaggaggttaaacgggggtaactaaacgggtaccttaacgtaccggtacgggaccgttacgggtaaccggggg

SEQ ID NO: 385370 - DNA, 590 bp, Homo sapiens
  misc_feature: GZ8MTXP02IYEG4.39.60.F05.1.454.CMB.2.raw
  modified_base (373)..(373): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctattccatgcacgtggtccgccaggctccgaggggaacggggctgggagtgggtctcatcctattagtagtacgttctagttacatatcttangcacgtcctgagtgaaagggccctaattccacctatctaccagacgaccgacgaccaaagactcagttgtttcagtacaaatcgaaactcgcctaggacgtagcccggaaggaccacgggtcctttactttagtacgtggtcgacggtaaaggaggtaacgggtaactaaaacgggtaccttaaccgtaccgtacgggaccgtttacggaacggggg

SEQ ID NO: 385371 - DNA, 628 bp, Homo sapiens
  misc_feature: GZ8MTXP02IPDVV.39.60.F05.1.454.CMB.2.raw
  modified_base (257)..(257): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactgggctccgctgggtttcctgttgctatttagaaggtgtccagtgtgaggtgcagctggtggagtcgtgggggaggcctggtcaagccgtggggggtccctgagactctcctgtgcagcctntggattcgccttcagcagctattccatgcactgggtccgccaggcctccgaggggaaggggctgggaggtgggtctcatccattagtagtagttctagttactatatcttatgcagcctcgagtggaaggggcctagttcacctatcctcagagaccgacgaccaaagactcaagtttcgtttctagacaaaagttcgaaaccaggaccttaggaacggacgacccgggaaagggaccctaacggggttaccttacgtttttaaacttaccgttaggttacggacggtaacgggtaaggtaacggggttaaacgtaaaacggggtaaccttaaacggttaccgtacggggtaccggttacggtaacggggg

SEQ ID NO: 385372 - DNA, 554 bp, Homo sapiens
  misc_feature: GZ8MTXP02GQP4I.39.60.F05.1.454.CMB.2.raw
  modified_base (443)..(443): a, c, t, g, unknown or other
  modified_base (456)..(456): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgtgcagcctctggattcgccttcagcagctattccatgcactgggtcccgccaggcctccgaggggaaggggctgggaggtgggtctcatccattagtagtagttctagttacattatcttatgcagcctcagtgaacgggccgtattccaccatcctccagacgaccgacgccaaagactcagttgtttacngacaaatgaaacngcctagagacgccgaaggcacggtctactttatactgtgcgaaggagaagggtaactaaaggtacctacgtaccgtagggtaccgtcggtaacggggg

SEQ ID NO: 385373 - DNA, 743 bp, Homo sapiens
  misc_feature: GZ8MTXP02ID0RY.39.60.F05.1.454.CMB.2.raw
  modified_base (260)..(260): a, c, t, g, unknown or other
tcagtcgcactagtcacgaccggtgctcgatttagtacgtcatcagggaaaggggtctgagagaggagccttagccctggattccaaggcctatccacttggtgatcagcactgagcaccgaggattcaccatggaactggggctccgctgggtttcctgttgctatttagaggtgtccagtgtgaggtgcagctggtggagtcgtgggggaggcctggtcaagccgtgggggtccctgagactctcctgtgcagcctcnggatcgccttcagcagctattccatcgctacgtcgggtcccgccgacggcctacccggaaggggaacggggtctaggggtaggtcggggttcctacgtatacccgtaatttacggtaagttacgtttactaaggtttaaccattattcctttaagtcgtacaccgtcctacgaacgttacggaaacggggtccctaagttacccaacccgtattcccgtacccgaaggaaaccggaacccggaaccgacccgtaaaacggaaaccttcggtaaacgttttcggttttaccaggtaaaccgtaaaagtaccgtaaaccgtacgtacccgtaagggaacgaaccgggaccggaaaacgggtacctaccgggttctttaaccgtttaaacgttaccggtgtaccgggtaaccggtaggaaacggggttaacgggtaaaccgttaaacggggacctttaacccggtacggtttaccgggaaccgggg

SEQ ID NO: 385374 - DNA, 589 bp, Homo sapiens
  misc_feature: GZ8MTXP02GKDJT.39.60.F05.1.454.CMB.2.raw
  modified_base (464)..(464): a, c, t, g, unknown or other
  modified_base (529)..(529): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgcttcagcagctattccatgcactggtccgccaggctccgaggggaaggggctggggagtgggtctctactcctattaagtagttacgttactagttacattatcttatgcagtcctacaggtaggaaacgggccgtattaccaaccctatccctacgaagacgaccgacgaccaaagaactcgtaagttgttacncgtaacaaatacgaaacacgcctaggacgagcccgaaggactacggtcttacgtttatacgttgngtacgaggtagtacgggtaacgtaaggtactacgtacgtaggtaccgtcggtaacggggg

SEQ ID NO: 385375 - DNA, 565 bp, Homo sapiens
  misc_feature: GZ8MTXP02IF1OZ.39.60.F05.1.454.CMB.2.raw
  modified_base (437)..(437): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggattcgccttcagcagctattccatgcacgtggtcccgccaggcctccgaggggaagggcgtggagtgggtctcatccattagtagtacgttctagtacatatcttatcgcagtcctagagtgaaacggtccgattcaccgtatcctacagagacgacgacaaagactacgagttntttcgagtacaaatacgaactagaccgtaggacgtacgaccgaggaacacggtcttactttatactgtacgacgagtaggaggtaacgtaaacggtacctacgtaacgtcggtacgtacgtaacgggg

SEQ ID NO: 385376 - DNA, 540 bp, Homo sapiens
  misc_feature: GZ8MTXP02FXSIM.39.60.F05.1.454.CMB.2.raw
  modified_base (301)..(301): a, c, t, g, unknown or other
  modified_base (372)..(372): a, c, t, g, unknown or other
  modified_base (393)..(393): a, c, t, g, unknown or other
  modified_base (422)..(422): a, c, t, g, unknown or other
  modified_base (426)..(426): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctattccatgcacgtgggtccnccaggctccgaggggaaggggctgggagtgggtctcatccattagtagtagttctagttacattatcttangcagctcagtgaggcatcacntctcagacacgacgccaaagactcagttnttcngacaaatagaacagctagagacgccgaagaccgacggtcttctttaaatacgtgtacgacgaagaggtaaggtaacgtaacgactaacctacgaggtaaccgttcgaacggggg

SEQ ID NO: 385377 - DNA, 538 bp, Homo sapiens
  misc_feature: GZ8MTXP02GFE8Y.39.60.F05.1.454.CMB.2.raw
  modified_base (405)..(405): a, c, t, g, unknown or other
tcagtcgcactagtcacgaccggtgctcgatttagtacgtcatcagggaaagggggagagaggagccttagccctggattccaaggcctatccacttggtgatcatcactgagcaccgaggattcaccatggaactggggctccgctgggttttccttgttgctattttagaaggtgtccagtgtgaggtgcagctggtggagtctgggggaggcctgggtcaagcctggggggtccctgagactctcctgtgcagcctctggattcgccttcagcagctatccatgcactcggtccgccaggctccgaggggaaggggctgggagtgggtctcgatccattagtagtagttctagttacatatcttatgcagctcagtgaagggccattcaccatctaccaganacgacgaccaagaactcagttgtttcagcaaatgaacacgcctagacgacgcgaggacacggtctactttatactgtgacgagaggtaggtaactaagggactaccgtaccgtagggaccgtcgtaacggggg

SEQ ID NO: 385378 - DNA, 549 bp, Homo sapiens
  misc_feature: GZ8MTXP02H5F8A.39.60.F05.1.454.CMB.2.raw
  modified_base (390)..(390): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgtgcagcctctggattcgccttcagcagctattccatgcacgtcgggtcccgccgacgggcctccggaggggaaggggcgtgggaggtggggtctcatccattagtagtacgttctagttacatattcttatgcagcctnagtgaacgggcctatcacctatctcagacgacgacaccaaagactcagttctttcagtacaaatgaacagccgtagacgacgccgaggacacggtctactttatactgtcgacgagtagaggtaactaaggactacgtacgtacggacgtacgacgggg

SEQ ID NO: 385379 - DNA, 692 bp, Homo sapiens
  misc_feature: GZ8MTXP02H8GV2.39.60.F05.1.454.CMB.2.raw
  modified_base (538)..(538): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggtttccttgttgctatttagaaggtgtccagtgtgaggtgcagctggtggaggtcgtgggggaggcctggtcaagccgtggggggtccctgagactctcctgtgcagcctctggtacttccgccttcagcagctattccatgcacgtcgggtccgcccagggcctaccggaagggggaacggggcgtaggggaggttcggggtcctcgactaccgtagttagttaggttacgtttaccgttagttacatttaattcgtttatcgtcctacgtcctacgtaggttacgggaaacggggtccctaattacccaactactcctaccgaagacgaaccgaacgacccaaagtacctcgtaagttcgtttaccagtactaaaagtcggaaaccncggacctaggacgtaacggacccggaagggacctaaccgggtcctttagttttaaacgtccgtagtaccgggtacgaacgggttaaggaaacgggttaacgtaacggtaaccttaaccgttaccggtcgggtaaccgtacggggtaaccggggg

SEQ ID NO: 385380 - DNA, 576 bp, Homo sapiens
  misc_feature: GZ8MTXP02ILSWY.39.60.F05.1.454.CMB.2.raw
  modified_base (296)..(296): a, c, t, g, unknown or other
  modified_base (448)..(448): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggtttcctgttgctatttagaggtgtccagtgtgaggtgcagctgggtggagtcgtggggggaggcctggtcaagccgtggggggtccctgagactctcctgtgcagcctctggattcgccttcagcagctatccatgcactggtccncaggctccgaggggagggctgggagtgggtctcatccattagtagtacgttctagttacattatcttatgcagcctcagtgagggccattccacctatctcagacgaccgacgccaaagactcaagttgtttcagaccaaatcggaaaaccncgacgtaggacgacggaccggaaggaccgtacggtctttactttagtacgttggacggacgtaaggaacggtaacggggttaaacgtaacggtaccttacgtaccgtacggtacggtacggtacgggg

SEQ ID NO: 385381 - DNA, 555 bp, Homo sapiens
  misc_feature: GZ8MTXP02FMSGF.39.60.F05.1.454.CMB.2.raw
  modified_base (448)..(448): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctggagactctcctgtgcagcctctggattcgccttcagcagctattccatgcactgggtccgccaggcctccgaggggaaggggctgggagtgggtctcatccattagtagtagttctagttacatatcttatgcagctcagtagagggccattcacctatctcagacgacgacgccaagaactcagttgttactgacaaagtgaaacngcctaggacgacgccggagacgacggtacttcgtttattacgtgtacgacgtaagagtaacgggtaacgtaacggacgttacctaccggtcggacgtcggtacgggg

SEQ ID NO: 385382 - DNA, 613 bp, Homo sapiens
  misc_feature: GZ8MTXP02JJ3VL.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctattccatgcacgtcgggtccgccgaggcctccggaggggaacggggcgtgggaggtgggtctcgactcctattagtagtacgtttactagttacatatcttatgcagtcctagagtaggaacgggcgtattccaccatctaccagacgaccgacgaccaagactcgtagttctttcagaacaaatacgaaacacgccgtaggaacgacggacccggaagggaccctacgggtacctttacgtttaacttaccgtggtacggacgtaaggaacggtaacgggggtaactaaacgggtacctaaccgtacgtacgggtacgtcggtaacggggg

SEQ ID NO: 385383 - DNA, 703 bp, Homo sapiens
  misc_feature: GZ8MTXP02H3HXM.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggaggtcgtgggggaggcctgggtcaaggccgtggggggtccctgagactctcctgtgcagcctctggtattcgccttcagcagctattccatgcacgtcgggtccgccgagggcctaccggagggggaacggggcgtggggaggtggggtcctcgatccgtagttaggtagttacgttcttaagttacattattcttatcgactacgtcccttacgaggttacgggaaacgggtcccgtaatttccaacctattccctacccgaaggacgaaccgaccgaacccaaacggtacctcgtaaggtttcgttttaccgaggtaacctaaaaagtcggaaaactgggtaccctaggaacggacggacccggaagggacctaaccgggtctttaacgttttaacgtacgtcggttaggaccggaacggtagggtaacgggggttaaacctaaaacggggtaaccttaacggttacccggtacgggtaaccggtttcggaaccgggggg

SEQ ID NO: 385384 - DNA, 782 bp, Homo sapiens
  misc_feature: GZ8MTXP02FS2N9.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctattccatgcacgtggtcccgccgaggcctccgaggggaacggggctggggaggttggggtcctcgtactccgtatttacggtagttacgtttactagtttacattattcctttaatcgacacggtcctacgagggttacgggaaacggggtcccgtaatttacccgaacctacttaccgtacccgaaggaaacggaacccggaacccgaacccgaaaaggtaaacctaccgtaaagggtttcgtttaccgtagaaccgtaaaaagttaccgggaaaacaccgggtacccgtaagggacggtaaaccggacccggggtaaagggaaccccgtaaccggggttacccttttacccggtttttaaaatttacccggtggttacgggacccgggtaaaacggtaaggggtaaaacgggggtttaaacctaaaacgggggtaaccctttaaaacccggttacccggttacgggggtaacccgtttaccggggttaaaccggggggg

SEQ ID NO: 385385 - DNA, 584 bp, Homo sapiens
  misc_feature: GZ8MTXP02FS208.39.60.F05.1.454.CMB.2.raw
  modified_base (429)..(429): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttcctgttgctatttagaaggtgtccagtgtgaggtgcagctggtggagtcgtgggggaggcctggtcaagccgtggggggtccctgagactctcctgtgcagcctctggattcgccttcagcagctattccatgcactgggtccgccaggctccgaggggaaggggctggaggtgggtctcgatccattagtagtacgttctagttacatatcttatgcagcctcagtggaacgggcctattcaccactctacgagagaccgacgaccaaagactnacgttgttctagactaaagtacgaacagtcccgaggacgaacggccgaagggactaccggtctttacgttttaatacgtgtaggtacggaagtaggtaacggggtaacgtaaacggtaactaccgtaccgtacgggtaccggtcggtaacggggg

SEQ ID NO: 385386 - DNA, 640 bp, Homo sapiens
  misc_feature: GZ8MTXP02GQ70Y.39.60.F05.1.454.CMB.2.raw
  modified_base (467)..(467): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctattccatgcacgtggtccgccaggcctccgaggggaagggctggagtgggtctcatccatagtagtacgttctagttacattatcttatcgtcacgtcctcgaggtagaaacggggccctaagttccaaccctagtcctaccgaagacgacgacgacccaaaggtacctctaaggttcgtttaccnggtaaccaaaattcggaaaccacggcccgttaggacggtaacggcccggtaaacggacgtaccggtaccgttacttttaataccgttggtacgaccggtaggaacggtaacggggttaacgtaaacgggtaccttaaacggtacccgtaggaaccggttcggtaaacgggggg

SEQ ID NO: 385387 - DNA, 606 bp, Homo sapiens
  misc_feature: GZ8MTXP02GFSUK.39.60.F05.1.454.CMB.2.raw
  modified_base (265)..(265): a, c, t, g, unknown or other
  modified_base (388)..(388): a, c, t, g, unknown or other
  modified_base (424)..(424): a, c, t, g, unknown or other
  modified_base (520)..(520): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtggggggaggcctgggtcaaggccgtggggggtccctggagactctcctgtgcagcctntggattcgccttcagcagctattcccatgccacgtgggtcccgccaggcctaccgaggggaaggggctggggagtgggtctcgatccattagtagtacgttctagttacattatcttatgcanccttcgagtcggaaacgggcctattccacccatccnccaagacgacgacgaccaaagactcagttcttctagaactaaatacgaaacacgtaccaggaacgacgccggaagaccacgggtacttacgtttanacgttgtacgacggtaaggacggtaacggtaacgtaaaacggggccttaaacgtacccggtagggtaccgttcggtaaaccggggg

SEQ ID NO: 385388 - DNA, 729 bp, Homo sapiens
  misc_feature: GZ8MTXP02HXLVR.39.60.F05.1.454.CMB.2.raw
  modified_base (260)..(260): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtggggggtccctgagactctcctgtgcagcctntggattcgccttcagcagctattcccatgacacgtcgggtccgccgaggtcctaccgaggggaacggggcgtgggaggtggggtctcatccgtagttagtagttacgttctaagttacaattagttcttaatgactacgcctacaaggttacggaaacggggtccctaaatttcccgaaacctacttacccgtacccgaaggaaacggaaccgaaccgaccccgaaaaagggtaaccttcgaaaggtttcgttttaccaaggaacctaaaaattcgggaaaacctagacccgttaggaaaccgacggacccggttaaggaaacccacgggttacctttaacgttttacgtaccgtacggttaggacccggtaaagtaaccggggtaaggggtttaaaaccaaaacgggggttacccttaaaccgtaacccgggtttacgggggtaacctttaacccggggaacgggggg

SEQ ID NO: 385389 - DNA, 538 bp, Homo sapiens
  misc_feature: GZ8MTXP02JC05X.39.60.F05.1.454.CMB.2.raw
  modified_base (369)..(369): a, c, t, g, unknown or other
  modified_base (377)..(377): a, c, t, g, unknown or other
  modified_base (422)..(422): a, c, t, g, unknown or other
tcagtcgcactagtcacgaccggtgctcgatttagtacgtcatcagggaaaggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgtgcagcctctggattcgcttcagcagctattccatgcactcgggtccgccaggctccgaggggaaggggctgggagtggggtctcatccattagtagtagttctagttacatatcttangcagctcngtgaggccatcacatctcagagacgacaccaagactcagtgttcngactaaatcgaacagcctagacgacgccgaaggtacacggcttacgtttattacgtgtagcgaacgagtagggtaaccgtaaggaactacgtaccgtcggacggtacgtacggggg

SEQ ID NO: 385390 - DNA, 611 bp, Homo sapiens
  misc_feature: GZ8MTXP02HK8M1.39.60.F05.1.454.CMB.2.raw
  modified_base (368)..(368): a, c, t, g, unknown or other
  modified_base (372)..(372): a, c, t, g, unknown or other
  modified_base (515)..(515): a, c, t, g, unknown or other
tcagtcgcactagtcacgaccggtgctcgatttagtacgtcatcagggaaagggggagagaggagccttagccctggattccaaggcctatccacttggtgatcagcactaagcaccgaggattcaccatggaactggggctccgctgggttttccttgttgctattttagaaggtgtccagtgtgaggtgcagctggtggagtcgtgggggaggccgtggtcaagccgtgggggtccctgagactctcctgtgcagcctctggacttcgccttcagcagctatccatgcacgtggtcccgcaggcctcgaggggagggctgggagtggtctcatccagttagtagtagttcctagtacatatcttangcancctcagtggacggcctattcccactactctacgagacgacgaccgacaaagactacgagttcgtttcagactaaaatcgaaacgacgccgtaggagaaccgccggaaaggacctacgggtaccttttatttaacgtttaccgnggtacggtaacggaagggtaacgggtaacggttaaactaaacgggttacctaacccggttacggacggtaaccggtacgggtaacggggaaaccgg

SEQ ID NO: 385391 - DNA, 599 bp, Homo sapiens
  misc_feature: GZ8MTXP02HGZUU.39.60.F05.1.454.CMB.2.raw
  modified_base (275)..(275): a, c, t, g, unknown or other
  modified_base (454)..(454): a, c, t, g, unknown or other
  modified_base (472)..(472): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggcggagtcgtgggggaggcctggtcaagccgtggggggtccctgagactctcctgtgcagcctctggacttcgccttnagcagctattccatgcacgtgggtccgccgaggcctaccgaggggaaggggctgggaggtgggtctcatcctagttagtagtacgttctagttacatatcttatgcagcctcgagtggaagggcctaattccaccctatcctccaagacgaccgacgaccaaagactcagttgtttacngaactaaagtcgaaaccncgacgtagaacgacgaccggaacgtaccacggttacttacgtttacgtacgtgtacggacgtaggtaacggtaacggtaacgtaacggtaccttaacgtaccggtacggtaccggtacggtacgggg

SEQ ID NO: 385392 - DNA, 590 bp, Homo sapiens
  misc_feature: GZ8MTXP02FYZMG.39.60.F05.1.454.CMB.2.raw
  modified_base (308)..(308): a, c, t, g, unknown or other
  modified_base (453)..(453): a, c, t, g, unknown or other
  modified_base (470)..(470): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctgggtggagtcgtgggggaggcctgggtcaagccgtggggggtccctggagactctcctgtgcagcctcgtggattcgccttcagcagctattcccatgccacgtcgggtccnccaggcctaccgaggggaacggggctgggagtgggtctcatccatttagtagtacgttctagttacattatcttatgcagtcctgagtgaacgggctattcaccatcctacagacgacgaccgcaaagtactctagttctttcanactaaatgaaacagccngaagacgaccgagacctcggtcttactttactactggcgtacgaaggtaggaaacggggttaaactaaacggggtacctaaccgttaccggtacggggtaacccgtcggggtaaccgggg

SEQ ID NO: 385393 - DNA, 638 bp, Homo sapiens
  misc_feature: GZ8MTXP02FPXO4.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctattccatgcacgtgggtccgccgaggcctccgaggggaggggcgtgggagtgggtctcatccattagtagtacgttctagttacattatcttatgctacgtcctcgaggtggaaacgggggtccctaatttcccaaacctatcctacccgaagacgaccgacgacccaagaaacctcgtagttcgtttccaggactaaaagtcgtaaacacggcctaggaggtaacgccgggaaggacccgacggtcctttactttaagttaccgtaggttccgacggtacggaagggttaacggggtaaccgtaaaacgggtaccctaaaccgtccggtacggggtaaccgtcgggtaaccggggg

SEQ ID NO: 385394 - DNA, 620 bp, Homo sapiens
  misc_feature: GZ8MTXP02HGS0F.39.60.F05.1.454.CMB.2.raw
  modified_base (264)..(264): a, c, t, g, unknown or other
  modified_base (308)..(308): a, c, t, g, unknown or other
  modified_base (398)..(398): a, c, t, g, unknown or other
  modified_base (498)..(498): a, c, t, g, unknown or other
  modified_base (515)..(515): a, c, t, g, unknown or other
  modified_base (566)..(566): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggaggcctggtcaaggccgtggggggtccctgacgactctcctgtgcagcctntggattcgccttcagcagctacttccatcgcacgtcgggtcccnccgaggcctaccggaggggaaggggcgtaggggaggtcgggtctcgatcctagttagtagttacgttcgtaagtttacacttattcttancgtacacgtccctagagggtaggaaacggggtcctacgtttacaccctattcccacgaagacgaccgacgtaacccaaagtacctcgtaagttcgttacnggaactaagtgaaaccngtccaggacgtacgcgaagccacggtcttattattacgtgcgacggaacgnggtaaacgggtaactaacggacttaccgtacgcggtaacggtcggtaacggggg

SEQ ID NO: 385395 - DNA, 578 bp, Homo sapiens
  misc_feature: GZ8MTXP02H06BK.39.60.F05.1.454.CMB.2.raw
  modified_base (301)..(301): a, c, t, g, unknown or other
  modified_base (377)..(377): a, c, t, g, unknown or other
  modified_base (411)..(411): a, c, t, g, unknown or other
  modified_base (472)..(472): a, c, t, g, unknown or other
  modified_base (478)..(478): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctgggtggagtcgtggggggaggcctggtcaagccgtggggggtccctgagactctcctgtgcagcctctggattcgccttcagcagctattccatgcactggtccncaggctccgaggggaaggctggagtgggtctcatccattagtatagttctagtacattatcttatgtcacgtcctnaagtggaaacgggtcccgtattcaaccctatccnccgaagaagaccgaacacccaaaagacctgaagttgtttacctgaactaaaatggaaaacncgacgngagacgacgacgacgacgtacttacttactacgtgtacgacgacggaaggaaggtaacggtaacgtaacgtaccgtacgtacggtacggtacggtacggg

SEQ ID NO: 385396 - DNA, 722 bp, Homo sapiens
  misc_feature: GZ8MTXP02HO2PQ.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctcgtggtattccgccttcagcacgtctattcccatgactacgtcggtcccgcgacggcctccggaaggggaggcgtagggaggtcgggtctcgactctattacgtagtacgttatagttactatattcttatcgcacgtcctcgtagtagggaaacgggtcccgtattacccgaaccctatacccgtaccgaaggaacgaaccgacccgaaccgaaaacgtacgttactaaggggtttcttttaccgaggtaaacctaaattaccggaaaacgtacgacccggtagaagggacccggtaacccgaaaggggtaccgtaaccggtttacctttacgttttaacgttaccgttacggttacgaacggggaaggtaaacggggtaaacggggttaaaccgtaaacggggtaacccttaccggttaacccgggaggggttaacccggtttacgggtaaaccgggggg

SEQ ID NO: 385397 - DNA, 536 bp, Homo sapiens
  misc_feature: GZ8MTXP02GJFZ9.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcgccttcagcagctattccatgcactgggtccgccaggctccgaggggaaggggctgggagtggggtctcatccattagtagtagttctagttacatatcttatgcagcctcagtgaagggccgattcaccatctccagagacgacgaccaaagacctcagttgtttctgacaaatgaacagcctagagacgccggaggacacggcttctttattacgtgtcgcgaggagaggtaacgtaaggactacgaccgtggaccgtcgtacggggg

SEQ ID NO: 385398 - DNA, 547 bp, Homo sapiens
  misc_feature: GZ8MTXP02IJJ62.39.60.F05.1.454.CMB.2.raw
  modified_base (389)..(389): a, c, t, g, unknown or other
  modified_base (434)..(434): a, c, t, g, unknown or other
  modified_base (442)..(442): a, c, t, g, unknown or other
  modified_base (451)..(451): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagccctctggattcgccttcagcagctattcccatcgcacgtcgggtccgccaggcctccgaggggaaggggctgggagtgggtctcatcctattaggtagttagttctagttactatattcttatgcagcctnagtgaggccgattcactatctcagagacgacacaaagactcagtntttcaganaaatgaacngcctgagcggaccgaggacacgggtcttctttatacgtgacgtacgacgtaggagtaacgtaagacctactaccgtcggacggttcggaacggggg

SEQ ID NO: 385399 - DNA, 682 bp, Homo sapiens
  misc_feature: GZ8MTXP02IEAGB.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtggggggtccctgagactctcctgtgcagcctcgtggacttcgccttcagcagctattccatcgcacgtcgggtccgccgagggcctccggaaggggaacggggcgtagggaggttcggggtctcgactcctaagttagtagttacgttactaagttacattatcttatcgactagccctagacgtagaaacgggtcccgtaatttccgaaacccttatccctaccgaagaacgaccgaaccgaacccgaaacgtactaccgtaggtttcgtttacaggtaacctaaaagtacgaaacctagacccgtaggacgaacggaccggaaggaaccgaccggtctttaccgtttttagtaaccgttggacggtaccgaaggtaaacggtaacggggttaaactaaacgggtacccttaaccgtaaccgtacggggtaaccgtttacgggaaaccggggg

SEQ ID NO: 385400 - DNA, 703 bp, Homo sapiens
  misc_feature: GZ8MTXP02HONE0.39.60.F05.1.454.CMB.2.raw
  modified_base (259)..(259): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggtttccttgttgctatttagaaggtgtccagtgtgaggtgcagctggtggagtcgtgggggaggcctggtcaagccgtggggggtccctgagactctcctgtgcagcctntggattcgccttcagcagctatccatgcacgtcgggtccgccgaggcctaccgaggggaagggcgtagggagtgggtctcgatccgtatagtagtacgttctaagttacatattcttatgacagtcctacgagtgaaacggggtccatttccaaacccgtattcccacccgaaagggtaacacccggggaaccaaccgaaaacgggtacccttaggacggttttacgttttcccgagggaaacctaaaaagttcggaaaacccgcggtaccgtaagggaacggtaaccggaacccgggaacgtaaccggtacggtttcctttaacgttttaaccgtcggtacggggtacgacgggtaaaggaaacggggtaaaccgggttaaacgtaaaaccgggtaccttaaccggtaccggtacggggtaaccggttacggggtaaacgggg

SEQ ID NO: 385401 - DNA, 597 bp, Homo sapiens
  misc_feature: GZ8MTXP02JB1B4.39.60.F05.1.454.CMB.2.raw
  modified_base (420)..(420): a, c, t, g, unknown or other
  modified_base (449)..(449): a, c, t, g, unknown or other
  modified_base (539)..(539): a, c, t, g, unknown or other
  modified_base (563)..(563): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcacgcctctggattcgccttcagcagctacttccatcgcacgtcggtccgccacggctcggaggggaaggggcgtggaggtgggtctcactcctagttagtagtacgttactagttactattatcttatgctagcctacgagtggaacggggcctactcaaccctntcctccgaagacgaccgaccgaccgaaanacctcgtagttacgtttcagtaacaaagtcgaaaacgtcgtaccgtagaacggacgaccggaggaccacggtcttttactttagttacgngtacgcgaaggtgtaacgggtaanaacggacttacgacgtacggacgttggaacgggg

SEQ ID NO: 385402 - DNA, 869 bp, Homo sapiens
  misc_feature: GZ8MTXP02HUN5A.39.60.F05.1.454.CMB.2.raw
  modified_base (261)..(261): a, c, t, g, unknown or other
tcagtcgcactagtcacgaccggtgctcgatttagtacgtcatcagggaaaggggtctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtcctgagctctcctgtgcagcctntggattcgccttcagcagctattccatcgctacgtcgggtcccgccgacggcctacccggaagggggaacggggtccgtaggggtacgggtcggggttcctacgtaaccgtaccgtaagttttaagggttaaggtttacgttttaccgttaacggttttaacctaatttaacttccttttaagttcgacctaccggttaccctacggtaaagggttacggggaaacgggggtacccgttaactttacccgaaacccctattaccccgttacccgaaacgggaacgaacccgggaacccgtaaacccgaaaacggtaaacccttccggttaaaggttttccggttttttaaccgacgggtaaaccctaaaagttaccggaaaacccgtaccgggtaacccgttaggggaaaccggtaacggggaaccccggtaacggggaaacccggtacccggggtttacccttttaaaccgtttttaaacgtttaaacggttcgggtaacgtaccggggttaaaagggaacggggtttaaaacgggggtaaaacccggttaaaacggtaaccccggtttaaacccgtaacccggtttacgggggttaaaaccccggg

SEQ ID NO: 385403 - DNA, 546 bp, Homo sapiens
  misc_feature: GZ8MTXP02FGO4V.39.60.F05.1.454.CMB.2.raw
  modified_base (423)..(423): a, c, t, g, unknown or other
  modified_base (431)..(431): a, c, t, g, unknown or other
  modified_base (443)..(443): a, c, t, g, unknown or other
  modified_base (481)..(481): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcgccttcagcagctattccatgcactgggtccgccaggctccgaggggaaggggctgggagtgggtctcgatccattagtagtagttctagtacatatcttatgcagcctcagtgaacgggccattcaaccatcctcagacgacgacgacaagaactnagtgttcngacaaatgaacngcctgagcgccgaggtacacggtcttactttattacgngtcgcgaagaggtaacgggtaactaaagggacctaaccgtaccgtaggaccgtcggtaacggggg

SEQ ID NO: 385404 - DNA, 668 bp, Homo sapiens
  misc_feature: GZ8MTXP02IAYUV.39.60.F05.1.454.CMB.2.raw
  modified_base (274)..(274): a, c, t, g, unknown or other
  modified_base (614)..(614): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactgggctccgctgggtttcctgttgctatttagaaggtgtccagtgtgaggtgcagctggtggagtcgtgggggaggcctggtcaaggccgtggggggtccctgagactctcctgtgcacgcctcgtggacttcgccttnagcagctacttccatgcacgtcgggtccgccaggcctccggaggggaaggggctggggagtgggtctcactccgtagttagtagtacgttcgtagttacagttattcttatcgtactacgtcccttacgtaaggtcgggaaacgggtcccgtactttacccgaacctacttaccctaccgaacggacggaacccggaacccgaacccgaaaacggtacccgttacgtaaacggttttcgttttaccgtaggtaacctaaaagttacgggaaacctacggtacccgtaggaacggacgacccggaaggaccgtaaccggtcttacgttttataccgttggngtacgagtaacggaggtaacaggtactacgtacgtcggaccgttacggacgggg

SEQ ID NO: 385405 - DNA, 724 bp, Homo sapiens
  misc_feature: GZ8MTXP02GAGVC.39.60.F05.1.454.CMB.2.raw
  modified_base (305)..(305): a, c, t, g, unknown or other
  modified_base (470)..(470): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggaggcctggtcaagccgtgggggtcctgagctctcctgtgcacgcctcgtggacttccgtccttcagcagctatccatcgcacgtcgggtccncgaggcctaccggaggggacggggcgtgggtacggtcgggtctacgtactccgtaagtttacggttaagttacgtttacttaagtttactaatttacttactttaagtcgacctacggtcccttacgaggtacgggaacgggggacccttattacccgaaccctntaccctaccgaaaggacgaccgaaccgaccgaaacggtaactcgtaaggtttcgtttacgaggtaaacctaaagttacggaaaaccgtacggtacccgtagggaacggaccggacccgggaacggaaccgtacgggttacctttacgtttttaaacgtacgttgggtacggacggtaaggacgggttaaagggtaaaccgtaaacggtaaccttaaccggtaccggttacgggaccggtttacggaaccggggg

SEQ ID NO: 385406 - DNA, 569 bp, Homo sapiens
  misc_feature: GZ8MTXP02IM6FE.39.60.F05.1.454.CMB.2.raw
  modified_base (273)..(273): a, c, t, g, unknown or other
  modified_base (374)..(374): a, c, t, g, unknown or other
  modified_base (377)..(377): a, c, t, g, unknown or other
  modified_base (383)..(383): a, c, t, g, unknown or other
  modified_base (406)..(406): a, c, t, g, unknown or other
  modified_base (457)..(457): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagctctggattcgccttcngcagctatccatgcacgtggtccgccgaggcctccgaggggaggggcgtgggagtgggtctcatcctattagtagttacgttactagttacattatcttancgnagcctnagtgaacgggcattcactatccncagacgacgacaccgaaacgactctagttcgtttcagacaaagtgaaaccngccgtaggagacgaccgagacgacggtcttactttatacgtgtacgcgtaacggacggtaaggtaacgtaacgggaccttaacgtaccggtacggtacgttcgtaacggggg

SEQ ID NO: 385407 - DNA, 651 bp, Homo sapiens
  misc_feature: GZ8MTXP02GMNSM.39.60.F05.1.454.CMB.2.raw
  modified_base (517)..(517): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctcgtggacttcgccttcagcagctattccatcgcacgtcggggtccccgccgacgggccgtaccggaagggggaacgggggcgtaggggtaggttcggggtcctcacgtcctaagttaggttagttacgtttcttaagttacaattattcttatcgcacgtcctacgtaggtacgggaaacggggtccctaaattcccgaacctactcctaccgaagacgaccgacgaaccaaagacctctagttcttacacgtaaanaaagtagaacacggctaggacgacgaccggagacgtacgtctttacgtttactacgttgaggacgtaaaggacggtaacgggtaaactaacgggaaccttaccggtaccggaggtacccggtagggaacggggg

SEQ ID NO: 385408 - DNA, 683 bp, Homo sapiens
  misc_feature: GZ8MTXP02I52LS.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcagccgtgggggtccctgagactctcctgtgcagcctctggattcgccttcgagcagctattccatcgcacgtcgggtccgccaggctccgaggggaggggctgggagtcgggtctcgatcctattaggtagttacgttctagttacattattcttaatggactacgtcctcgaaggttcggaaagggtcccgtaattccgaaccctatccgtacccgaagacgaccgaaccgaccgaaaacggtaacctccgtaaagtttcgttttaccgacggtaacctaaaagttacggaaaccttacggccctagggaaccgacgacccggaggtaccgacgggttacttacgtttttaactaccggtaggttacggaacggtaacgggtaaggtaaacggggttaacgtaaaacgggtacctttaaaaccgtcggtttacggaaccggtttacgggtaaacccggggg

SEQ ID NO: 385409 - DNA, 607 bp, Homo sapiens
  misc_feature: GZ8MTXP02G9WQ7.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctattccatgcacgtgggtccgccaggcctaccgaggggaaggggctgggagtgggtctcatccattagtagtacgttctagtacatatcttatgcagcctcagtgaacgggccattccaacctatctaccagacgaccgacgacccaaagaacctcgtaagttgtttacaggtacaaaagttgaaaccagacctaggaagacggacccggaagggaccaacgggtacctttacgttttaacttacgtggttacgacgggaagaaggtaaaggggtaaccgtaaaaggacccttaacgtaccgtaggggtaaccggtcgtaacggggg

SEQ ID NO: 385410 - DNA, 733 bp, Homo sapiens
  misc_feature: GZ8MTXP02I1CF7.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctctgtgcagctctgattcgcttcagcagctattccatcgcacgtcgggtcccgccgagggtccgtaccgagggggaacggggtcgtaggggaggttcggggtaccttcgtaacgttaccctaagtttaaggttagttacggtttcgttaaacgtttaaccaatttaattacctttaatcggtacctaacgtacccgttaccgtaaggggtaacgggtaaacgggggtacccgttaacgttaccctaacccttaataccccgttacccgaagggtaaccgacccggaaccgacccgaaaacggttaactccggtaaagtttcgtttttaccgacggtactaaaacgtcgtaaaaccacgtacctaggacgacggaccgtaaggacgtacggtctttacgtttacttacgtggtcggacgtaaggaggtaacggggtaacgtaaacgtacgttaacccgtcgtacgggtaccgtacgggtaaccggggg

SEQ ID NO: 385411 - DNA, 650 bp, Homo sapiens
  misc_feature: GZ8MTXP02HIUTE.39.60.F05.1.454.CMB.2.raw
  modified_base (279)..(279): a, c, t, g, unknown or other
  modified_base (308)..(308): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctcgctgggttttccttgttgctattttagaaggtgtccagtgtgaggtgcagctggtggagtcgtgggggaggcctggtcaaggccgtggggggtccctggacgactctcctgtgcacgcctgtggtacttcgccttnagcagctatccatcgcacgtcgggtcccnccgaacggtccgtaccggaaggggaacggggccgtaggggagggttcgggtctacgataccgtaagttaggtagttagtttcttaacgttacatttattcttaactggtacacggtcccttgaagtaggggaaacggcccgtaattccaacctattccacgagacgaccgaccgacaaagactcgtagttcgtttacagtaacaaagtacgaacgtacgctagaagcggaccgagacgacggttcttacgttttactacgtgtacgacgtaggtaacggtaacggtaacgtaaaacggtaaccttaccggtaacgtcgggtaacggtttcggaaaccggggg

SEQ ID NO: 385412 - DNA, 675 bp, Homo sapiens
  misc_feature: GZ8MTXP02FL7CG.39.60.F05.1.454.CMB.2.raw
  modified_base (536)..(536): a, c, t, g, unknown or other
  modified_base (592)..(592): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctatccatgctacgtcgggtcccgccgaggcctaccggaaggggaacggggcgtggggaggttcgggtctccgtacttccgtaagtttacggtagttaaccgtttcttaacgttactaattaattccttaattggacctacgccttacgaggttacggacgggtacctattacccaacctactcctaccgaagacgaccggaacaccgtaaaagaacctgtaacgtttcgtttacgacgaactaaactacggaaacnccgtacgtaggaacgacgtccggaaggaactccggtactttaccgtttaagtacgnggttacgaccgtaaaggaacggtaacggtaaacgtaacggtaaacctaccggttacgacggggtaaccgttcggaaacggggg

SEQ ID NO: 385413 - DNA, 658 bp, Homo sapiens
  misc_feature: GZ8MTXP02IFGX7.39.60.F05.1.454.CMB.2.raw
  modified_base (278)..(278): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggtttccttgttgctatttagaaggtgtccagtgtgaggtgcagctggtggaggtcgtggggggagcctggtcaagccgtggggggtccctgacgactctcctgtgcacgcctcgtggtacttcgccttnagcagtctacttccatcgctacgtcgggtccgccgaggccgtaccggagggggaacggggcgtggggaggttgggtctctacgtacctaagtttacggtagttacgttacttagttaacattacttacttagtcgcctacgtcctacgaggtacgggaaacgggcctaacttccaacttatccgtaccgaagtaccgaaccgaccaaccgtaaaacgtacgttcaagtttcggttaccaggtaaacctaaagtacgaaacgtcgtaccgtaggacgaacggaccggaggacccgtaacggtctttacgtttatacgttgacgacgaggtaggtaacggtaacgaacggtactacgtacgtcggacggttacggaacgggg

SEQ ID NO: 385414 - DNA, 627 bp, Homo sapiens
  misc_feature: GZ8MTXP02HAEVY.39.60.F05.1.454.CMB.2.raw
  modified_base (385)..(385): a, c, t, g, unknown or other
  modified_base (458)..(458): a, c, t, g, unknown or other
  modified_base (468)..(468): a, c, t, g, unknown or other
  modified_base (474)..(474): a, c, t, g, unknown or other
  modified_base (491)..(491): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggccgtggtcaagccgtggggggtccctggagactctcctgtgcagcctctggattcgccttcagcagtctattccatcgcacgtcgggtcccgccacgggcctccgaggggaagggctgggaggtcgggtctcatccattaggtagtacgttctagttacattactacttntgctacgcctactaggtacggacgggcctattccgacccaatcctaccagtacgaccgacgaccaaagtaacncgtaaggttnttacgngtaacaaagtgaaacgngaccgttagaacgacggccggaaggactaccggggttacttacgttttagtaacctgggtacggaccgaaggtacgtaaagggtaacgtaaaacgggacctaaacggtcccgtagggtaccggtacgtaacggggg

SEQ ID NO: 385415 - DNA, 564 bp, Homo sapiens
  misc_feature: GZ8MTXP02FFP7C.39.60.F05.1.454.CMB.2.raw
  modified_base (388)..(388): a, c, t, g, unknown or other
  modified_base (453)..(453): a, c, t, g, unknown or other
  modified_base (468)..(468): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcgccttcagcagctatccatgcacgtgggtccgccaggcctaccggaggggaacggggcgtgggacggtggggtcctcgtaatccgaatttacggtagtacgttctagtacattatcttangcagctcgagtgaagggccattccactatcacagacgacgacgaccaagaactcagttctttacngaacaaatacgaacngccgtagagcgacgagacacggtctttacttaatacgtgtacgcgaagacggaaggtaacaaaggtacctaacgtccgaggacgttcggaacgggg

SEQ ID NO: 385416 - DNA, 678 bp, Homo sapiens
  misc_feature: GZ8MTXP02JMNKQ.39.60.F05.1.454.CMB.2.raw
  modified_base (280)..(280): a, c, t, g, unknown or other
  modified_base (374)..(374): a, c, t, g, unknown or other
  modified_base (440)..(440): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaaggccgtggggggtccctgagactctcctgtgcagcctctggattcgccttcagcngctactccatcgcacgtcgggtccgccgaggcctaccggaggggaaggggctaggggaggttcgggtctcgactccatttaggtagttacgttntacgttacattatcttagtcgctacgcctacgaggtaggaacgggtcccgtaattccaaaccctancctaccgagagacccgaacgacctaaacgaaccttcgtacgttagtttccgacgtaactaaagttacgaaaccgcggtaccgtagacggtacggacccgaaggtaccgaaccccgggtacttaaacgttacgttaagttcggtacggtaaccggtaaaggttgggggtaacggggggtaacggttacgggggactttaccggttaccgtcgggggtttaaccggttttcggtaaccgg

SEQ ID NO: 385417 - DNA, 703 bp, Homo sapiens
  misc_feature: GZ8MTXP02F0GHO.39.60.F05.1.454.CMB.2.raw
  modified_base (274)..(274): a, c, t, g, unknown or other
  modified_base (342)..(342): a, c, t, g, unknown or other
  modified_base (378)..(378): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtcctgagactctcctgtgcagcctcgtggattcgccttnagcagctattccatcgctacgtgggtcccgcgaggcctccggaggggaaggggctgggaggtgggtcncatccattagtagtacgttctagtacattatcttangcagtcctacagtggaaacgggccgtaattccaacctactcctaccaagaacgaccgtaaccgacccgaaagtaaacctcgtaaacggtttcgttttaccgaggtaacctaaaaggttacggaaaacctacggacccgttaggaacgtacggacccggaaagggaccgtaccgggtcctttaacgttttacgttaaccgttcggttacggaccggggttaaaggacggggttaaaacgggggttaaaaccttaaaacgggggtaaaccctttaaaccggttaaccggttacggggtaacccggtttacggggttaaaccgggggg

SEQ ID NO: 385418 - DNA, 642 bp, Homo sapiens
  misc_feature: GZ8MTXP02FKLVZ.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctggggagcctggtcaagccgtgggggtccctgagactctcctgtgcagcctctggattccgccttcagcagctatccatcgcacgtggtcccgccaggtcctaccggaggggtaacggggccttagggacggtcgggtctcgaacttccctaagtttacggttagtaccgtttccgtagttactattcttacttagtcgaccacggtccctacgtagtaggaaaccgggtcctagtttaccaccctagtaccctaccgagtaacaccggaacgtacccaagtacctcgtacgttgttacctcgaacaaacttacgaacctacgtcctaggacgacggaccggaacggtacacggtccttacgtttatacgtgtcgacgtaggacgtacggtaacgtaacggacctacgtaccgtcggtaaccgtcggtaaccggggg

SEQ ID NO: 385419 - DNA, 767 bp, Homo sapiens
  misc_feature: GZ8MTXP02JELMS.39.60.F05.1.454.CMB.2.raw
  modified_base (258)..(258): a, c, t, g, unknown or other
  modified_base (422)..(422): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagcgtggtggagtcgtgggggaggcctggtcaagccggtgggggtccctgacgactctcctgtgcncgcctctggtacttccgccttcagcacgtctacttcccgatcgctacgtcgggtaccgccgacggtccgtaccggaagggggaacggggtcgtggggtaggttcgggtccgtactacgtactagttacgttagttacgttacgtaagttactagttactcttangtactacggtcctacgtagggtaacgaacggggtcctaacgtttacccaccgtaaaccgttccgaacccgaagtaaccggaaccggtaaacccggaccctaaaacgggtaaccttaccgttaaggttttacggtttacttacgtaaacgttaaaaccgtagggttaaaacccgacgttaccccggtaggaacggtaccgggacccgggtaaacggaacgtacccgttaagtttacccgttttaaaagtaccggtggttaccggaaccgggtaagaaacggggttacgggtaaaacctaaggggaaccttaccgtacggtacggtaccggtttagggaaccggggg

SEQ ID NO: 385420 - DNA, 776 bp, Homo sapiens
  misc_feature: GZ8MTXP02I9ZGU.39.60.F05.1.454.CMB.2.raw
  modified_base (271)..(271): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttctgttgctattttagaggtgtccagtgtgaggtgcagctggtggagtcgtgggggaggcctggtcaagccgtggggggtccctgagactctcctgtgcagcctctggattcgcttcngcagctattccatgctacgtcggtcccgccaggcctccggaaggggtaacggggcctaggggacggtcggggtcctcgtactccgtaagttacgtagttacgtttaccttaaggttacaagtttattacctttaagtcgtacctaacggccttaccgagggttaggaaacggggtacccgttaattcccgaacccgtattaccgacccaagggtaaacgaaccccggggaactaaccccgaaaaggtaaacccctcgggtttaaaaggtttcgttttaccgtaacggaaaaccgtaaaaacttccgggaaaacgaaccgggtccccttaggggaaacccggtaacggacccccgggaaagggggaccctaacccggggttacctttaccgggtttttaaattacccgtaggggttacgaccggtaaaaggtacggggttaaagggtaaccgtaaaagggtaccctaaactacccgggttcggaaaccgtttcgggtaaacggggg

SEQ ID NO: 385421 - DNA, 754 bp, Homo sapiens
  misc_feature: GZ8MTXP02H17I0.39.60.F05.1.454.CMB.2.raw
  modified_base (284)..(284): a, c, t, g, unknown or other
  modified_base (578)..(578): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctgggtggagtcggtgggggaggcctggtcaagccgtggggggtccctgacgactctcctgtgcacgcctctggtactcgtccttcagcngctacttccatcgctacgtcgggtcccgaccacgggtccgtaccggaagggggaacggggtcgtaggggtagggtcggggtactacgtactaccgtaagttaacgttaggtttaccgtttacgtttaacgttaactaactttacttactttaactcgggtacctaacgtcccttacgtaacggttacgggaaacggggtacctactttaccgaaccctagttacccgtaacccgaaggtaaccgaacccgaccggtaaacccgaaaacgtacgttcgtaaagtttccgtttaanaacggtaccttaaaaagtcggaaactcggtacctaaggaggaacggacccgaaggggtacctaaccgggtctttactttttaaacgtcgttggacggtacgaaaggttccggaaggggtaaaccttaacgggaaaccttaccggtaaacgtcggtacccggtttacgggaacgggg

SEQ ID NO: 385422 - DNA, 687 bp, Homo sapiens
  misc_feature: GZ8MTXP02JGC7N.39.60.F05.1.454.CMB.2.raw
  modified_base (388)..(388): a, c, t, g, unknown or other
  modified_base (395)..(395): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtggggagcctggtcaagccgtgggggtccctgacgactctcctgtgcacgcctcgtggattcgccttcgagcagctattccatcgcacgtcggtcccgccgaggcctcggaggggtaaggggctaggggaggttcggggtctcgactcctagttaggttagtacgtttctaagttacattnttcttangccagcctgaggtaggaacgggtctactacgacctactccgtacaagtacgaccgtaaccgacctaaacgtacctacgtagtttcgtttacacggaactaaacgtacgaaacacgtcgtaacggacgaaccggaccggaaaggacccgtaccgggttaccttttacgtttaacgtttacccggtaggttacgggaccggaaagggtacgggtaaaacggggtaacgttaaaaccgggtacccttaaccggtaccggttacgggtaacccgggtttacggtaaaacccggggg

SEQ ID NO: 385423 - DNA, 572 bp, Homo sapiens
  misc_feature: GZ8MTXP02FGRUK.39.60.F05.1.454.CMB.2.raw
  modified_base (293)..(293): a, c, t, g, unknown or other
  modified_base (445)..(445): a, c, t, g, unknown or other
  modified_base (456)..(456): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttcctgttgctattttagaaggtgtccagtgtgaggtgcagctggtggagtctgggggaggcctggtcaagcctggggggtcctgagactctcctgtgcagcctctgattcgcttcagcagctatccatcgcactggtccncaggctccgagggaggggctggagtgggtctcgatccaattacggtagtagttcctagttacattatcttatgcagccttcgagtgaaagggccgattcaccagtctcagacgacgacgacaagaactcaagtgttctagactaaatcgaanacgcctagganacgcccgaaggtaccacgggtactcgtttacttaaactggttacgaccgtaagacgggtaacgggtaacgtaaacgggaacctttacgaacgtacggtaaccgtcgttaacggggg

SEQ ID NO: 385424 - DNA, 813 bp, Homo sapiens
  misc_feature: GZ8MTXP02I350N.39.60.F05.1.454.CMB.2.raw
  modified_base (292)..(292): a, c, t, g, unknown or other
  modified_base (623)..(623): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtggaggtgcgagcgtggtggagtcggtgggggaggccgtggtcaaggccggtcggggggtccctggagtactctccgtgtgcacgcctcgtgtacttccgcttcgagnacgtctacttccatcgtcgacgtccggtccgcgacggtccgtaccggagggggaacgggtccgtaggggacggtttcggggttacctacgaccgtttaccttaaaggtttaacgttaacggtttaacccgttttacgttaacggtttaaaacttacgtttaagtttaccgtttaacgtcgtaccgtaccgtacccgttacgtaggggttaacgggtaaaccggggtcctaaacctttccaaacccgttacgttccgaaacggaacgaaaacccggtcccgaaaccgtaacccgaaaaacgtaccttagggttaaccgtttgtttaccgaanaaactaaacggttacgaaacgtacggacctaaggggcggaaacccggcggtaacgggtaccgtaaggtttccctttaagtttacgtaaccgtttgggacggaacgtaaacgggggttaagtaaacggggttaaccaaaaccgggttctaacccggttaacggtccgggtaacggttacggggtaaacggg

SEQ ID NO: 385425 - DNA, 800 bp, Homo sapiens
  misc_feature: GZ8MTXP02JC4GJ.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactgggctccgctgggttttcctgttgcttattttagaggtgtccagtgtgaggtgcagcgtggtggagtcggtgggggacggtccgtgggtcgaacggtccggtcgggggggtccctggacgtacctcctccgtgtcgcacgtcccgtctgggtacttccgtccttcgagcgagtccttacttccagtcgactccggtcgggtccccgccgacggtccgtaccggaagggggaacggggtcgttggggacggttcggggttcctacgtacgttacctaagtttaaggttacggttaaccgtttacgtaacgtttaactaatttacttactttacgtcgggtacctaacggtccgttacggtacgggtaacggggaaccgggtccgtaaccgtaccctaccctacgttaccgaccgaaagggacgaccggaaccgaaaccgaaagtacccgtacgttaacggtttctttacgaacgtaaccgtaaagtaccgaaaacgcgtaccgtaggaacgacggacccgtaacggtaccgtacgggtttactttacgttttactacggttagggtcccgaacgggtaaagggtacggtaaaacgggtaacgttaaaaccgggtaacctaaaccggtcggttacggggtaccggttacggggtaaaacccggggg

SEQ ID NO: 385426 - DNA, 693 bp, Homo sapiens
  misc_feature: GZ8MTXP02HBQ1O.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactgggctccgctgggtttcctgttgcttattttagaaggtgtcagtgtgaggtgcagctggtggagtcgtgggggaggcctggtcaagtccgtggggggtccctgagactctcctgtcgcagcctcgtggacttcgccttcagcagctattccatcgcctacgtcgggtcccgccaggccgtccgaaggggaaggggccgtaggggaggttcggggtacctcgaactacctagtttaaacggtaggttaaccgttacttaagtttaactaattacttcttaagtcggtacctaactcccgttacgtaggtacgggtaaacggggtccctaaacgttcctaaccgtactacccgtacgaacgacggaaccgaacccgacaaaacgaacttcgtaaagttcgtttcgagtaaccaaagtacgaaaactcgaccctagggaacgacgaaccggtaaggaccgaccggtctttacgtttaaactcgttagacctcggaaaggacggagggttaaaacgaacggtacctaaacgcccgtaggggtaaccgttcggtaacggggg

SEQ ID NO: 385427 - DNA, 754 bp, Homo sapiens
  misc_feature: GZ8MTXP02JQLLD.39.60.F05.1.454.CMB.2.raw
  modified_base (305)..(305): a, c, t, g, unknown or other
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggtttccttgttgctattttagaaggtgtccagtgtgaggtgcagctgggtggaggtcgtgggggagcctggtcaagccgtggggggtccctgagctctcctgtgcagcctctggattccgcttcagcagctattccatcgctacgtggggtccccnccacgggtctaccggaggggaacggggctggggacgtggggtctcgaagttccaagtttacggtagtacgtttctacgtttacatattcgtttaatcgactgtccccgtgaacgttgggaaacgggccctaaatttccgaacccacgtccttaacccgagaacctaccgggaacctacccgaaaagacccttacgaacggtttaccgtttttgaccgtaaacctaaaagttaacggaaaccttaacgaccctaaggggtacgaaccggtcccgggaaacgggaccccggtaaccgggttccctttaccgtttttaaattaacccggttgtacggttaccgggttaaaaggttttcgggggttttttttaccccgggttttaaagggggtactttccccgggtacttaaggtttaccgttaacccggggtttaacgggtttaccgggggg

SEQ ID NO: 385428 - DNA, 788 bp, Homo sapiens
  misc_feature: GZ8MTXP02G0B0W.39.60.F05.1.454.CMB.2.raw
tcagtcgcactagtcacgaccggtgctcgatttagtacgtcatcagggaaagggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcggtgggggaggtcctggtcaacggccggtcgggggtccctgacgactctcctgtgcacgcctctggtacttccggccttcagcagtctacttccatcgccacgtcggtccgccgacggccgtaccggaggggaacggggtcgtggggaggtttcggggtacctacgataccgttaagtttaacggttagttaacgttacgttaaacgttaactaattacttacgttatcgtaccacgtcctacgtagtaggaaaccgggtccgtaacgttacccaaaccgtacttacccgtaaccgaaggtaaaccggaccggaaacccgtacccgtaaaacggtaaccctcggttaaacggtttacgtttcgttaaacggtaaacctaaaactacgggtaaaaccgaccggttaccccgagggtaccggaacggaacccggttaacgggacccgtacgggtaccccttttaacgtttacgttacgtacgggttacgaccggggtaaaagaacgggggtaacggggtaaaaccttaaaggggttacccccttaaacggtaccgggtaacggttaccggtaacggtaacggggg

SEQ ID NO: 385429 - DNA, 503 bp, Homo sapiens
  misc_feature: GZ8MTXP01BI3GG.19.1.A01.1.454.CMB.2.raw
  modified_base (464)..(464): a, c, t, g, unknown or other
  modified_base (479)..(479): a, c, t, g, unknown or other
  modified_base (487)..(487): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaagggcttgagtggatgggagaagcatccctttcttgatactccagacctacgcacagaagttccagggcagagtcacgattaccgcgacgaatccacgagcacagtctatatggaattgacagcctggacatcagaggacacggccgtctattttgtgtcgacaagaaagngattccatacttcgnggcggggnactaatggcagcaagc

SEQ ID NO: 385430 - DNA, 517 bp, Homo sapiens
  misc_feature: GZ8MTXP01AYKR2.19.1.A01.1.454.CMB.2.raw
  modified_base (268)..(268): a, c, t, g, unknown or other
  modified_base (446)..(446): a, c, t, g, unknown or other
tcagtactctcgtgcacgaccggtgctcgatttagacgtctcatcagggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtncgacaagcccctggacaagggcttgagtggatgggagaagcatccctttctttgatactccagactacgcacagaagttcagggcagaagtcaacgattacccgcggacgaatccacgagcacagtctatatggaattgaccagcctgacatcaggaggacacggccgtctattttgngtacgacagaaagagatccattactcgaggtcgggcacgttattggcagcagcttgaagttaacggtgggg

SEQ ID NO: 385431 - DNA, 502 bp, Homo sapiens
  misc_feature: GZ8MTXP01EPV8I.19.1.A01.1.454.CMB.2.raw
  modified_base (326)..(326): a, c, t, g, unknown or other
  modified_base (378)..(378): a, c, t, g, unknown or other
  modified_base (403)..(403): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaagggcttgagtggatgggagaagcatccctttnttgatactccagacctacgcacagaagttccagggcagagtcacgataccgngacaatccagagcacagtactatangaatgacagctgacatcagagcacggcctcttatttgtgcgaacaagaaagagattccgaatacttcgagggcgggtcacgtaatgggcagcgaagtcg

SEQ ID NO: 385432 - DNA, 533 bp, Homo sapiens
  misc_feature: GZ8MTXP01D3FUT.19.1.A01.1.454.CMB.2.raw
  modified_base (316)..(316): a, c, t, g, unknown or other
  modified_base (441)..(441): a, c, t, g, unknown or other
  modified_base (457)..(457): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcgggtgaaagtttcctgcaaggcttctggggacaccttcacctcctattctatcaactggtgcgacaagcccctggacaagggcttgagtgatgggagagcatcctttntttgatactccagactacgcacagaagtcaggcagaagtcaacgataccgcgacgaatccgacgagcacagtctatatggaattgacagctgacatcaggacggacacggccgttctagttttgngactacgtaagaaagngacttaaccaattacgtcgagggccgggcaacgttgacgggcaagcctagcgttagtaacgttcgggtaacggggg

SEQ ID NO: 385433 - DNA, 508 bp, Homo sapiens
  misc_feature: GZ8MTXP01C0BRW.19.1.A01.1.454.CMB.2.raw
  modified_base (324)..(324): a, c, t, g, unknown or other
  modified_base (348)..(348): a, c, t, g, unknown or other
  modified_base (405)..(405): a, c, t, g, unknown or other
  modified_base (440)..(440): a, c, t, g, unknown or other
  modified_base (446)..(446): a, c, t, g, unknown or other
  modified_base (453)..(453): a, c, t, g, unknown or other
  modified_base (502)..(502): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtctcggtgaaagttcctgcaaggcttctggggacaccttcacctcctattctatcaactgggtgcgacaagccccctggacaaggcttgagtggatgggaggagcattcccttntttgatactccagaccctacgcanagaagttcccagggcagagtcacgataccgcggacaatccacgagcacagtctatangaattgacagctggacatcagagacacggcgtctnttttgngtcgaanaagaaagagtattccatacttcgagggcggggcacgtaacgtggcagcngtaacg

SEQ ID NO: 385434 - DNA, 498 bp, Homo sapiens
  misc_feature: GZ8MTXP01A1PCS.19.1.A01.1.454.CMB.2.raw
  modified_base (322)..(322): a, c, t, g, unknown or other
  modified_base (435)..(435): a, c, t, g, unknown or other
  modified_base (442)..(442): a, c, t, g, unknown or other
  modified_base (447)..(447): a, c, t, g, unknown or other
  modified_base (454)..(454): a, c, t, g, unknown or other
  modified_base (468)..(468): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctgggctgaggtgaggaagcctgggtcctcggtgaaagtttcctgcaaggcttctgggggacaccttcacctcctattctatcaactgggtgcgacaagcccctggacaaggcttgagtggatgggagagcatccttnttgatactcagacctacgcacagaagttccagggcagagtcacgattaccgcgacgaatcacgagcacagtactatatggaattgacagcctggacatcagagacacgccgtntatttgngcganaagaagngattccatacttgngggcggggcacgtaagtggcagcgaagtcg

SEQ ID NO: 385435 - DNA, 534 bp, Homo sapiens
  misc_feature: GZ8MTXP01A3Z5H.19.1.A01.1.454.CMB.2.raw
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttcgtggggacaccttcacctcctattctatcaactgggtgcgacaagcccctggacaagggcttgagtggatggggaggaagcattccctttctttgatactcagactacgcacacgaagttcgagggcagaagtcaacgataccgcggacgaatccacgagcacagtctatatggaattcgacagcctgacatcaggagacacggccttctattttgagcgacgagaaagagtatccattactcgagggtcggggacacgttagttcggaacaggcaggcttagaacgttcgggtaacggggg

SEQ ID NO: 385436 - DNA, 525 bp, Homo sapiens
  misc_feature: GZ8MTXP01EXRDS.19.1.A01.1.454.CMB.2.raw
  modified_base (227)..(227): a, c, t, g, unknown or other
  modified_base (274)..(274): a, c, t, g, unknown or other
  modified_base (320)..(320): a, c, t, g, unknown or other
  modified_base (444)..(444): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctgggctgaggtgaggagcctgggtcctcggtgaaagtttccngcaaggcttctggggacaccttcacctcctattctatcaactgggtncgacaagcccctggacaaggctgagtggatggagagcatccctttnttgatactcagacctacgcacagaacgttccagggcagagtcacgattaccgcgacatccagagcacagtactatatggaattgacagcctggacatcagaggacacggtccgtcttattttgngtcgaacaaggaaagttagaactttaccgaattaaccgttcgacgggccggggaacacgtaagtcgggcaggccgaagtcg

SEQ ID NO: 385437 - DNA, 513 bp, Homo sapiens
  misc_feature: GZ8MTXP01B8HQ0.19.1.A01.1.454.CMB.2.raw
  modified_base (269)..(269): a, c, t, g, unknown or other
  modified_base (318)..(318): a, c, t, g, unknown or other
  modified_base (366)..(366): a, c, t, g, unknown or other
  modified_base (383)..(383): a, c, t, g, unknown or other
  modified_base (437)..(437): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctgggctgaggtgaggaagcctgggtcctcggtgaaagtttcctgcaaggcttcgtggggacaccttcacctcctattctatcaactgggtncgacaagcccctggacaagggcttgagtggatgggagagcatccctttnttgatactcagactacgcacagagtcagggcagaagtcaagataccgngacgaatccacgagcanagtctatataggaattgaccagcctgacatcaggaggacacggctctatttcgngcgacagaaagagatccaattactcgagggcggggcacgttgttggcaggcagcttagtaagttaacgggtcgggg

SEQ ID NO: 385438 - DNA, 505 bp, Homo sapiens
  misc_feature: GZ8MTXP01EQ1KO.19.1.A01.1.454.CMB.2.raw
  modified_base (229)..(229): a, c, t, g, unknown or other
  modified_base (276)..(276): a, c, t, g, unknown or other
  modified_base (347)..(347): a, c, t, g, unknown or other
  modified_base (407)..(407): a, c, t, g, unknown or other
  modified_base (434)..(434): a, c, t, g, unknown or other
  modified_base (447)..(447): a, c, t, g, unknown or other
  modified_base (452)..(452): a, c, t, g, unknown or other
  modified_base (460)..(460): a, c, t, g, unknown or other
  modified_base (476)..(476): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttccngcaaggcttctggggacaccttcacctcctattctatcaactgggtncgaacaagccccctggacaagggcttgagtggatgggagagcatccctttcttgatactccagacctacgnacagaagttccagggcagagtcacgattaccggcgaacaactcacgagcacagtctatanggaattgacagctggacatcagagacncggctctatttgngcganaagaaagngattccgatacttcgngggcggggcacgtaatggcagcaaggtcg

SEQ ID NO: 385439 - DNA, 541 bp, Homo sapiens
  misc_feature: GZ8MTXP01ERFPW.19.1.A01.1.454.CMB.2.raw
  modified_base (269)..(269): a, c, t, g, unknown or other
  modified_base (321)..(321): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctgggctgaggtgaggaagcctgggtcctcggtgaaagtttcctgcaaggcttcgtggggacaccttcacctcctattctatcaactgggtncgacaagcccctggacaagggcttgagtggatggggagaagctatccctttnttgatactccagactacgcacacgagttcagggcagaagtcaacgattaccggcggacgaactccgacgagcacagtctaatataggtaattgaccagcctgacatcaggaggacacggccgtcttagtttgtgacgtacaagaaagtagtaactcaattacgtcgaggggcggggacacgttagttcggcagcagcttagtaacgttcggtaacggggg

SEQ ID NO: 385440 - DNA, 508 bp, Homo sapiens
  misc_feature: GZ8MTXP01EDBF9.19.1.A01.1.454.CMB.2.raw
  modified_base (268)..(268): a, c, t, g, unknown or other
  modified_base (315)..(315): a, c, t, g, unknown or other
  modified_base (476)..(476): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaagtttcctgcaaggcttctggggacaccttcacctcctattctatcaactgggtncgacaagcccctggacaagggctgagtggatgggagagcatcctttnttgatactccagactacgcacagagtcagggcagaatcaacgataccgcgacgaatccagagcacagtctatatggaattgaccagcctgacatcagggacgacacgcgtctatttgtgacgacaagaaagagatccattactcgagggcggggcacgttnttggcagcagcttagtaagttaagggtcgggg

SEQ ID NO: 385441 - DNA, 546 bp, Homo sapiens
  misc_feature: GZ8MTXP01BV8B5.19.1.A01.1.454.CMB.2.raw
  modified_base (234)..(234): a, c, t, g, unknown or other
  modified_base (269)..(269): a, c, t, g, unknown or other
  modified_base (318)..(318): a, c, t, g, unknown or other
  modified_base (448)..(448): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttcgnggggacaccttcacctctattctatcaactgggtncgacaagcccctggacaagggcttgagtgagtgggagagctatcctttnttgatactcagactacgcacacgagtcaggcagaagtcaacgataccgcgacaatccacgagcacagtactatagtaggaattcgacctagcctagacatacgaggaggacacggccgtcttattttcgngtacggaactaagaaagtagaactttccgaattaccgtacgacgggacggggcacgttagcggaacaggcagcgttaggtaacgttcgggtaaggggg

SEQ ID NO: 385442 - DNA, 583 bp, Homo sapiens
  misc_feature: GZ8MTXP01C3FQS.19.1.A01.1.454.CMB.2.raw
  modified_base (279)..(279): a, c, t, g, unknown or other
  modified_base (349)..(349): a, c, t, g, unknown or other
  modified_base (567)..(567): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtgggctgaggtgaggagccgtgggtcctggtagaaagtttcctgcaaggtcttcgtggggacaccttcacctcctattctatcaacgtgggtncgaacaacgcccctggacaaggcttgagtggagtgggagagctattccttcttgatctccagacctacgnacagaacgtaccgagggcagagtacaacgacgtaccgcgaaacgaactaccgacggacgacactagtacttaatagtaggaattcgaaccagccctaggaactagtaccgaaggacggaacgtacccggggtactttacgtttattttcggagtaccgaagtaaagaaacgagttaaccttcgtaaacttaccacggcgggccgggtaacagtaacgnggacaggcaagtaacg

SEQ ID NO: 385443 - DNA, 518 bp, Homo sapiens
  misc_feature: GZ8MTXP01CTNDG.19.1.A01.1.454.CMB.2.raw
  modified_base (325)..(325): a, c, t, g, unknown or other
  modified_base (466)..(466): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagttcctgcaaggcttctggggacaccttcacctcctattctatcaactgggtgcgacaagcccctggacaagggcttgagtggatgggagaagcattcccttnttgatactcagacctacgcacagaagttcccagggcagagtcacgattaccgcgaacgaatccacgagcacagtactatatggaattgaccagcctggacatcagagacacggcgtacttattttgtgcgaacaagaaagngtacttccaatacttcgagggccggggaacacgtaagtgggacaggcaagcg

SEQ ID NO: 385444 - DNA, 518 bp, Homo sapiens
  misc_feature: GZ8MTXP01ACQ41.19.1.A01.1.454.CMB.2.raw
  modified_base (484)..(484): a, c, t, g, unknown or other
  modified_base (504)..(504): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctctattctatcaactgggtgcgacaagcccctggacaaggcttgagtggatgggaggaagctatccctttcttgatactcagacctacgcacagaagttccagggcagagtcacgattacgcgacgaatccacgagcacagtctatatggattgacagctaggacatcagagacacggtcctcttattttgtagcgaacaagaaagagtacttacccgaatacgttcgnggggccggggctaacgttgnggcacgcgaagtcg

SEQ ID NO: 385445 - DNA, 600 bp, Homo sapiens
  misc_feature: GZ8MTXP01BQYSI.19.1.A01.1.454.CMB.2.raw
  modified_base (319)..(319): a, c, t, g, unknown or other
  modified_base (327)..(327): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggagcctgggtcctcggtgaaagtttcctgcaaggcttctgaggacaccttcacctcctattctatcaactgggtgcgacaacgcccctaggacaagggcttgagtggatgggagagcatccctttnttgatacncagactacgcacagagtccaggcaagacgtcaacgattacccgcggaacaactccaacgacgacaacagtactataagtaggaaattcgaaccagccctagacagtcgaagacggaccacgggtccgttcgttacgtttttggacgtacggaaccgtaaaggaaaaggactaaacgtttaccaacgttaccgttacggaaacgggtccgggggacttaccgttaggttaacgggcgtaacgccgaggaccgttaagttaacgttaaccggggg

SEQ ID NO: 385446 - DNA, 515 bp, Homo sapiens
  misc_feature: GZ8MTXP01EA7ZT.19.1.A01.1.454.CMB.2.raw
  modified_base (318)..(318): a, c, t, g, unknown or other
  modified_base (427)..(427): a, c, t, g, unknown or other
  modified_base (446)..(446): a, c, t, g, unknown or other
  modified_base (480)..(480): a, c, t, g, unknown or other
  modified_base (500)..(500): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggagctggtcctcggtgaaagttcctgcaaggcttctggggacaccttcacctcctattctatcaactgggtgcgacaagcccctggacaaggctgagtggatggagagcatccctttnttgatactcagtacctacgcacagaagttcccagggcagagtcacgattaccgcgacgatccagagcacagtactatatggaattgacagcctgggacatcagaggacncggtccgtacttattttgngtcgacaagaaagaggatttaccgatacttacgngggcggggtcacgttaaggngacgagtcgaagtcg

SEQ ID NO: 385447 - DNA, 560 bp, Homo sapiens
  misc_feature: GZ8MTXP01BLJWJ.19.1.A01.1.454.CMB.2.raw
  modified_base (273)..(273): a, c, t, g, unknown or other
  modified_base (323)..(323): a, c, t, g, unknown or other
  modified_base (403)..(403): a, c, t, g, unknown or other
  modified_base (459)..(459): a, c, t, g, unknown or other
  modified_base (485)..(485): a, c, t, g, unknown or other
  modified_base (533)..(533): a, c, t, g, unknown or other
  modified_base (538)..(538): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgtaaagtttcctgcaaggtcttcgtggggactaccttcacctcctattctatcaactgggtnacgacaacgcccctggacaagggctgagtggatggaagagctatcctttnttgatactcagactacgcacaacgtacttcgagggcagaagtaccaacgacgttaccgcggacgaactccgacgacgcanagtctatataggaattcgaaccagcctagacatcgaggacggactacggtccgttnttagttttcgagaccagtaagaaagngaacttcgaattacgtcgacggggtcggacttagttacgttggccagnacggnttacgaacgttcgggtaacggg

SEQ ID NO: 385448 - DNA, 537 bp, Homo sapiens
  misc_feature: GZ8MTXP01CFCT6.19.1.A01.1.454.CMB.2.raw
  modified_base (268)..(268): a, c, t, g, unknown or other
  modified_base (316)..(316): a, c, t, g, unknown or other
  modified_base (447)..(447): a, c, t, g, unknown or other
  modified_base (513)..(513): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactggtncgacaagcccctggacaagggcttgagtggatgggagagcatcctttnttgatactccagactacgcacacgagttcaggcagagtcaacgattaccgcggacgatccacgagcacagtctatatagaattgaccagcctgacataccaggacggacgaccggccgttcttagttttgngtacgactaagaaagagtattaacccaattactacgacgggtacggggcacgttgttggaacagcngcgttgaacgttcggtaacggggg

SEQ ID NO: 385449 - DNA, 552 bp, Homo sapiens
  misc_feature: GZ8MTXP01EXQK4.19.1.A01.1.454.CMB.2.raw
  modified_base (273)..(273): a, c, t, g, unknown or other
  modified_base (321)..(321): a, c, t, g, unknown or other
  modified_base (392)..(392): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctggaggtgaggaagcctgggtcctcggtgaaagtttcctgcaaggcttcgtggggactaccttcacctcctattctatcaacgtgggtncgacaacgcccctggacagggcttgagtggatgggagagcatcctttnttgatactcagactacgcacagtaagtcagggcagaagtcaacgtataccgcggtacaatccgacgagcanagtactatatggaattcgaccagcctagacatcgagggacgacgaccggcttacttagtttgcgacgtacaagaaacgagtatccaattaccgtcgaacgggcgggacttacggttagttcggaacagcctaaggcttaggtaacgttaacgggtcgggg

SEQ ID NO: 385450 - DNA, 531 bp, Homo sapiens
  misc_feature: GZ8MTXP01DE4EI.19.1.A01.1.454.CMB.2.raw
  modified_base (323)..(323): a, c, t, g, unknown or other
  modified_base (419)..(419): a, c, t, g, unknown or other
  modified_base (422)..(422): a, c, t, g, unknown or other
  modified_base (446)..(446): a, c, t, g, unknown or other
  modified_base (455)..(455): a, c, t, g, unknown or other
  modified_base (469)..(469): a, c, t, g, unknown or other
  modified_base (500)..(500): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctgaggtgaggaagcctgggtcctcggtgaaagtttcctgcaaggcttcgtggggacaccttcacctcctattctatcaactgggtgcgacaagcccctggacaagggcttgagtggagtgggagaagcattccctttntttgatactccagactacgcacacgacgtcagggcagaagtcaacgactaccgacggacgaatccacgagcaacagtactatataggaattgaccngcngacatcaggaggacacggtccgtnttagtttgngacgaacaagaaanagtatccaattactcgaggcggggcacgttnggcagcagcgttgaagttcgggtaacggggg

SEQ ID NO: 385451 - DNA, 500 bp, Homo sapiens
  misc_feature: GZ8MTXP01DXNYG.19.1.A01.1.454.CMB.2.raw
  modified_base (268)..(268): a, c, t, g, unknown or other
  modified_base (314)..(314): a, c, t, g, unknown or other
  modified_base (431)..(431): a, c, t, g, unknown or other
  modified_base (438)..(438): a, c, t, g, unknown or other
  modified_base (445)..(445): a, c, t, g, unknown or other
  modified_base (477)..(477): a, c, t, g, unknown or other
  modified_base (483)..(483): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactggtncgacaagcccctggacaagggcttgagtgatgggagagcatccttnttgatactcagactagcacagaattcagggcagaagtcaacgataccgcgacaatccacgagcacagtctatatgaattgaccagcctgacatcaggagacacggcctctattttgngtacganagaaagngattccaattactcgaggacgggcacgttagngcagcngcgttgtgttcggtggg

SEQ ID NO: 385452 - DNA, 601 bp, Homo sapiens
  misc_feature: GZ8MTXP01CU5HC.19.1.A01.1.454.CMB.2.raw
  modified_base (270)..(270): a, c, t, g, unknown or other
  modified_base (320)..(320): a, c, t, g, unknown or other
  modified_base (329)..(329): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttcgtggggacaccttcacctcctattctatcaactgggtncgacaagcccctggacaaggctgagtggagtgggagagctattccctttntttgatacncagactacgcacacgaacgtcgagggcaggaacgtacaacgtactaacccggacggaacgaactcccaacggacgacaacctagtaccttaataagtggtaaatttcggaaccagcctagaccagtaccgaaggggaacggaccgaaccgggtccttacgtttagttttggtacgacgtaacgtaaaggaaagtagtaacttaaccaattacgtcgaaggggtccgggcaacgttagttggcagcgagcttagtaacgttcgggtaacgggg

SEQ ID NO: 385453 - DNA, 532 bp, Homo sapiens
  misc_feature: GZ8MTXP01AH2BB.19.1.A01.1.454.CMB.2.raw
  modified_base (270)..(270): a, c, t, g, unknown or other
  modified_base (319)..(319): a, c, t, g, unknown or other
  modified_base (450)..(450): a, c, t, g, unknown or other
  modified_base (501)..(501): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttcgtggggacaccttcacctcctattctatcaactgggtncgacaagcccctggacaagggcttgagtggatgggagagcatccctttnttgatactccagactacgcacacgagttcagggcagaagtcaacgataccgcggacgaatccacgagcacagtctatagtggaattcgaccagcctgacatcaggaggacacggccgttcttaagttttgngtcgacagaaagagattccattacgtcgagggcggggacacgttgttggcngccagcgttagtaacgttaacgggtcggggg

SEQ ID NO: 385454 - DNA, 521 bp, Homo sapiens
  misc_feature: GZ8MTXP01EGSFQ.19.1.A01.1.454.CMB.2.raw
  modified_base (265)..(265): a, c, t, g, unknown or other
  modified_base (349)..(349): a, c, t, g, unknown or other
  modified_base (378)..(378): a, c, t, g, unknown or other
  modified_base (433)..(433): a, c, t, g, unknown or other
  modified_base (484)..(484): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctgggctgaggtgaggaagctgggtcctcggtgaaagtttcctgcaaggcttctggggacaccttcacctctattctatcaactggtncgacaagcccctggacaagggcttgagtgagtgggagaagcatcctttcttgatactcagactacgcacagagttcaggcagancaacgatacgcggacgaatccacgagcanagtactatataggaattgacagctagacatcaggagacgacgcgtcttattttgngtacacgtagaagagtatcaattactcgaagggccggggtacacgttaagnggcagcgaagcttagtaacgttaacgggttaacgggg

SEQ ID NO: 385455 - DNA, 546 bp, Homo sapiens
  misc_feature: GZ8MTXP01DY6DJ.19.1.A01.1.454.CMB.2.raw
  modified_base (324)..(324): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaaggctgagtggatgggagagcattccctttnttgatactcagacctacgacacagaagttcccagggcagagtacaacaacgttaccggacggaacgaatccaacgagcacagtctaatatggaattgacagcctaggacatcagaggcgacggcgttacttagttttgacgtcgaacgaaagaaagcgtaattacctaagttaacgacgagggaccggggaacaacgtaagtacgggcaagcgaagtaaccg

SEQ ID NO: 385456 - DNA, 519 bp, Homo sapiens
  misc_feature: GZ8MTXP01B3HUN.19.1.A01.1.454.CMB.2.raw
  modified_base (267)..(267): a, c, t, g, unknown or other
  modified_base (369)..(369): a, c, t, g, unknown or other
  modified_base (444)..(444): a, c, t, g, unknown or other
  modified_base (491)..(491): a, c, t, g, unknown or other
  modified_base (494)..(494): a, c, t, g, unknown or other
  modified_base (500)..(500): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctctattctatcaactggtncgacaagcccctggacaagggcttgagtggatgggagaagcattccctttctttgatactcagactacgcacagaagttcagggcagaatcaacgataccgngacgaatccacgagcacagtctatatggaaattgaccagcctgacatcagggacgacacggccgtcttattttgngcgacaagaaagagattccaattactcgagggcggggcacgttaggnggnagcagngagtaacgttaacggtggg

SEQ ID NO: 385457 - DNA, 528 bp, Homo sapiens
  misc_feature: GZ8MTXP01E1ONT.19.1.A01.1.454.CMB.2.raw
  modified_base (269)..(269): a, c, t, g, unknown or other
  modified_base (320)..(320): a, c, t, g, unknown or other
  modified_base (331)..(331): a, c, t, g, unknown or other
  modified_base (447)..(447): a, c, t, g, unknown or other
  modified_base (501)..(501): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttcgtggggacaccttcacctcctattctatcaactggtncgacaacgcccctggacagggcttgagtggatggggagaagctatcctttnttgatactcanactacgcacacgagttcagggcagaagtcaacgtacgtaccgacggacgaacgtccgacgacgacacagtctatagtaggtaattcgaccagctgacatcaggagacgacgccgtnttagtttgcgacacaagaagagatccattaccgcgagggtcgggacacgttagnggcagcagcttagaagttcggtcgggg

SEQ ID NO: 385458 - DNA, 615 bp, Homo sapiens
  misc_feature: GZ8MTXP01D3GZL.19.1.A01.1.454.CMB.2.raw
  modified_base (335)..(335): a, c, t, g, unknown or other
  modified_base (344)..(344): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctggaggtgaggagccgtgggtctcggtgaagtttcctgcaaggtcttcgtgggactaccttcacctcctattctatcaacgtgggtgacgaacaacgccccgtggacaagggcttggagtggagtggaggagcactttcctttnttgactacncagtacctacgcacgagtaactaccgagggtcagagtacacgtacgtaccggacggtaacgactaccgacgacgcaatagtactatagtaggaattcgaccagtccctggaaactagtacgaacggacggtaaccgtacggtaccggtttacttttaagtttttcggaggtaccgaagaaacgggtaaaattcggtaactttaccaacgtaccgttacgggacggggttaccgggaactaaaccttgggacgaccgagtcgaacggttcgg

SEQ ID NO: 385459 - DNA, 596 bp, Homo sapiens
  misc_feature: GZ8MTXP01DK76I.19.1.A01.1.454.CMB.2.raw
  modified_base (330)..(330): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttcgtggggacacccttcacctcctattctatcaactgggtgcgacaagccccctggacaagggcttgagtggagtgggagagcattccctttntttgatactccagacctacgcacgagaacgttccgagggcagagtacacgacttaccgcggacgaatccacgagcacagtactatataggaattcgaccagccctaggaacagtaccgaaggacggaccgaccgggtccgttactttagtttttcgagaccggtaacgaaaggtaaaagaggtaacttaccaaagttaccgttacggacggggttaccgggggaacctaacgttaacggttacgggccaaggcgaacggtaaccgg

SEQ ID NO: 385460 - DNA, 537 bp, Homo sapiens
  misc_feature: GZ8MTXP01AWMEB.19.1.A01.1.454.CMB.2.raw
  modified_base (270)..(270): a, c, t, g, unknown or other
  modified_base (318)..(318): a, c, t, g, unknown or other
  modified_base (449)..(449): a, c, t, g, unknown or other
  modified_base (459)..(459): a, c, t, g, unknown or other
  modified_base (496)..(496): a, c, t, g, unknown or other
  modified_base (502)..(502): a, c, t, g, unknown or other
  modified_base (506)..(506): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttcgtggggacaccttcacctcctattctatcaactgggtncgacaagcccctggacaagggctgagtggatgggagagcatccctttnttgatactcagactacgcacacgagttcagggcagaagtcaacgattaccggacggacgaatcccgacgacgacacagtactaatagtagaacttgaccagcctgaacatcgaggacggacacggccgttntacgttttgngtacgacaagaagagatccgattactacgaggcgggnacgttncggnagcgagcgttagtaacgttaacgggtcgggg

SEQ ID NO: 385461 - DNA, 654 bp, Homo sapiens
  misc_feature: GZ8MTXP01B9L5P.19.1.A01.1.454.CMB.2.raw
  modified_base (324)..(324): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagccgtgggtctcggtgaaagtttcctgcaaggcttcgtggggacacccttcacctcctattctatcaactgggtgcgacaagcccctggacaaggctgagtggatggagagcattcccttntttgatactcagtaccctacgcaacagaacgttacccgagggcaaggacgtaccacggacttaacccggcggaacgaactacccgacgacgacaacgtagtactataagtggaattacgacctagcccttaggggaactagtccgaaggacggaccgaccgggtccgtttacctttagttttttgggacgtacccggaagtaaaggaaaacggttacggtaactttacccgtaaagttaacccgttaccggaacgggggttacccgggggaacctaaacccggtttaagggtacggggccgttaaacgggtcccgaagggttaacccggg

SEQ ID NO: 385462 - DNA, 639 bp, Homo sapiens
  misc_feature: GZ8MTXP01AMRRY.19.1.A01.1.454.CMB.2.raw
  modified_base (270)..(270): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttcgtggggacaccgttcacctcctattctatcaactggtncgacaagcccctggacaagggcttgagtggatgggagagcatcctttcttgatactccagactacgcacacgagttcagggcagaacgtcaacgataccggcgacgaatccgacgagccacaggtctatagtaggtaattcggaacctaggcccttaggaaccagtacgaaggggacgggacctaaccggggcccgtttacgttaatttttcggacgtaccgtaacaaggtaaaagacgtaacttaacccaagttaaccttacggacggggtaccgggggtaaccttaaccgtttaaggacggggccaaacgggtaaccgaacgggtacccgttagggtaaccgttaacccgggggtttaaccgggggg

SEQ ID NO: 385463 - DNA, 563 bp, Homo sapiens
  misc_feature: GZ8MTXP01ALBS0.19.1.A01.1.454.CMB.2.raw
  modified_base (330)..(330): a, c, t, g, unknown or other
  modified_base (490)..(490): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctgggctgaggtgaggaagcctgggtcctcggtgaaagtttcctgcaaggcttcgtggggacaccttcacctcctattctatcaactgggtgcgacaacgccccctggacaaggcttgagtggagtggggagagctattccctttnttgatactcgagaccctacgcaacgagtacgttcccgaggggcagacgtacacgacgttaccgacggaacgaactccgaagacgcacagtactaatagtaggaattacgaccagcctagggacagtcgacgaggaccacggtccgttacttagttttcgngtaccgaagaaagaaagagtaacttccaagtaccttcgagggcgggtaacacgtaagtcgggcagcgaagtcg

SEQ ID NO: 385464 - DNA, 571 bp, Homo sapiens
  misc_feature: GZ8MTXP01ACT8M.19.1.A01.1.454.CMB.2.raw
  modified_base (329)..(329): a, c, t, g, unknown or other
  modified_base (347)..(347): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtggggctggaggtgaggaagccgtgggtcctcggtgtaaagtttcctgcaaggtcttcgtgggacaccttcacctcctattctatcaacgtggtgcgacaacgcccctggacaggcttgagtggatgggagagctatcctttnttgatactcagacctacnacgagacgttacccagggcagacgtacgacgtacgttaccggacgggtaaccgaactacccgacgaacgacactagtactatagtaggtaattcgaacagcctagggacatcaaggacgaccgacggccgttacttagttttgcgtacgacaaggaaagagtaattacctaataccgttcggacgggcggggaacacgtaacgtcgggacacggcgaagtaacg

SEQ ID NO: 385465 - DNA, 566 bp, Homo sapiens
  misc_feature: GZ8MTXP01BZ3OE.19.1.A01.1.454.CMB.2.raw
  modified_base (270)..(270): a, c, t, g, unknown or other
  modified_base (477)..(477): a, c, t, g, unknown or other
  modified_base (493)..(493): a, c, t, g, unknown or other
  modified_base (537)..(537): a, c, t, g, unknown or other
  modified_base (545)..(545): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtgggctgaggtgaggaagcctgggtcctcggtgaagtttcctgcaaggcttcgtggggactaccttcacctcctattctatcaactgggtncgacaacgcccctggaacaagggcttggagtggagtggggagaagctacgttccctttctttgatacctccagactacgcacaagacgttcgagggcagaagcaacgattaccggcggaacaatccgacgagcacagtactaatagtagaattcgaacctagcctagacatcgaagggacggacgaaccggcgttactagttttggngaccgaataagaaagngtattaaccattaccgtacgagggcgggtacacgttagcggaanagcacggngttagtaacgttcgggtcggg

SEQ ID NO: 385466 - DNA, 586 bp, Homo sapiens
  misc_feature: GZ8MTXP01AYY04.19.1.A01.1.454.CMB.2.raw
  modified_base (270)..(270): a, c, t, g, unknown or other
  modified_base (318)..(318): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctgaggtgaggaagcctgggtcctcggtgaaagtttcctgcaaggtcttcgtgggacaccttcacctcctattctatcaactggtncgacaacgccctggacaggctgagtggagtgggagagctatccctttnttgatactcagactacgcacacgaacgttcgaggcagaacgtcaacgataccgacggacaactccgaacgacgacacagtctaatagtaggtaaattcgacctagacctgaacctatcgaaggacgggaacgtaccgggtcccgttattacgtttttgacggtacgaactaaggaaacgagtaacttaacccaaattaccgtacgagggtccgggacttaacgttgttcggaacagccagcgttaggtaacgttcgggtaaccggggg

SEQ ID NO: 385467 - DNA, 570 bp, Homo sapiens
  misc_feature: GZ8MTXP01DMXFH.19.1.A01.1.454.CMB.2.raw
  modified_base (275)..(275): a, c, t, g, unknown or other
  modified_base (325)..(325): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttcgtggggacaccttcacctcctattcatcaactggtncgacacgcccctggacaaggcttgagtggagtgggagagcattccctttnttgatactcagacctacgcagagaacgtccagggcagagtcacgattaccggcgaacaatccacgagcactacgtactatagtaggaattcgaaccagccctagggacatcaaggagaccgacggccgttcttaagttttgacgtacgaacgaaagtaaagaggtaacttaccgaattaaccgttacggacggggccgggggtaacctacgtttaacggtcgggaccgagcccgaaggtaaccgg

SEQ ID NO: 385468 - DNA, 563 bp, Homo sapiens
  misc_feature: GZ8MTXP01DQ72S.19.1.A01.1.454.CMB.2.raw
  modified_base (274)..(274): a, c, t, g, unknown or other
  modified_base (322)..(322): a, c, t, g, unknown or other
  modified_base (468)..(468): a, c, t, g, unknown or other
  modified_base (526)..(526): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtgggctggaggtgaggaagccgtgggtcctcggtgaaagtttcctgcaaggcttcgtggggacaccttcaccttcctattctatcaacgtgggtncgacaagcccctggacaaggcttgagtggagtgggagagcatcctttnttgatactcagactacgcacacgacgtcgaggcagaatcaacgataccggcgaacgaatccacgacgcaacagtctaatagtaggaattcgacctaagcctagaccatccgaagggacgacgaccggtccgttacttagtttttgngtacgaacgtaagaaagtagacttaacaattacgtacgagggccgggtacacgttagnggaacaggcagcgttagtaacgttcgggtaacggggg

SEQ ID NO: 385469 - DNA, 602 bp, Homo sapiens
  misc_feature: GZ8MTXP01EVDCM.19.1.A01.1.454.CMB.2.raw
  modified_base (272)..(272): a, c, t, g, unknown or other
  modified_base (322)..(322): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggtcttcgtggggacaccttcacctcctattctatcaacgtgggtncgacaacgccccgtggacaagggctgagtgagtgggagagcattcctttnttgactactcagactacgcacagacgttcgaggcagaagtacaacgtactaccggcgaacgaatcccgacgacgacaacgtagtctaatagtagggtaaacttcgaaccagcctagacagtacgaagggggaacggaccgtacgggtccttacgtttaagttttggacgtaccggaataaagggaaaagtaggtacttaaccaagttaccgtcgaaggggtccgggacttaacgttgcgggaaccagaacacggacttggtaacgttaacgggtccgggg

SEQ ID NO: 385470 - DNA, 544 bp, Homo sapiens
  misc_feature: GZ8MTXP01A9PJ8.19.1.A01.1.454.CMB.2.raw
  modified_base (268)..(268): a, c, t, g, unknown or other
  modified_base (314)..(314): a, c, t, g, unknown or other
  modified_base (449)..(449): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactggtncgacaagcccctggacaagggctgagtggatgggagagcatccttnttgatactcagactacgcacagagttcaggcagaagtcaacgataccgcggacgaatccacgacgcacagtctatagtggaattcgaccagcctagacatacgagggacggacaccggccgttacttagttttgngtacgacgtaaggaaagtgtacttaaccgaattacgtcgagggcggggacacgttgcgggcagcgagcgttaggaacgttaacggggtccggggg

SEQ ID NO: 385471 - DNA, 582 bp, Homo sapiens
  misc_feature: GZ8MTXP01BTN69.19.1.A01.1.454.CMB.2.raw
  modified_base (274)..(274): a, c, t, g, unknown or other
  modified_base (328)..(328): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgtaaagtttcctgcaaggcttcgtggggacctaccttcacctcctattctatcaacgtgggtncgacaacgcccctaggacaagggcttgagtggagtggggagagcattccctttnttgattactcagactacgcacagtacgtcgaggcagacgtcaacgagttacccggcggaacgaactccgagacgcacagtctatataggaattgaccagcctagacatcgagggacgacgacggtccgttcttagtttcggcgtacgaacgaaggaaagagtacttaaccctagttactcggagggaccggggtacttacgttagttcggaacacggtcgaggcgttaggtaacgttaacgggttaaccggggg

SEQ ID NO: 385472 - DNA, 622 bp, Homo sapiens
  misc_feature: GZ8MTXP01CT2MH.19.1.A01.1.454.CMB.2.raw
  modified_base (545)..(545): a, c, t, g, unknown or other
  modified_base (599)..(599): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtggggctggaggtgaggagccgtgggtccgtggtagtaaagttcctgcgaggtcgttcgtggggacctaccttccacctcctattctatcaacgtgggtgaccgaacaacgccccctaggaaccgaagggtcttggaggtggagtgggggaaggaagctactttccctttcgtttagacttactccaagaccctacggacacgaacgtaacggttaacccgagggtccgaagtacgtacgaaccgtacttaacccgggacggaacgaactaccgacgacgcaacagtctagtagtgaattcgacagaccctaggaacctgtaacgaggacgaccgaccggtcgttacctttgttttcgngtaccgtaagaaagtaaagagtacttacgtaagtcttagcggggcggtctacgngtcggaccaggtcgaaggtaacg

SEQ ID NO: 385473 - DNA, 732 bp, Homo sapiens
  misc_feature: GZ8MTXP01A3I1B.19.1.A01.1.454.CMB.2.raw
  modified_base (223)..(223): a, c, t, g, unknown or other
  modified_base (271)..(271): a, c, t, g, unknown or other
  modified_base (311)..(311): a, c, t, g, unknown or other
  modified_base (324)..(324): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtgggctggaggtgaggacgccgtgggtcctggtagtaagttccngcgaaggtcttcgtgggactaccttcacctctattctatcaagtggtnacgacacgccctaggacagggctggagtggagtgggagancgtacttcctttnttagactactccgagacctacgcaacgacgacgttacgagggactagaacgtacaacggacgtaaccggacggaacgtaactacccgaacggtacgactaactaggtacttaagtaacgttagggtaaacgttacggaacccgtaacgtacccgtacggtaaccctaagtaccggaaacgggggtaacgggtaaccccggtaccggttaaccccggtttagtttaaccgttttttacgggaacggtaacccggtaaagtaaacgggaaaacgtaccggtaaacttaacccgtaacgttaccgttacgggacggggtaccggggtaccgttaaacggttacggttacgggaacgtacggtaacgaacggttcgttaacgggtaacggttaaccgggggttaaccggggg

SEQ ID NO: 385474 - DNA, 655 bp, Homo sapiens
  misc_feature: GZ8MTXP01AYRT5.19.1.A01.1.454.CMB.2.raw
  modified_base (332)..(332): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctgggctgaggtgaggaagcctgggtcctcggtgtaaagtttcctgcaaggcttcgtggggactaccttcacctcctattctatcaacgtgggtgcgacaacgcccctaggacaaggcttgagtggatgggagaagctatcccttttnttgatactcagacctacgcacagacgttccgagggcagacgtcacgtacgttaccgacgaacgaactccgaacgagcaacgtagtactatagtaggaacttcgacccgagtaccctaggggaacctagtacgaaacgggtacggaaccgaaccggggtcccgtttaccgttttaacgttttttggtacggtacccggaaacgtaaacggaaaaggttaacggtaaaccgtttacccgtaaactttaaccggttacccgggaaggggttcccggggggcctaaacgttaaccgggtacggtacgacggtaaccgaacggtaacg

SEQ ID NO: 385475 - DNA, 702 bp, Homo sapiens
  misc_feature: GZ8MTXP01C09E0.19.1.A01.1.454.CMB.2.raw
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacagatgtccagtcccaggtgcagctggtgcagtcgtgggctgaggtgaggagccgtgggtcctggtagtaaagtttcctgcgaacggtcttcgtcggggacctacccttcaccttctattctatcaacgtggtcgaccgacacgccccgtaggacgaagggtcttaggaggtggaggtggggaaggaacgccgttacgtttcccctttttagtttacgtaacttaccgtaccaacgtacctacgacaacgaggtaaacgttccgaaggcaagacgtaccacgacttaccggacggtaacaactacgacgacgacacgtagttactaagttagtaggtaacgttcgaaacccgtacgaccgttaacgaaccgaacgtaccgaaacggaaccggtaaccgtaacccgggttaccccgttttagtttaacggttttttcgacggtaaacggtaaacgtaaaggaaaagtacggttaaacctttacccgtaagttaccgttacggaccggggtaacgggaacccgtaacgtaggtaccggagtaacgcgtaacgg

SEQ ID NO: 385476 - DNA, 514 bp, Homo sapiens
  misc_feature: GZ8MTXP01DOV4J.19.1.A01.1.454.CMB.2.raw
  modified_base (276)..(276): a, c, t, g, unknown or other
  modified_base (328)..(328): a, c, t, g, unknown or other
  modified_base (347)..(347): a, c, t, g, unknown or other
  modified_base (378)..(378): a, c, t, g, unknown or other
  modified_base (452)..(452): a, c, t, g, unknown or other
  modified_base (499)..(499): a, c, t, g, unknown or other
  modified_base (503)..(503): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtncgacaagccccctggacaagggcttgagtggatgggagaagcattccctttnttgatactcagacctacgnacagaagttccagggcagatcacgataccgngacgatcacgagcacagtactatatggaattgacagcctggacatcagagacacgcgtactattttgtgcgaanaagaaagagtacttaccgaatacttcgagggcggggccaacgttaancggnagccgaagtcg

SEQ ID NO: 385477 - DNA, 559 bp, Homo sapiens
  misc_feature: GZ8MTXP01BF4TN.19.1.A01.1.454.CMB.2.raw
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctggaggtgaggaagcctgggtcctcggtgaaagtttcctgcaaggcttcgtggggactaccttcacctcctattctatcaacgtggtgcgacaacgcccctggacaagggcttgagtggagtgggagagctacttccctttcttgactactacaagaccctacgtacagtaacgttccgaaagggcaagagtcacgattaccggacggaacgaactcccacgacgcaacagtactatataggaatgacagctagacatacagacggacgaccggccgttcttagttttcgtgacgaacgaagaaagtagttacttaccgagtaccgtcgacgggcggggacaaccgtagtcggcaggacaagcgtaag

SEQ ID NO: 385478 - DNA, 615 bp, Homo sapiens
  misc_feature: GZ8MTXP01CLGR5.19.1.A01.1.454.CMB.2.raw
  modified_base (222)..(222): a, c, t, g, unknown or other
  modified_base (268)..(268): a, c, t, g, unknown or other
  modified_base (319)..(319): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctgaggtgaggaagcctgggtcctcggtgtaagttccngacaaggcttgtgggacaccttcacctctattctatcaactgggtncgacaacgccctggacgaaggcttgagtggagtgggagagctattcctttnttgactactccagactacgcacacgtacgtcgaggcagtaacgtacaacggtacgttacccggacgggtaacaactacccgaagacgacaccgagttactaatagtagggtaatttacgaaccagccttagaacagtacgaaggggacgggaaccgtaccgggtccttagtttaagtttcggtagacgtaacaaggtaaacagtacttaacccagttaccgtacggagggtacggggcttaacgttaggcggccaggccgaggtcgttagtaacggttaacggggttaaccggggg

SEQ ID NO: 385479 - DNA, 570 bp, Homo sapiens
  misc_feature: GZ8MTXP01B39LD.19.1.A01.1.454.CMB.2.raw
  modified_base (330)..(330): a, c, t, g, unknown or other
  modified_base (482)..(482): a, c, t, g, unknown or other
  modified_base (498)..(498): a, c, t, g, unknown or other
  modified_base (525)..(525): a, c, t, g, unknown or other
  modified_base (538)..(538): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctggaggtgaggaagccgtgggtcctcggtagtaaagtttcctgcaaggcttcgtgggacaccttcacctcctattctatcaacgtgggtgacgacaacgccccgtggacaagggcttgagtggagtggggagagcacttccctttnttgactactccagactacgcacgtagaacgttccgagggcagaaacgtcaacggtacttaccgcggtaacaactccgacgacgcacagtctatataggaattgaccacgcctgaactatacagggacggactacggccgttctaagttttgngaccgtagaagaaagngtactccaagttactcggaggccgggnaccgttgttcggnagcgtagcgttagaacgttcgggtaaccgggg

SEQ ID NO: 385480 - DNA, 715 bp, Homo sapiens
  misc_feature: GZ8MTXP01BQHAZ.19.1.A01.1.454.CMB.2.raw
  modified_base (225)..(225): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctggaggtgaggaagccgtgggtcctggtagtaagtttccngcaaggtcttcgtgggactaccttcacctctattctatcaacgtgggtcacgacaacgcccctaggacagggtctggagtggagtggggagaacgctacttccctttcttaggactttacctccgagtacctacgaccgtaacgaaccgtaacggttccgaaggggccaaggtaaccgttaccgaacggtaccgttaacccgggaccgggaacgtaactaccccggaaacggtacgaccaacgtagttactaagtaagtacggtaaactttcgaaccagacccgtagaactaacgttaccgaaggggtaacgggaaccgtaccgggttaccgtttacgtttacgtttttacgggaccgtaaccgaaacgtaaagggtaaagtacggtaactttaacccgtaagtttaccgtacgggacgggtaccggggacttaccggttgttacggccagcgtaacggtccgttaggtcgttaacggggttaaccgggg

SEQ ID NO: 385481 - DNA, 691 bp, Homo sapiens
  misc_feature: GZ8MTXP01ASELC.19.1.A01.1.454.CMB.2.raw
  modified_base (333)..(333): a, c, t, g, unknown or other
tcagtactctcgtgcacgaccggtgctcgatttagacgtctcatcaggggaacaaccacattcctcctctaaagaagcccctgggagcacagctcatcaccatggattggacctggaggttcctctttgcggtggcagcagctacaggtgtccagtcccaggtgcagctggtgcagtcgtggggctgaggtgaggaagccgtgggtcctcggtgaaagtttcctgcaaggcttcgtggggactaccttcacctcctattctatcaacgtggtgcgacaacgccccgtaggacgaagggcttggagtggagtggggaagagctacttccctttnttgacttacctccaagactacgacacgacgtaacgttcgagggacaggaacgttaccaacgtacgttaacccgggacgggaacgaacgtacccgacggaacgaccaacgtacggtactaagtacgtagggtaaacttacgaacccagcccttagaacctagtaccgaagggggaacggaaccggtaccgggtacccgtttacgtttacgtttttacggacggtaaccggtaaacgaaagggtaaaacgtaggtaaccttaaccaaagttaccgtcggaacggggtaccggggacttaacgttcgttacgggaacgacggaactacggcgttagggtaacgttccggggtaaccggggg

SEQ ID NO: 385482 - DNA, 713 bp, Homo sapiens
  misc_feature: GZ8MTXP01D6CQZ.19.1.A01.1.454.CMB.2.raw
  modified_base (228)..(228): a, c, t, g, unknown or other
  modified_base (330)..(330): a, c, t, g, unknown or other
  modified_base (362)..(362): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtgggctggaggtggaggacgccgtgggtcctcggtagtaacgtttccgngacgaaggtcttcgtacgggactaccttcctacctccttattctatacaacgtggtcgcgacaacgccccgtaggacgaaggcttgaggtggagtgggagancgtacttcctttgttagactactcagactacncacagtacgtcgagggccagaacgtacgaacgtacgtaaccggcgggaaaccaacgtacccgaacgacggtaccaaagtaacgttacgtaagtagttaaacggggtaaaactttccgggaaacccgtaccgtaaccgtaacgaaactaacgtaacggaacgggggtaaacggtaacccggttaccgggtttaccgtttagtttaacggtttcggaacggaaaccggtaaagtaaacgttaaacgtaccgttaacctaaccgtaagttaccggtacgggacggggaccgtacttaagttgacggaacgacggtaacgcggtacggttagggtaacggttaacccggggcggg

SEQ ID NO: 385483 - DNA, 650 bp, Homo sapiens
  misc_feature: GZ8MTXP01AVYE1.19.1.A01.1.454.CMB.2.raw
  modified_base (268)..(268): a, c, t, g, unknown or other
  modified_base (294)..(294): a, c, t, g, unknown or other
  modified_base (320)..(320): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctgggctgaggtgaggaagcctgggtcctcggtgaaagtttcctgcaaggcttcgtggggacaccttcacctctattctatcaactgggtncgacaacgcccctggacaaggcttgngtggagtgggagagctacttcctttnttgactactcagactacgactacgaacgagttcgagggcagaagtacaacgtatacccggcggacaacgtccaacgagacctaacgtagtctaaatagttaggaaactttcggaacccacggtcctagacctagtaccgaaggggacggaaccgtaccgggtcccgtttagtttagtttttcggacgtaccgggtaaacctaaagggaaaagtacggtaacctttcccaaaagtttcccgaaccgggaacggggtacccgggggaccttaaaccgttcgggcggaacgacgaacgacgtacgttacggtaacggttaacgggtaacgggg

SEQ ID NO: 385484 - DNA, 592 bp, Homo sapiens
  misc_feature: GZ8MTXP01BVRY9.19.1.A01.1.454.CMB.2.raw
  modified_base (319)..(319): a, c, t, g, unknown or other
  modified_base (492)..(492): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctgaggtgaggagccgtgggtcctcggtgaagtttcctgcaggtcttcgtgggacaccttcacctctattctatcacgtggtgcgacacgccctggacagggtctgagtggagtggggagagctagttccctttntttgacttacgtccagtactacgacacgacgtaacgttcgagggcaggaacgtcaacgtactacccggcgaacgaactccgacgagacatacgtactatagtagtaattacgaccacgccgtagacatacgaagggtacgggaccgtaccggtccgttacgtttagttttggngtacgacgtaaagaaagtgacttaacgattacgcggagggccggggcaacgttgttacgggcgagcgagcgttacggtaacgttcggggttaaccggggg

SEQ ID NO: 385485 - DNA, 631 bp, Homo sapiens
  misc_feature: GZ8MTXP01AYMHD.19.1.A01.1.454.CMB.2.raw
  modified_base (225)..(225): a, c, t, g, unknown or other
  modified_base (276)..(276): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtgggctgaggtgaggaagccgtgggtcctcggtagtaaagtttccngctaaggtcttcgtggggactaccttcacctcttattctatcaacgtggtncgacacgccctggacagggctgagtggagtgggagagctacttcctttgttgatactccagactacgcaacacgaacgttcgaggccagtaacgtcaacgacttacgggacggaacgactacccgacggacacacgtagtctaagtatagggtaaacttacggacctaggcctagaacataccgaaggggacggtaccgaccggtccgttacgtttaagtttcgacggtaccgaagtaaagaaagtctaacgtttaaccaagtttaccgcggttaaggggcccgggtacaaccgttaggcggaacgacggaacgacggtaccgttagggtaacggttaacggggttaaccggggg

SEQ ID NO: 385486 - DNA, 639 bp, Homo sapiens
  misc_feature: GZ8MTXP01EMMMN.19.1.A01.1.454.CMB.2.raw
  modified_base (238)..(238): a, c, t, g, unknown or other
  modified_base (250)..(250): a, c, t, g, unknown or other
  modified_base (273)..(273): a, c, t, g, unknown or other
  modified_base (324)..(324): a, c, t, g, unknown or other
  modified_base (406)..(406): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctggaggtgaggagccgtgggtcctggtagtaagtttcctgcgaaggtcttcgngggactccttcncctcctattctatacactgggtncgacagcccctggacgaggcttggagtggagtgggagaagctactcctttnttgactctccatactacgacatacgagtcgaggtcagacgtacaacgtatacccgggagaccgaaatcccgagacgcaactntacgtatagtggtaaacttcgaaccaggtcctagaacctaagtccgaagggggtacgaccggtaaccggttccgtttacgttacgtttttggacgaccgtaagtaagtaaaacggtctaaaccgttccgttaaacttacggttaccggaggggtacccggggtcttaaccgttggttacgaacggaaccgtgacggtcgttacggtaacgggtttcggggttaacccgggggg

SEQ ID NO: 385487 - DNA, 606 bp, Homo sapiens
  misc_feature: GZ8MTXP01BYXOK.19.1.A01.1.454.CMB.2.raw
  modified_base (337)..(337): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtggggctggaggtgaggaagccgtgggtcctggtgaaagtttcctgcaaggtcttcgtggggacaccttcaccttcctattctatcaacgtgggtgcgacaacgcccctggacaagggctgagtggagtgggaggagctacttcccttttnttgatacctccagaccctacgcacagtaacgtacccgagggcagagtcaacgtacgttaccggacggaacgaactccgaacgacgcaacgtagttactatagtacggtaattcgaccagccctaggactatacgaggacgacgtacggtccgttcgttagttttggacgtacgaagtaaacggaaagttacgtaacttcctaagttacgttacgggacggggttccggggaactacgtaacggtgggaccttaggccgttaacggtcgg

SEQ ID NO: 385488 - DNA, 562 bp, Homo sapiens
  misc_feature: GZ8MTXP01CCMXB.19.1.A01.1.454.CMB.2.raw
  modified_base (271)..(271): a, c, t, g, unknown or other
  modified_base (329)..(329): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagccgtgggtcctcggtgaaagtttcctgcaaggcttcgtggggacaccttcacctcctattctatcaactgggtncgacaacgcccctaggacaagggcttggagtggagtggggaggaagcacttccctttntttgattactccagactacgcacacgacgttcagggcagaagtcaacgataccggcggacgaactccagagcacagtctatatggaattgaccagcctagacatcgagggacggacgacggtccgtattacgttttgacgtaccgataaagaacgagtattccattacgtcgagggtcggggcacgtttgcgggctaggcaggtcttaggtaacgttaacgggtaaccggggg

SEQ ID NO: 385489 - DNA, 697 bp, Homo sapiens
  misc_feature: GZ8MTXP01C5PO6.19.1.A01.1.454.CMB.2.raw
  modified_base (223)..(223): a, c, t, g, unknown or other
  modified_base (237)..(237): a, c, t, g, unknown or other
  modified_base (272)..(272): a, c, t, g, unknown or other
  modified_base (330)..(330): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtgggctggaggtgaggagccgtgggtcctcggtagtaagtttcngacaaggtcttcgngggactaccttcaccttctattctatcaacgtggnacgacaacgccccgtaggacagggtctggagtggatggggagagtctacttccctttnttagtactaccaccagtactacgcacgaacgtaacgtcgaggacagaacgtacaacggtaacttacccgggacggaaaccgaaacgtcccgaaacggacgaccaacgtacggttaactaagtaagttaggaaactttcgacccaaggtcccaagactacgtacgaaggggtacggtaaacccgtaccgggttccgtttacgttttagttttgaggtaaccgtaaacgtaaagggaaaacgttacgtaacttaacccgtaaagttaccggtacgggaacggggtaccggggacccttaaaggttacggttacgggaacacggaaccgttagggacgtttaggaaccggttcgggggttaaccgggggg

SEQ ID NO: 385490 - DNA, 691 bp, Homo sapiens
  misc_feature: GZ8MTXP01AVOH4.19.1.A01.1.454.CMB.2.raw
  modified_base (232)..(232): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtgggctgaggtgaggaagccgtgggtcctcggtagtaaagtttccngcaaggtcttcgtggggactacccttcacctcctattctatcaacgtgggtgacgaacgaacgccccgaggacgaagggtctggagtggagtggggaaggaagcctactttccccttttgttagtactactaccgagtaccctacgacacgaacgtacgttaaccgagggcaaggagtaccgacgtacgttacccggacgggtaaacgaactaccgaacgacggaccaacctaggttacctaagttaacgtagggaaacttcgaaccctaggtaccccttaggggaacttaaggaccgaaacgggaccgaccgtaacccggtccggtttactttacgtttttcggagacccggtaaagaaacggtaaaagggttactaacgttacgtaaacgttacgaccggacgggggttacgggaaccctaaagttcgacgggacgacggtccgaaggttaacccgg

SEQ ID NO: 385491 - DNA, 601 bp, Homo sapiens
  misc_feature: GZ8MTXP01AM2GD.19.1.A01.1.454.CMB.2.raw
  modified_base (342)..(342): a, c, t, g, unknown or other
  modified_base (516)..(516): a, c, t, g, unknown or other
  modified_base (555)..(555): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtgggctggaggtgaggaagccgtgggtcctggtagtaaagtttcctgcgaaggtcttcgtgggactaccttcacctcctattctatcaacgtggtcgcgacaacgccccgtaggacgaagggtctggagtggagtgggaagagctacttccctttnttagactactccagtaccctacgacacgagtacgttaccgagggtcagacgtacacggtactaccggacgaacgaactccgaacgacgcacgtagtactatagtaggaattcgaacagccgtagactagtacgaggacgacgtacgtcgttacttagttttcgagaccgtaaanaaggtaaagttacgtacttacgaacgtacgttaccgggnggggaccgggtaactacgtgtacggcgacggcgttaacggtaacgg

SEQ ID NO: 385492 - DNA, 582 bp, Homo sapiens
  misc_feature: GZ8MTXP01BCPSG.19.1.A01.1.454.CMB.2.raw
  modified_base (272)..(272): a, c, t, g, unknown or other
  modified_base (323)..(323): a, c, t, g, unknown or other
  modified_base (499)..(499): a, c, t, g, unknown or other
  modified_base (521)..(521): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttcgtggggactaccttcacctcctattctatcaacgtgggtncgacaacgccctaggacaagggctgagtggagtgggagagctactcctttnttgatactccagactacgacacgacgtaagttccgaggcaggaagtccaacgtactaacccggcggtaacgaactccgacgagacacagtctatataggtaattcgactagcctagactatacgagggacggacgtaccggtccgttattacgttttgacgacgaactaagaaagngtaactaacgattaccgtacgngggtccggggacaacgttgttggaacaggaacagcgttaggaacgttaacgggtccggggg

SEQ ID NO: 385493 - DNA, 716 bp, Homo sapiens
  misc_feature: GZ8MTXP01CBWD0.19.1.A01.1.454.CMB.2.raw
  modified_base (226)..(226): a, c, t, g, unknown or other
  modified_base (277)..(277): a, c, t, g, unknown or other
  modified_base (326)..(326): a, c, t, g, unknown or other
  modified_base (335)..(335): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctggaggtgaggaagccgtgggtcctggtagtaaagtttccngacaaggtcttcgtggggactaccttccacctcctattctatcaagtggtncgacacgcccgtaggacaggctgagtgagtgggagagctacttcctttnttgactacncgagactacgcacaacggtacttcgaggacagaacgtaccaacgtacgttaacccggacgggaacaacgtacccgacgacgacctaacgtaaggtactaagttaagtacggtaaacgtttcgaacctacgaccgttacgaactacgtacgaaacgggggtacggaacccggtaccgggttaccccggtttatttaacggtttttcggacggtaaaccggtaaacgtaaacgggtaaaacgtaccgttaaacgttaacccgtaaacgttacccggttaccgggaaacgggggtacccggggtaacttaaaccgggttagttaccgggaacgtaacgcgtacggtaccgttacggtaacgggttaaccgggtaacccgggggg

SEQ ID NO: 385494 - DNA, 612 bp, Homo sapiens
  misc_feature: GZ8MTXP01BH890.19.1.A01.1.454.CMB.2.raw
  modified_base (238)..(238): a, c, t, g, unknown or other
  modified_base (274)..(274): a, c, t, g, unknown or other
  modified_base (329)..(329): a, c, t, g, unknown or other
  modified_base (493)..(493): a, c, t, g, unknown or other
tcagtactctcgtgcacgaccggtgctcgatttagacgtctcatcagggggaacaaccacattcctcctctaaagaagcccctgggagcacagctcatcaccatggactggacctggaggttcctctttgcggtggcagcagctacaggtgtccagtcccaggtgcagctggtgcagtctggggctggaggtgaggagccgtgggtcctcggtgaaacgtttcctgcaaggtcttcgnggggactaccttcacctctattctatcaacgtggtncgacaacgcccctaggacaagggctggagtggagtggggagagctattccctttnttgatactccagtactacgcacgacgtacgtcgagggcagaacgtcaacggtacttaccggacggacgtaactccgaagacgacacgagtactagtagtaggtaaacttgaccagtcctagaacatacgagggacggacgtacggccgttacttagtttttcgngaaccgtagaaggaaacgtacgtacttaacaagttaccgtacggacgggaccggggacaacggttagttcgggaacagcgacggtcgttacggtaacgttaacgggggttaacccgggg

SEQ ID NO: 385495 - DNA, 615 bp, Homo sapiens
  misc_feature: GZ8MTXP01A4RHX.19.1.A01.1.454.CMB.2.raw
  modified_base (209)..(209): a, c, t, g, unknown or other
  modified_base (216)..(216): a, c, t, g, unknown or other
  modified_base (252)..(252): a, c, t, g, unknown or other
  modified_base (302)..(302): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtgggctgaggtgaggagctgggtctggtanaagttcngcagctgtgggacactcactctattcatcagtggtncgacacgccctggacgaggctggagtggagtggggagagctattcctttnttagatactccagactacgcacgaacgacgttcgaggacagtaacgtcaacgacttaacccgggccggtaacgaactcccggaagacgacactagtactatacgtagaagttacgaccacgtccagactacgtacgacggaacggaccgtaaccggtccgttacgtttacgttttcggtacggtaaacgaaccgtaaagtaaaggtacgtaactttaaccgaacgttaccgtacgggacggccggggtacttaacggttcgttacggaaccgagaacgacggtgttacggtcggttaaccgggtaaccggggg

SEQ ID NO: 385496 - DNA, 629 bp, Homo sapiens
  misc_feature: GZ8MTXP01CPCNF.19.1.A01.1.454.CMB.2.raw
  modified_base (285)..(285): a, c, t, g, unknown or other
  modified_base (342)..(342): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtggggctggaggtgaggaagccgtgggtcctggtagtaaagttcctgcaaggtcttcgtgggacctacccttcaccttcctattctatcaacgtgggtncgacaacgccccgtaggacaaggtctggagtggagtagggagagctactttcctttnttgactactcagaccctacgcagagtacgttacgagggtcaggtacgtacacgtacgtaccggacggaaccaactccgaacgacgtacacgtagttactaatagtagtaacttcgaaccgtagaccgttaggactagtacgaacggtacggaacccgtaccgggttcctttacgtttagttttcggacgtacgaacgtaaaggtaaacgagtaacttaccgtaaacgtacgttcggacggggttaccgggtaactacgtaagtacggcgttagccgttaagtaacgg

SEQ ID NO: 385497 - DNA, 624 bp, Homo sapiens
  misc_feature: GZ8MTXP01ASQN9.19.1.A01.1.454.CMB.2.raw
  modified_base (223)..(223): a, c, t, g, unknown or other
  modified_base (269)..(269): a, c, t, g, unknown or other
  modified_base (322)..(322): a, c, t, g, unknown or other
  modified_base (586)..(586): a, c, t, g, unknown or other
  modified_base (594)..(594): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtgggctggaggtgaggagccgtgggtcctggtagtaagtttccngcaaggtcttcgtgggactaccttcacctctattcatcacgtggtncgacaacgcccgtggacgaggtctggagtggagtgggagagctacttcctttnttagacttactccgagactacgacaacgaacgtaacgtcgagggacaaggaacgtacaacggtacgtacccgggacggaacgtaacgcccgaacggacgacaacgtacggtactaagtaagtaggtaacgttacgaccagcctagacagtaccgaggggacgacgtaccggtaccgttacttagttttcgagtacgaacgtaaagaaacgtagtaacttaacgaacgttacgtacggacgggtacgggtacacgttagcggaanacgaacgngacgttaggtaacggttcgggtaaccgggg

SEQ ID NO: 385498 - DNA, 589 bp, Homo sapiens
  misc_feature: GZ8MTXP01C40S0.19.1.A01.1.454.CMB.2.raw
  modified_base (231)..(231): a, c, t, g, unknown or other
  modified_base (343)..(343): a, c, t, g, unknown or other
  modified_base (487)..(487): a, c, t, g, unknown or other
  modified_base (534)..(534): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtggggctggaggtggaggagccgtgggtctggtagtaacgttccngacaaggtcttcgcgggactaccttcacctctattctatcaagtggtcacgaacgaacgccccgtaggacgaggtctggagtggagtagggaagacgtctactttccctttnttagactactacacgtacctacggacaacgagtaacgttaccgaggcaggtacgtacgaacgtacgtaccggacgaaacgaactaccgaggacgacaactagtacgttaaatacgtaggtaattcggacaacgtccaggactanacgaggacgtacgcggtctttagttgttgacgacaagaagtaaacgntacttacaacgttcacgggacgggccggtaatacgtgcggacttgaacgcgtaag

SEQ ID NO: 385499 - DNA, 691 bp, Homo sapiens
  misc_feature: GZ8MTXP01BFCA4.19.1.A01.1.454.CMB.2.raw
  modified_base (280)..(280): a, c, t, g, unknown or other
  modified_base (334)..(334): a, c, t, g, unknown or other
  modified_base (593)..(593): a, c, t, g, unknown or other
tcagtactctcgtgcacgaccggtgctcgatttagacgtctcatcaggggaacaaccacattcctcctctaaaagaagcccctgggagcacagctcatcaccatggactggacctggaggttcctctttgcggtggcagcagctacaggtgtccagtcccaggtgcagctggtgcagtcgtggggctggaggtgaggaagccgtgggtcctcggtagtaaagtttcctgcaaggtcttcgtggggactaccttcaccttcctattctatcaacgtgggtncgacaacgcccctaggacaagggctggagtggagtgggagagctacttcctttntttgactactccgagactacgacacacgtaacgtcgagggcagaacgtccaacgtactacccggacggacgaactaccgacgacgacaacgaggttactagttaactgggttaaaacttcggaacctaggtaccctaggaaccagtaccggaagggggaccgtaaccggtccggttacgtttacgtttacggttggaccgtaacgaaacggaaacgaaaggttacgttaacctaacgttaaccgttacgggaaccgggngggggtaacccgggtaacttacggttacggcggtaacgaaccggcccggtaaggtccggttaaacgggtccggggttaaccgggggtaaccccggggg

SEQ ID NO: 385500 - DNA, 707 bp, Homo sapiens
  misc_feature: GZ8MTXP01CIZPO.19.1.A01.1.454.CMB.2.raw
  modified_base (277)..(277): a, c, t, g, unknown or other
  modified_base (335)..(335): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctggaggtgaggaagccgtgggtcctcggtagtaaagtttcctggcaaggcttcgtgggactaccttcacctcctattctatcaacgtgggtncgacaacgcccctggacaagggcttggagtggagtggggaggaagctacttccctttntttgagttacctccagtacctacgcacgaacgaagttccgagggtccaagaacgtaccaacgtaacgttaacccgggacgggtaacgaactcccgaacgacgcaacgtagtacgtaatacgtaggtaattacgaccaaggccctagaactagtacgaaggggaacggaccgtaccgggtcccgttactttaagtttttcggacgtaaccggtaaccgaaagggtaaaacgtaacggtaactttaacccgtaacgttaaccgttacgggaaaccgggggaccggggtaaccttaacccggttagttacggggtaaccgaacggccgtaaacggtcggttacgggtaacggttaacgggggttaacccgggggg

SEQ ID NO: 385501 - DNA, 599 bp, Homo sapiens
  misc_feature: GZ8MTXP01D45OY.19.1.A01.1.454.CMB.2.raw
  modified_base (230)..(230): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtgggctggaggtgaggagcctgggtcctcggtagaaagtttccngcgtaaggtcttcgtggggactacccttcaccttcctattctaatcaacgtgggtgcgaacacgcccctggacaaggcttgagtggagtgggaagagctacttcctttcttagtactactcagtaccctacgacacgagtaacgttacccgagggcagacgtacgacgtacgttaccggacggacgtaacgtaccagacgacactagtacgtatagtaggaattcgacagcctagaacatcgaagacgacgtaccggtcgttacttagttttcgtcgtacgaacgaaagtaaggacgtatttaccaaagtaccgttacggacggggccggggtaacacgtaagtacggacgacgaaccgttgtaaccgg

SEQ ID NO: 385502 - DNA, 787 bp, Homo sapiens
  misc_feature: GZ8MTXP01EL7IF.19.1.A01.1.454.CMB.2.raw
tcagtactctcgtgcacgaccggtgctcgatttagacgtctcatcagggggatcacataacaaccacattcctcctctaaagaagcccctgggagcacagctcatcaccatggactggacctggaggttcctctttgcggtggcagcagctacaggtgtccagtcccaggtgcagctggtgcagtcgtggggctggaggtgaggaacgccgtgggtcctcggtagtaaagtttcctgacaaggtcttcgtgggactccttcacctctatctatcaacgtggtcacgacacggccccctaggaacaagggtcttaggaggttagggatagggggaaggaacggtctaacgtttccccgttttagtttagtaacttaccgtaccgtaacggtaacccctaaccggacaaacccgtaagggtaaaccgtttaacccgaagggggccaaagggtaacggtaccgaaccgtaaccgttaacccgggacgggtaaacccgtaaactacccgaaacgtaaccggacaaccgtaaggtttacctaaagttaacggttaagggaacttacgaacccgtaaacgccccgttaaaggggaacctaaacgtacggaaacggggaaaccggtaccggtacccgggttaccgttttaacggtttacggttttacggtaaccggaaccggtaaagtaaaacggtaaacgttaccgtaacttaacccgaagttaacccggacggggttacggggacccgggtaagtacgttaacggacggaccgagtaaccgttaacgtaacg

SEQ ID NO: 385503 - DNA, 659 bp, Homo sapiens
  misc_feature: GZ8MTXP01C4YZO.19.1.A01.1.454.CMB.2.raw
  modified_base (579)..(579): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtggggctggaggtgaggaagccgtgggtctcggtgtaaagttcctgcaggtcttcgtggggactccttcacctcctattctatcaacgtgggtgcgaacacgcccctaggacaaggcttggagtggagtgggagagctattcctttcttgactactcacgaccctacgacacgaacgtaacgttacccgaggggcaaggtacgtaccaaacggtacgttacccggacgggaaaccgtaacgtacccgaaacggacgtaacctaaggttacctaagttaacgttagggtaaactttacggaacctacgaccttacggaactacgtacgaagaacgggaccgtacccggtccgtttacgtttaacgttttcgtagtacgaacgaacggtaaaagngttaacgtaccttaacgtaacgtcgacggggcggggactaaccgttagtcggacgacggaccgtaaggttccgttaaggg

SEQ ID NO: 385504 - DNA, 645 bp, Homo sapiens
  misc_feature: GZ8MTXP01AEJHD.19.1.A01.1.454.CMB.2.raw
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtgggctgaggtgaggagccgtgggtcctggtagtaaacgttctgacgaaggtcttcgtgggactaccttcacctcttattctatcaacgtgggtgacgacacgccccgtaggacgaagggtcttggacgtggagtgggaagagctatttccctttgttagactactccacgtaccctacggacaacgtacgtacgttaacgagggcgagacgtcgaacgtacgttaccggacgaaacgactacccgacggacgactaacgagtacctaagtagtacggtaaacttcgaacctacgtaccttacggaacgagttacgaacgggtaacgaacccgtacggttccgtttaacgtttagttttcgacgtaccgtaagaacgtaaagttacgtacttacccgaaagtaccgttcggaacgggccggggtaactacgtaacggtcggacgttagcgcgtaacggg

SEQ ID NO: 385505 - DNA, 604 bp, Homo sapiens
  misc_feature: GZ8MTXP01C2MJS.19.1.A01.1.454.CMB.2.raw
  modified_base (225)..(225): a, c, t, g, unknown or other
  modified_base (332)..(332): a, c, t, g, unknown or other
  modified_base (413)..(413): a, c, t, g, unknown or other
  modified_base (515)..(515): a, c, t, g, unknown or other
  modified_base (536)..(536): a, c, t, g, unknown or other
tcagtactctcgtgcacgaccggtgctcgatttagacgtctcatcaggggaacaaccacattcctcctctaaaagaagcccctgggagcacagctcatcaccatggactggacctggaggttcctctttgcggtggcagcagctacaggtgtccagtcccaggtgcagctggtgcaggtcgtgggctggaggtgaggaagccgtgggtcctcggtgaaagtttcngcaaggtcttcgtggggactaccttcacctcctattctatcaacgtggtgcgacaacgccccgtaggacgagggcttggagtggagtggggagagctacttcctttnttgattctccagactacgcacgacgaacgttcgaggcagaacgtacaacgacttaccgggcggaagaccgtaccacgtaanccgtaacgagttcaattagtagggtaaattcgaacctagcctagacataccgaggggacggacaccgggtccttatttacgtttgacgtacgaagtaagaanagtactaaccaagttaccggngttacggcggggtcttaacgttagcggcgtaacgcgtaagcgttggtaaacggttcgggtaaccgggg

SEQ ID NO: 385506 - DNA, 697 bp, Homo sapiens
  misc_feature: GZ8MTXP01CUKXO.19.1.A01.1.454.CMB.2.raw
  modified_base (223)..(223): a, c, t, g, unknown or other
  modified_base (270)..(270): a, c, t, g, unknown or other
  modified_base (448)..(448): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctgaggtgaggaagccgtgggtcctcggtagaagtttcngcaggtcttcgtgggactaccttcacctctattctatcaagtggtcncgacaacgccccgtaggaacgaagggtctaggagtggaagtggggaacgagctactttccctttcttgacttactccagactaacgacacgaacgtacgttacgaggtacagtaacgacaacggtacgtaacccggacgggaaacaacgtcccgaacgacgacacgtagtctaagtanagggtaacttcgaaccgacgtccttagactaacgtacgaacggggaacggtacccgaaccggttacccggtttacgtttaacgtttttcggacggtaaaccgtaaccgtaaaaggaaacgtaagtaaccttaacccgtaaacgttaaccttcgggaacggggtacccggggtacttaacccgtttagggcggaacctaggaacgtacggtacgttacgggtaacggttaaccgggggttaacccggggg

SEQ ID NO: 385507 - DNA, 635 bp, Homo sapiens
  misc_feature: GZ8MTXP01AI3GH.19.1.A01.1.454.CMB.2.raw
  modified_base (224)..(224): a, c, t, g, unknown or other
  modified_base (326)..(326): a, c, t, g, unknown or other
  modified_base (329)..(329): a, c, t, g, unknown or other
  modified_base (414)..(414): a, c, t, g, unknown or other
  modified_base (594)..(594): a, c, t, g, unknown or other
tcagtactctcgtgcacgaccggtgctcgatttagacgtctcatcagggggaacaaccacattcctcctctaaagaagcccctgggagcacagctcatcaccatggactggacctggaggttcctctttgcggtggcagcagctacaggtgtccagtcccaggtgcagctggtgcagtcgtggggctggaggtgaggagccgtgggtcctggtagtaagtttcngcgaaggtcttcgtgggactaccttcacctctattctatcaacgtggtgcgacacgcccgtggacgagggtctggagtggagtggggagagctacttccttnttnactactacagtactacgacacgacgtacgtcgaggcaggaactacgaacgtacgtaccgggacggacgactacgacgacgctaanacggttactaagttaagtagggtaaacttcggaacccagtccctagaactatacggaacggggacggaccgtacggtcccgtttattagttttgggacgtaacgaacgtaaggtaaacggtactacgtaactaacgttacgtacgggacgggtaccgggacttacgttacggcggaacgnggtaacacggcgttacgtaacgggttcgggtaacccggggg

SEQ ID NO: 385508 - DNA, 708 bp, Homo sapiens
  misc_feature: GZ8MTXP01B4OQB.19.1.A01.1.454.CMB.2.raw
  modified_base (276)..(276): a, c, t, g, unknown or other
tcagtactctcgtgcacgaccggtgctcgatttagacgtctcatcaggggaacaaccacattcctcctctaaaagaagcccctgggagcacagctcatcaccatggactggacctggaggttcctctttgcggtggcagcagctacaggtgtccagtcccaggtgcagctggtgcagtcgtgggctgaggtgaggaagccgtgggtcctcggtagtaagtttctgacgaaggtcgttcgtcgggactaccttcacctctattctatacaagtggtnacgacacgcccgtagacgaggctagagtggagtggggagaacgtctactttccctttgtttacgacttaccgtcaacgtacctacgactaacgacgtaacgtcggagggaccaggtaacgtaccgaacgtacgtacccggacgggtaaccgaaactcccgaacggaacgtacaagtacgtactagtacgtaaggtaacttacgaacacgactaacgacaactacgaaggggaacggaccgtaccggtaccgtttacgttagttttcgaacggtaacgaacgtaaacggaaacgtaaacgttaacttaaccgtaacgttacccgtaggggttaccgggtacggggtaacccttaaacggttcggttacggaacgacggtaacgacgggtaccgttaagggtaacccggttaacgggggtttaaccccgggggg

SEQ ID NO: 385509 - DNA, 690 bp, Homo sapiens
  misc_feature: GZ8MTXP01CB1Q1.19.1.A01.1.454.CMB.2.raw
  modified_base (223)..(223): a, c, t, g, unknown or other
  modified_base (332)..(332): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctggaggtgaggagcgtgggtcctggtagtaagtttccngcaaggtcttcgtgggactaccttcacctctattcatcacgtggtcgacgacacgcccgtaggaacgagggtctaggaggtggagtggggagacgctactttccctttnttagactacgtacgacgtactacgcaacgacgtaacgtcgagggtacaggtaacgtaccgaacggtaccgttaacccgggacgggaaactaacgtacccgaaacggactacccgaacgtaaggttacctaaagttaagtaacgggtaactttaccggaaaccgtacgtacccgtaagaaccgtagtaacccggaaaggggaaccggtaaccgtaccgggtccccgtttaagtttacgttttcggacggtaaaccgaacgtaaagaaacgtacgtaacttaacccgaagttaccggtcggacgggtcggacttaacgttgacggcaagctagcgttaggtaacgttcggggtaaccggg

SEQ ID NO: 385510 - DNA, 653 bp, Homo sapiens
  misc_feature: GZ8MTXP01A9Y96.19.1.A01.1.454.CMB.2.raw
  modified_base (283)..(283): a, c, t, g, unknown or other
  modified_base (349)..(349): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtgggctggaggtgaggaagccgtgggtcctggtagtaaagtttcctgcgaaggtcttcgtgggactaccttcacctctattctatcaacgtgggtcncgacacgcccgtaggactaagggcttggagtggagtaggggaagacgtctacgtttccctttgttnactactcagtaccctacgcacgacgtaacgtccgagggcaagtacgtccgaacgtacttaccgggacgtaaacgaactaccgaacggacgaccaacgtacgtacttaagtagttagggtaaacttacgaacctacggtacccttaggggaactaacgtaccgaacgggtaaccggaccgtaccggttacgtttactttaggttttcgacgtaccgaagaaagtaaacgttactacgttaaccgacgtaacgttacgggcgggttacggggaactacggttaagcggacgacgtcgaacggtcgg

SEQ ID NO: 385511 - DNA, 675 bp, Homo sapiens
  misc_feature: GZ8MTXP01EIBK6.19.1.A01.1.454.CMB.2.raw
  modified_base (232)..(232): a, c, t, g, unknown or other
  modified_base (361)..(361): a, c, t, g, unknown or other
  modified_base (374)..(374): a, c, t, g, unknown or other
  modified_base (454)..(454): a, c, t, g, unknown or other
  modified_base (646)..(646): a, c, t, g, unknown or other
tcagtactctcgtgcacgaccggtgctcgatttagacgtctcatcaggggaacaaccacattcctcctctaaaagaagcccctgggagcacagctcatcaccatggactggacctggaggttcctctttgcggtggcagcagctacaggtgtccagtcccaggtgcagcgtggtgcagtcgtggggctggaggtggaggacgccgtgggtcctacggtagtaacgtttccgngacgaacggtcttcgtcggggacctaccgttcctaccttccttattctatacgaacgtgggtcgacgaacacgcccctaggaacgaaggtctggaggtggaggtaggggagaacgtctacgttcctttntttacgacttacncgagtactacacgagtaacgtacgtacgacggagacgaacgtacaacgtacgtaccgggacgacgacgtacacgacacgnacgtacagtagtagtaattcgacaggcctagactatacggaggggtaaccgtacgaaccggttcttaacgtttaacgtttcggacgtaaacccgtaaaggtaaagaaacgggtaccttaaccttaacgaacgtttacgggacggttaccggggtaccggacaaacggttccggaggtaacaccgtaacgggngtacgaggtaacggttaacgggtaacggg

SEQ ID NO: 385512 - DNA, 780 bp, Homo sapiens
  misc_feature: GZ8MTXP01BF0LR.19.1.A01.1.454.CMB.2.raw
  modified_base (228)..(228): a, c, t, g, unknown or other
  modified_base (277)..(277): a, c, t, g, unknown or other
  modified_base (327)..(327): a, c, t, g, unknown or other
tcagtactctcgtgcacgaccggtgctcgatttagacgtctcatcaggggaacaaccacattcctcctctaaagaagcccctgggagcacagctcatcacaatggactggacctggaggttcctctttgcggtggcagcagctacaggtgtccagtcccaggtgcagctggtgcagtcgtggggctggaggtggaggaagccgtgggtcctcggtagtaaagtttccngacaaggtcttcgtgggacaccttcacctctattctatcaacgtgggtnacgacacgccctggacaggctgagtggagtgggagagctacttccgtttnttagacttactcagtactacgcacgacgtaacgttcgaggcagaaatccgaacggtacgttaacccggacgggaaccgtaacgtcccgaaacggtacgaccaacgtacgtaacttaataagttacggtaaacgtttcgaaccgtacgacccgttacggaaactacgttaaccgaaagggggtaaacccggggtaacccggtaacccggggtttacccgtttaaaccgtttttaacggttttttaccggggaccggttaaaaccccgggtaaacggtaaagggtaaaaacggggttaacttaaacccgtttaaccccgtaaaacgggtttaacccggttaccgggttaaaccggggggacccggggtaccgttaaaacccgggttagttaccgggtcgacgggaactacgggtacgttacgggtaaccgggttaaccgggggttaacccggggg

SEQ ID NO: 385513 - DNA, 635 bp, Homo sapiens
  misc_feature: GZ8MTXP01AYRTU.19.1.A01.1.454.CMB.2.raw
  modified_base (256)..(256): a, c, t, g, unknown or other
  modified_base (286)..(286): a, c, t, g, unknown or other
  modified_base (349)..(349): a, c, t, g, unknown or other
tcagtactctcgtgcacgaccggtgctcgatttagacgtctcatcagggggatcacataacaaccacattcctcctctaaagaagcccctgggagcacagctcatcaccatggactggacctggaggttcctctttgcggtggcagcagctacaggtgtccagtcccaggtgcagctggtgcagtctggggctggaggtgaggaagccgtgggtcctcggtagtaaacgtttcctgcgaaggtcttcgtggggacnccttcacctcctattctatcaacgtggtcncgacaacgtccccgtggacaagggcttaggacgtggagtggggagaacgctactttccctttntacgactactcgagaccctacgacacgagtacgttccgagggcagacgtacgaacgtacttaccggacgtaaccgaactccgaacgaggaccaactagtacctaatagtaggaacttacggaacctagacccgtagggacacgtacgaacggtacggaaccgtcccgggtactttacgttaacgtttttgacgtacgaacgtaaaggaaacggttagtacttaccctaagttaccgcggaacggggcccggggtaactacgtcggtcggacgacgtcgaacggtcg

SEQ ID NO: 385514 - DNA, 674 bp, Homo sapiens
  misc_feature: GZ8MTXP01DNHGH.19.1.A01.1.454.CMB.2.raw
  modified_base (225)..(225): a, c, t, g, unknown or other
  modified_base (235)..(235): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtgggctggaggtgaggagccgtggtctggtgtaagttcngcagcttcgngggactccttcacctctattctactcacgtgggtgacgacacgccccgtggacgaggtctggagtggagtgggaagagtctactttcctttagttagtactaccgtcaacgtacctaaccgacaaccgtaagtaaccgttacccggagggtcaaggtacgttaccgaacgtaacgttacccgggacgggtaacaaccgtaccaacggtacgacaacgtagtacttaaagtacgtacggtaaacttcaaccccggtagcccgttagggaaccctaacgtacggaacggaaccggtaccgtacccggttaccgttttacgtttaacggttttcgaccgggaccgtaaaggtaaaacgaaacggttaacgtaccttaccgaaacgttcgttccgggaacgggttcggggaacaacgttggacggccgaggtccgaaggtcgg

SEQ ID NO: 385515 - DNA, 649 bp, Homo sapiens
  misc_feature: GZ8MTXP01EP8CX.19.1.A01.1.454.CMB.2.raw
  modified_base (240)..(240): a, c, t, g, unknown or other
  modified_base (642)..(642): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagcgtggtgcaggtcgtggggctggaggtgagggaacgccgtgggtccgtcggtagtaaacgtttccngcgaaggtcttcgtgggacctacccttcacctccttattctatcgaacgtgggtcgcgacacgcccctaggacgaggcttggagtggagtgggagagctacttccctttattgactactacacgtacctacgacaacgagtacgttaaccgagggtcgagacgtacacgtagttacccggacggaaccgtaacgtaccgaacggacgacgtacgacgttacgtaagttacgtaggtaagttacgaaccgtacgaccgtacggactaacgtacgaacggaacggaccgtacccggttccgttacgttttaagtttggttacgaccgtaaagaaaggtaaagacgtacgttacaacgttccacggttcgggacggggtaacacggtaacgtcggagacgaacgngtaacgg

SEQ ID NO: 385516 - DNA, 604 bp, Homo sapiens
  misc_feature: GZ8MTXP01A150H.19.1.A01.1.454.CMB.2.raw
  modified_base (228)..(228): a, c, t, g, unknown or other
  modified_base (273)..(273): a, c, t, g, unknown or other
  modified_base (286)..(286): a, c, t, g, unknown or other
  modified_base (341)..(341): a, c, t, g, unknown or other
  modified_base (376)..(376): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtgggctggaggtgaggagcgtggtcctggtagtaacgttccngcaggtctcgtgggactaccttcacctctatctatcacgtggtcncgacacgtccccnggacgaaggcttggagtggagtaggggagacgtctactttcctttgttgactacnccgagaccctcgacacgagtacgtaccgagcagcncacgactacgacgacactcgagacgacacgagtacagtagaggtatacgacagcctagggactagtacgaggtaccgacgaccggtacttacgtttacgttttggactacggaactaaaggaaagttacggttaaccttacccgtaagttaacccggacgggttacggggccggggtaacccctcggtttaaggcggggaccttaccgggttaacgaacggttcccgg

SEQ ID NO: 385517 - DNA, 581 bp, Homo sapiens
  misc_feature: GZ8MTXP01BLQZN.19.1.A01.1.454.CMB.2.raw
  modified_base (238)..(238): a, c, t, g, unknown or other
  modified_base (290)..(290): a, c, t, g, unknown or other
  modified_base (392)..(392): a, c, t, g, unknown or other
  modified_base (528)..(528): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcaggtcgtgggctggaggtgaggaacgccgtgggtccgtacggtagtaaacgtttccngacaaggtcttcgtcgggtactacccttccacctcctattctatcacgtggncgacacgcccgtaggacgaggtctggagtggagtagggaacgagtctactttcccttttgttagactactacgacgacctacgacacgagtacgtacgaggnagacgtacacgacgttaccggacgaacactacgacgagacacgtatactagtagtaggacttacgacacgcctagggactagacaagggacgccgtacggtcttacgttagtttcgacgtaccgaagaagtaaagngttacttacgacgtagttcgacggggttcgaacctagcgagcacgcgaagtcg

SEQ ID NO: 385518 - DNA, 688 bp, Homo sapiens
  misc_feature: GZ8MTXP01EVSZD.19.1.A01.1.454.CMB.2.raw
  modified_base (235)..(235): a, c, t, g, unknown or other
  modified_base (269)..(269): a, c, t, g, unknown or other
  modified_base (319)..(319): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctgaggtgaggaagcctgggtcctcggtgaaagtttcctgcaaggcttcgnggggacaccttcacctcctattctatcaatggtncgacaacgccctggacaaggctgagtggagtgggagagcacttccctttnttgatactccagacctacgcacaacgtacgttacgaggggccaaggaacgtacaaccggtacgttacccgggacgggaaccgtaaacgtcccaaacggtacgccgaacacgttactaactaagtagggtaaacttcgtaaccaacggccctaggacccaagttacccaaggggtacgggtaaccaccgggggtccccttaccgtttagtttttccggtacgtaacgtaacgaaaggtaaaaggccgttaaatttaaccccaaatttacgaccggttaaacgggggcgggggtacccttaaacgttcggttacgggcgaacgcccgtaaggtaccgttagggtaacgtttcccgggggttaaccgggggg

SEQ ID NO: 385519 - DNA, 679 bp, Homo sapiens
  misc_feature: GZ8MTXP01ELXAU.19.1.A01.1.454.CMB.2.raw
  modified_base (174)..(174): a, c, t, g, unknown or other
  modified_base (569)..(569): a, c, t, g, unknown or other
tcagtactctcgtgcacgaccggtgctcgatttagacgtctcatcaggggaacaaccacattcctcctctaaaagaagcccctgggagcacagctcatcaccatggactggacctggaggttcctctttgcggtggcagcagctacaggtgtccagtcccaggtgcagctggtncagtcgtgggctggaggtgaggacgcgtcggtcctacggtagtaacgttcctgctaggtcttcggtcgggacctaccttcacctctattctatcagtggtcacgacacgccctaggaacagggtctaggagtggaggtaggggagactccgttactttcccttttagtttagaccttacgtacgaacgtaccgtacgactaacgaacgtaccgtaccgaggacacggtaacgtcaacggttaacgtaacccggaccgaaacgtaaactcccgggaaagacgtccaaacgttacggtattaaggttacgtaggttaaaccttcgaaccgacgtcaagactaagtcgaagggggaccgacgtaccgttcgtttaattcgtttcgaacgacgttaaanaaggtaactcgtactaacgtgttaccgcggttagggtaccggaattaccggttaggacgtcccgaagtcgtacccggtgttaggtaacccggttcggggttaaccggggg

SEQ ID NO: 385520 - DNA, 514 bp, Homo sapiens
  misc_feature: GZ8MTXP02JKFR2.19.1.A01.1.454.CMB.2.raw
  modified_base (445)..(445): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactggtgcgacaagcccctggacaagggcttgagtggatgggaggaagcatccctttcttgatactccagactacgcacagaagtccagggcagagtcacgattaccgcggacgaatccacgagcacagtactatatggaattgaccagcctagacatcagaggacacggccgtctacttttgngtcgacagaaagagattacgatactcaggcgggcacgtagtgcgagcgacgctacgagtacggtagggg

SEQ ID NO: 385521 - DNA, 584 bp, Homo sapiens
  misc_feature: GZ8MTXP02G2HZB.19.1.A01.1.454.CMB.2.raw
  modified_base (268)..(268): a, c, t, g, unknown or other
  modified_base (441)..(441): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactggtncgacaagcccctggacaagggcttgagtggatgggaggaagtctacctttcctttgtagtactcacgactacgtcacagaacgtacgacgagacgagtacgacgacgttacgtacggacggaactaccacgaaacgaacagtactaactataggaagtataccacgactcganactacagaggacgacgtccggtaccttagttttagttgacgacgaagaaagaagacttactactaaactcgacggacgggggaccgacttagtacggcgacgaacgacgacgtacgtacgtacggtacgggtacgggtacggg

SEQ ID NO: 385522 - DNA, 512 bp, Homo sapiens
  misc_feature: GZ8MTXP02JOK6X.19.1.A01.1.454.CMB.2.raw
  modified_base (322)..(322): a, c, t, g, unknown or other
  modified_base (444)..(444): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaaggcttgagtggatggagagcatcctttnttgatactcagacctacgcacagagttccagggcagagtcacgataccgcgacgaatccacgagcacagtctatactaggaattgaccagcctagacatcagagacacggccgtctatttgngtacgactaaggaaagagtactccgaactacgtacgaggacgggcacgtagtcgggacagcgacgtcg

SEQ ID NO: 385523 - DNA, 529 bp, Homo sapiens
  misc_feature: GZ8MTXP02HLWLW.19.1.A01.1.454.CMB.2.raw
  modified_base (326)..(326): a, c, t, g, unknown or other
  modified_base (404)..(404): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggagcctgggtcctcggtgaaagtttcctgcaaggcttcgtggggacaccttcacctcctattctatcaactgggtgcgacaagcccctggacaagggcttgagtggagtgggagagcatccctttntttgatactccagaccctacgcacagagtccagggcagagtcacgataccgcgacgaatccacgagcacagtctatanggaattcgacagcctagactatcagagacacggtccgtacttagttttgagtacgacgaagaaaacggagtaacttccaattacgcgaaggggccggggaactacgtacgtcggacagacagacg

SEQ ID NO: 385524 - DNA, 529 bp, Homo sapiens
  misc_feature: GZ8MTXP02J2I14.19.1.A01.1.454.CMB.2.raw
  modified_base (324)..(324): a, c, t, g, unknown or other
  modified_base (335)..(335): a, c, t, g, unknown or other
  modified_base (454)..(454): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggagcctgggtcctcggtgaaagtttcctgcaaggcttcgtggggacaccttcacctcctattctatcaactgggtgcgacaagcccctggacaagggcttgagtggatgggagagcatcctttnttgatactcanacctacgcacagagtccagggcagacgtcacgattaccgcgacgaaactccacgacgacacagtctatataggtaattagaccagactgacatcagagacacggcgtacttagttttgngtacgacagaaaagagtacttaccaagtacctacgacgggcggggaactacgtacgtcggacacggaccgagacg

SEQ ID NO: 385525 - DNA, 509 bp, Homo sapiens
  misc_feature: GZ8MTXP02IFZT0.19.1.A01.1.454.CMB.2.raw
  modified_base (268)..(268): a, c, t, g, unknown or other
  modified_base (320)..(320): a, c, t, g, unknown or other
  modified_base (445)..(445): a, c, t, g, unknown or other
  modified_base (485)..(485): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactggtncgacaagcccctggacaagggcttgagtggatggggaggaagcatccctttnttgatactccagactacgcacagaagttccagggcagagtcacgattaccgcggacaactccacgagcacagtactatatggaattgacagcctagacatcagaggacacggcgtctagttttgngtcgacagaaagagattaccatactcaggcgggcacgtanggcagcagctgactacggtcgggg

SEQ ID NO: 385526 - DNA, 505 bp, Homo sapiens
  misc_feature: GZ8MTXP02IBCO8.19.1.A01.1.454.CMB.2.raw
  modified_base (278)..(278): a, c, t, g, unknown or other
  modified_base (331)..(331): a, c, t, g, unknown or other
  modified_base (351)..(351): a, c, t, g, unknown or other
  modified_base (381)..(381): a, c, t, g, unknown or other
  modified_base (388)..(388): a, c, t, g, unknown or other
  modified_base (444)..(444): a, c, t, g, unknown or other
  modified_base (453)..(453): a, c, t, g, unknown or other
  modified_base (479)..(479): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctggaggtgaggaagcctgggtcctcggtgtaaagttcctgcaggcttcgtgggacaccttcaccctcctattctatcaacgtgggtncgacaagcccctggacaagggcttggagtggagtggggagaagcatccctttnttgatactcagcctacgcanagagttccagggcagatcacgatacccggngacaacnccacgagcacagtactatataggattgacagcctgacatcagagacgacggccgtntagttttgngtcgaacagaaagagacttcactacncgaggcggcgactagcgcacgcagcg

SEQ ID NO: 385527 - DNA, 506 bp, Homo sapiens
  misc_feature: GZ8MTXP02J17JR.19.1.A01.1.454.CMB.2.raw
  modified_base (320)..(320): a, c, t, g, unknown or other
  modified_base (442)..(442): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaagggcttgagtggatgggaggaagcatccctttnttgatactcagactacgcacagagttccagggcagagtcacgattaccgcgacgaatccacgagcacagtctatatggaattgaccagcctgacatcagaggacacggccgtcttattttgngcgacagaaagagattccatactcgaggcggggcacgtatggcagcagctgacgtacgtcgggg

SEQ ID NO: 385528 - DNA, 513 bp, Homo sapiens
  misc_feature: GZ8MTXP02JMFZ7.19.1.A01.1.454.CMB.2.raw
  modified_base (323)..(323): a, c, t, g, unknown or other
  modified_base (331)..(331): a, c, t, g, unknown or other
  modified_base (451)..(451): a, c, t, g, unknown or other
  modified_base (496)..(496): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagccccctggacaagggctgagtggatgggagagcatccttnttgatacncagacctacgcacagagtccagggcagagtcacgattaccggacggaacgaactcccacgagacacagtctaatatggaattgaccagcctagacatcagagacacggccttctatttgngacacgtaagaaagagtactacatactcgaggcgggaacacgtancggacacgacgagtacg

SEQ ID NO: 385529 - DNA, 511 bp, Homo sapiens
  misc_feature: GZ8MTXP02GI5KO.19.1.A01.1.454.CMB.2.raw
  modified_base (322)..(322): a, c, t, g, unknown or other
  modified_base (325)..(325): a, c, t, g, unknown or other
  modified_base (333)..(333): a, c, t, g, unknown or other
  modified_base (339)..(339): a, c, t, g, unknown or other
  modified_base (354)..(354): a, c, t, g, unknown or other
  modified_base (358)..(358): a, c, t, g, unknown or other
  modified_base (377)..(377): a, c, t, g, unknown or other
  modified_base (382)..(382): a, c, t, g, unknown or other
  modified_base (414)..(414): a, c, t, g, unknown or other
  modified_base (416)..(416): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacacttcacctcctattctatcaactgggtgcgacaagcccctggacaagggcttgagtgatggagagcatccctttnttnatactcanaccacncacagaagtcgaggnaganacacgatacgacgacaacncaganacacatcaatatagaatcgacacgacagacananagagacgacgcgtctatttgtgcgacaacgaaaagaagtactactaactactacgacggacgggaacgacgtaacgtacggacgacgacgacgcg

SEQ ID NO: 385530 - DNA, 549 bp, Homo sapiens
  misc_feature: GZ8MTXP02HXI49.19.1.A01.1.454.CMB.2.raw
  modified_base (329)..(329): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggtcttcgtggggacaccttcaccctcctattctatcaactgggtgcgacaagcccctaggacaagggcttgagtggagtggagaagcatcctttnttgatactcagacctacgcacagaagtccgagggcagacgtcacgtacttaccgacggacgaaactccaacgagacacagtactatagtagaattgacagcctgactatcaagacggacacggccgttacttagttttgcgacgtaacgaacgaaagtagtaacttacaacgttacctcgagggtacggggaactaacgtacgtcggaccagcgaagtcg

SEQ ID NO: 385531 - DNA, 510 bp, Homo sapiens
  misc_feature: GZ8MTXP02JLAGD.19.1.A01.1.454.CMB.2.raw
  modified_base (270)..(270): a, c, t, g, unknown or other
  modified_base (321)..(321): a, c, t, g, unknown or other
  modified_base (420)..(420): a, c, t, g, unknown or other
  modified_base (443)..(443): a, c, t, g, unknown or other
  modified_base (469)..(469): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgccagctggtgcagtctggggctgaggtgaggaagcctgggtcctcggtgaaagtttcctgcaaggcttctggggacaccttcacctcctattctatcaactgggtncgacaagcccctggaccaagggcttgagtggatgggagaagcatccctttnttgatactccagactacgcacagaagtccagggcagagtcacgattaccgcgacgaatccacgagcacagtctatatgaattgacagcctgacatcagnggacacggccgtctactttttgngtcgacagaaacgagattccattacncaggcgggcacgtatggcaggacagctgactacggtcgggg

SEQ ID NO: 385532 - DNA, 523 bp, Homo sapiens
  misc_feature: GZ8MTXP02I7CL1.19.1.A01.1.454.CMB.2.raw
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactggtgcgacaagcccctggacaagggcttggagtggatggaggaagcatccctttcttgatactccagacctacgcacagagtccagggcagagtcacgattaccggcgacgaactccacgagacacagtactaatataggaattagacctaggccctagactatacagaggacacggccggttctagttttgagcgtacagaaaagagacttaccatactcgaaggcggggctacgtataggcacgcgagcg

SEQ ID NO: 385533 - DNA, 513 bp, Homo sapiens
  misc_feature: GZ8MTXP02G439Z.19.1.A01.1.454.CMB.2.raw
  modified_base (318)..(318): a, c, t, g, unknown or other
  modified_base (441)..(441): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggagcctgggtcctcggtgaaagtttcctgcaaggcttctggggacaccttcacctcctattctatcaactgggtgcgacaagcccctggacaagggcttgagtggatgggaggagcatccctttnttgatactccagactacgcacacgagttccaggcagagtcacgattaccgcgacgatcgacgagcacagtctatataggaattcgaccagcctgacatcagacgacacggcgtactattttgngcgacagaaagagtacttacatactacgagggtcggcacgtagtggcgagacagctagacgtacggtcgggg

SEQ ID NO: 385534 - DNA, 774 bp, Homo sapiens
  misc_feature: GZ8MTXP02FS61X.19.1.A01.1.454.CMB.2.raw
  modified_base (331)..(331): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctgaggtgaggaagccgtgggtcctcggtagaaagtttcctgcaaggcttcgtgggaccaccttcacctcctattctatcaacgtggtgcgacaacgccccgtaggacaagggcttggagtggagtggggagagctacttccctttnttgactactccagacctacgacacacggtaaacgttccgaggggaccaggacgttaccgacggtaacgttaaccccgggacgggtaaacccgtaaacgtacccgaaacgggacgaccgaaccgtaaggttaccttaaagttaacgttaagggtaaactttaccggaaaccccgtaacggtacccgttaacggaaccctaaagttaacccggaaacggggtaaaccggggaaacccgtaaccccgggggttacccgttttaaccggttttaaagtttttttcggggacggtaaccggtaaaacggaaaggtaaaaggtaaacggttaaccgtttaaccctaaagttaaccggttaccggacgggggaccgggggtactaaaccgtaggtacgggaacgtacggacgtaacggtcgtaaggtacggttacggggttaaccggggg

SEQ ID NO: 385535 - DNA, 494 bp, Homo sapiens
  misc_feature: GZ8MTXP02FYKSV.19.1.A01.1.454.CMB.2.raw
  modified_base (322)..(322): a, c, t, g, unknown or other
  modified_base (440)..(440): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaggcttgagtggatgggagagcatcccttntttgatactcagacctacgcacagaagttccagggcagagtcacgattacgcgacgaatccacgagacacagtcatatggaatagacagctgacatcagagacacggcctctatttgngtcgacaagaaagagtactcatactcgaggcgggcacgtatcggcagcagtacg

SEQ ID NO: 385536 - DNA, 612 bp, Homo sapiens
  misc_feature: GZ8MTXP02GIZJR.19.1.A01.1.454.CMB.2.raw
  modified_base (320)..(320): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagccgtgggtcctcggtgaaagtttcctgcaaggcttcgtggggacaccttcacctcctattctatcaacgtgggtcgcgacaacgcccctggacaaggctgagtggatgggagagcatcctttnttgatactcagtactacgcacagtacgtccgagggcagtacgtcacgtacttacccggacggaacgaactccgaacgagaccaacgagtactaagtatacggtaaattcggaaccacgtacctaggactaagtaccgaaggaacggacgtaccgggtaccggttactttacgtttttcggacgtacgtaacgaaggaaaagtacgtaactttacccgattaaccgtcggaacgggtcggggaccaacgtagtggaacgacgacgtacgccgtagacggtacgggtaccgggg

SEQ ID NO: 385537 - DNA, 522 bp, Homo sapiens
  misc_feature: GZ8MTXP02HXZSD.19.1.A01.1.454.CMB.2.raw
  modified_base (304)..(304): a, c, t, g, unknown or other
  modified_base (396)..(396): a, c, t, g, unknown or other
  modified_base (427)..(427): a, c, t, g, unknown or other
  modified_base (452)..(452): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattcctatcaactgggtgcgacaagcccctggacaagggctgagnggatgggagagcattcctttctttgatactccagacctagccacagaattccagggcagagtcacgattaccgcgtacgaatccacgagcanagtctatataggaattgacagcctagacatnagaggacacggcgtactatttttgngtcgaacagaaaagaggtaacttaccaattacctacgaggcgggaacgacgtacgtggaccagccaagcg

SEQ ID NO: 385538 - DNA, 523 bp, Homo sapiens
  misc_feature: GZ8MTXP02ISB6M.19.1.A01.1.454.CMB.2.raw
  modified_base (276)..(276): a, c, t, g, unknown or other
  modified_base (323)..(323): a, c, t, g, unknown or other
  modified_base (466)..(466): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctgggctgaggtgaggaagcctgggtcctcggtgaaagtttcctgcaaggcttcgtggggacaccttcacctcctattctatcaactgggtncgacaagcccctggacaaggcttgagtggatgggagagcatcctttnttgatactcagacctacgcacagaagttccgaagggcagagtcgacgacttaccgacggaacgaaactccgacgacgacaacaagtctatataggaattgacctagcctagacatacagagacacggctctatttgtgcgaanagaaagagacttaccagtactacgaggacgggcgtacgtaagtcggacaggcaagcg

SEQ ID NO: 385539 - DNA, 516 bp, Homo sapiens
  misc_feature: GZ8MTXP02GZSNX.19.1.A01.1.454.CMB.2.raw
  modified_base (276)..(276): a, c, t, g, unknown or other
  modified_base (324)..(324): a, c, t, g, unknown or other
  modified_base (375)..(375): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttcgtgggacaccttcacctcctattctatcaactgggtncgacaagcccctggacaaggcttgagtggatggagaagcatccctttnttgatactccagacctacgcacagaagtccagggcagagtcacgataccgngacgaatccacgagcacagtactatatagattagacagcctgacatacagagacacggcgtcttattttgagtacgacaagaaagagtacttaccatacgtacgacgggacgggaactacgtagtcggacaggacaggtcg

SEQ ID NO: 385540 - DNA, 518 bp, Homo sapiens
  misc_feature: GZ8MTXP02IYA47.19.1.A01.1.454.CMB.2.raw
  modified_base (322)..(322): a, c, t, g, unknown or other
  modified_base (434)..(434): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaagggctgagtggatggagagcatcctttnttgatactcagacctacgcacagagtccgagggcagagtacacgacttaccgacgtacgaactccacgacgacacagtactatatggaattgactagctgacatcagagacncggctcttatttgacgtcgacagaaaagagtacttacgactacgacgtacggcgggaactacgtagtcggacacggcgtaagcg

SEQ ID NO: 385541 - DNA, 539 bp, Homo sapiens
  misc_feature: GZ8MTXP02G6PX2.19.1.A01.1.454.CMB.2.raw
  modified_base (269)..(269): a, c, t, g, unknown or other
  modified_base (320)..(320): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtncgacaagcccctggacaagggcttgagtggatggggagaagcatccctttnttgatactccagactacgctacagaagttccagggcagagtcacgattaccgcggacgaatccacgagcacagtcatatggaaattcgaacagcctgacatcagacggacacggcgtattacttttgcgtacgaacaggaaaagtagacttacatactcgagggtccggggactacgtagtcggaacgagcgagcgtacggaagtaccgggtacggggg

SEQ ID NO: 385542 - DNA, 511 bp, Homo sapiens
  misc_feature: GZ8MTXP02JIX46.19.1.A01.1.454.CMB.2.raw
  modified_base (323)..(323): a, c, t, g, unknown or other
  modified_base (445)..(445): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctgggctgaggtgaggaagcctgggtcctcggtgaaagtttcctgcaaggcttcgtggggacaccttcacctcctattctatcaactgggtgcgacaagcccctggacaagggcttgagtggatggagagcatcctttnttgatactcagacctacgcacagagttccagggcagagtcacgataccgcgacgaatccacgagcacagtactatataggaattgaccagcctagacatcagagacacggcgtcttatttgngtacgacaagaaagagtactaccatacgtacgaggcgggaacacgtagtcggacacggacagtacg

SEQ ID NO: 385543 - DNA, 533 bp, Homo sapiens
  misc_feature: GZ8MTXP02HR4S2.19.1.A01.1.454.CMB.2.raw
  modified_base (230)..(230): a, c, t, g, unknown or other
  modified_base (305)..(305): a, c, t, g, unknown or other
  modified_base (332)..(332): a, c, t, g, unknown or other
  modified_base (462)..(462): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagccgtgggtcctcggtgaaagtttccngcaaggcttcgtggggacaccttcacctcctattctatcaactgggtgcgacaacgcccctggacaagggcttgngtggagtgggagaagctattccctttntttgatacctcagaccctacgcacagtagttccgagggcagagtcacgataccgacgacgaactccacgacgacacagtactatatggatgacagcctgacatcagacgacgacggtcgtcttattttgngacgaacgtagaaaagagtacttaccacttacgacgagggcggaactacgtagtacggacagacgcgtacg

SEQ ID NO: 385544 - DNA, 533 bp, Homo sapiens
  misc_feature: GZ8MTXP02IOAJN.19.1.A01.1.454.CMB.2.raw
  modified_base (271)..(271): a, c, t, g, unknown or other
  modified_base (319)..(319): a, c, t, g, unknown or other
  modified_base (452)..(452): a, c, t, g, unknown or other
  modified_base (503)..(503): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctgaggtgaggaagcctgggtcctcggtgaaagtttcctgcaaggcttcgtggggacaccttcacctcctattctatcaacgtggtncgacaagcccctggacaaggcttgagtggatgggagagcatccctttnttgatactcagactacgcacacgaagttccgagggcagagtcacgattaccgcggaacaactccaacgagcacagtactatatagaattgaaccagcctagacatcagagacacggtccgtacttagttttgngtcgaacagaaagagaattaccaatacgtacgaagggcgggacacgttagnggaacagacagctagacgtacggtcggggg

SEQ ID NO: 385545 - DNA, 573 bp, Homo sapiens
  misc_feature: GZ8MTXP02IGFV7.19.1.A01.1.454.CMB.2.raw
  modified_base (269)..(269): a, c, t, g, unknown or other
  modified_base (316)..(316): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttcgtggggacaccttcacctcctattctatcaactggtncgacaagcccctggacaaggcttgagtggatgggagagcatcctttnttgatactccagactacgcacagaacgtccaggcagagtcacgacttaccggacgggacaactccgaacgagccacagtactatatggaaattcggaaccagaccctgacataccgaagacggaacaccgggtccgttacctttaagtttttgacgtacgtaaccgtaaggaaagtagtaactttacccaattaccgacgaagggccggggacacgttagcggaaccgaagcgagctaggacgtacgggtacggggg

SEQ ID NO: 385546 - DNA, 563 bp, Homo sapiens
  misc_feature: GZ8MTXP02H7TNB.19.1.A01.1.454.CMB.2.raw
  modified_base (273)..(273): a, c, t, g, unknown or other
  modified_base (322)..(322): a, c, t, g, unknown or other
  modified_base (394)..(394): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctgaggtgaggaaggcctgggtcctcggtgtaaagtttcctgcaaggcttcgtggggacaccgttcacctcctattctatcaactggtncgacaacgcccctggacaaggcttgagtggagtgggagagcatcctttnttgatactcagactacgcacacgagtccgaggcagagtcacgacttacgacggtacgaactccagagaccanagtactatagagtaattcgaacagcctgaacatcgaggacggacacggcgttacttagttttcgcgtacgaacaaggaaagtagtacttacaattaccgtacgaagggtcgggacaccgttagacggaacgacggacgaacgcgtacggaacgttacgggtaccggggg

SEQ ID NO: 385547 - DNA, 539 bp, Homo sapiens
  misc_feature: GZ8MTXP02GJOK0.19.1.A01.1.454.CMB.2.raw
  modified_base (326)..(326): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaagggcttgagtggatgggagaagcatccctttntttgatactccagaccctacgcacagaacgttccagggcagagtcacgattaccgcggacgaactccacgagacacagtactatataggaattagacctagcctagacagtacagagacacggccgtctagttttgagtcgacgtaagaaagaggtacttaccaataccgtacgagggacggggaacaacgtagtacgggcaacggccagtcg

SEQ ID NO: 385548 - DNA, 575 bp, Homo sapiens
  misc_feature: GZ8MTXP02JIYU7.19.1.A01.1.454.CMB.2.raw
  modified_base (234)..(234): a, c, t, g, unknown or other
  modified_base (340)..(340): a, c, t, g, unknown or other
  modified_base (563)..(563): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtggggctggaggtgaggaagccgtgggtcctcggtagtaaagtttccngcgaggtcttcgtgggactaccttcacctcctattctatcaacgtgggtgcgacacgccccgtggacagggtctggagtggagtgggaggaagctacttccctttnttgactactccagacctacgcacagacgttccgagggcagagtacgacgtacgttaccgacggacgaaactccaacgagcacacgtactatagtggtaattcgacctacgctacgactagtacgaagacgaccgacggtcgttactttacgttttgcgtacgaacgtagaaaaggacgtaacttccaactacgtacggacgggtcgggaacacgtagtcgganacgcgacgtacg

SEQ ID NO: 385549 - DNA, 641 bp, Homo sapiens
  misc_feature: GZ8MTXP02IFDRW.19.1.A01.1.454.CMB.2.raw
  modified_base (268)..(268): a, c, t, g, unknown or other
  modified_base (314)..(314): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagctgggtctcggtgaaagtttcctgcaaggcttcgtggggactaccttcacctcttattctatcaactggtncgacacgcccctggacaggcttgagtggatgggagagcatcctttnttgatactcagactacgacacacgaagttccgaggcagacgtcacgacttaaccggacggaacgaactaccgacgacgacacagtactaagtagtacgtaaattcgaaccgacgtaccctagaaccaataccgaagaacgggaaccgtaccgggtacccgttactttagttttttacggacggtaccgtaaaggtaaaggaaaaggtacggtaaactttaacccgaattaccggttacgaacgggggaccggggtacaaaccgtttagacgggggaacaacggaccgaggggttacctaggggtaaacgttacggggttaccggggg

SEQ ID NO: 385550 - DNA, 594 bp, Homo sapiens
  misc_feature: GZ8MTXP02HKF2I.19.1.A01.1.454.CMB.2.raw
  modified_base (331)..(331): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggagcctgggtcctcggtgaaagtttcctgcaaggcttcgtggggacaccttcacctctattctatcaactgggtgcgacaacgcccctaggacaagggcttggagtggagtggggagagctattccctttnttgactactcagtacctacgcacagtaacgtccgagggcagagtcacgtacgttaccggacgaacgaactaccgacgacgcaacgagtactatacgtaggaattcgaacctagcctagaactatacgaggaacgaccgaccggtaccgttacgtttacgtttttggtacgacgaacgtaacggaaaagtagtaacttaccgtaactaaccgtcggaacgggacggggtaacgtaacgtacgtacggacacggacgtacgacgg

SEQ ID NO: 385551 - DNA, 634 bp, Homo sapiens
  misc_feature: GZ8MTXP02HTE24.19.1.A01.1.454.CMB.2.raw
  modified_base (314)..(314): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttcgtggggacaccttcacctcctattctatcaactggtgcgacaagccctggacaaggctgagtggatgggagagcatcctttnttgatactccagactacgcacacgagtccaggcagagtcacgattaccgcgacgaactccgacgagcaacagtctaatagtaggtaaattggaaccaggtaccctagaaccaagttaccaaggaacgggtaaccaaccggggtcccgttaaccgtttaacgttttttaggacggtacggtaaacgtaaggtaaaaaggacggtaaactttacccgaattaaacccgttacggtaaacggggtaccgggggactaaaccgttaacgtggaaccgtaggaccgaaggtaccgttaggacggtttaacgggttaaccgggggg

SEQ ID NO: 385552 - DNA, 587 bp, Homo sapiens
  misc_feature: GZ8MTXP02IE9RO.19.1.A01.1.454.CMB.2.raw
  modified_base (269)..(269): a, c, t, g, unknown or other
  modified_base (315)..(315): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttcgtggggacaccttcacctcctattctatcaactggtncgacaacgccctggacaaggctgagtggatgggagagcatcctttnttgatactcagactacgcacacgagttccaggcagagtcacgacttaccgacggaaccgaactccgaacgacgaccaacagtacctaatacgtagtaacttgaccagccctagacatcgaagaggacacggtcgtacttagttttgacgacgtacgaaggaaagtagtaacttcccaattaccgtacgacggggaccgggggacctaacggttacgacggaaccgaacggccgtacggaccgttaggtaccgtttaacggggtaccgggggg

SEQ ID NO: 385553 - DNA, 574 bp, Homo sapiens
  misc_feature: GZ8MTXP02HKEH1.19.1.A01.1.454.CMB.2.raw
  modified_base (543)..(543): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctgaggtgaggaagccgtgggtcctggtgtaaagtttcctgcaaggcttcgtggggactaccttcacccttcctattctatcaacgtggtgcgacaacgcccctggacaaggcttgagtggatggggagagcattccctttgttgatactccagacctacgcacagaacgtcgagggcagagtcacgacttaccggacggtacgaacgtcccaacgacgacaacgacgtctaagtataggaaacttcgaacctagacctacgacactacgaaggacggacgacgggtccgttacgttagttttggcgtacgacgaagtaaagagtacttaccagtacgtcgagggcggtacacgttagngcgagcgacgcgtacgacgtacggtacgggg

SEQ ID NO: 385554 - DNA, 529 bp, Homo sapiens
  misc_feature: GZ8MTXP02GE08N.19.1.A01.1.454.CMB.2.raw
  modified_base (326)..(326): a, c, t, g, unknown or other
  modified_base (460)..(460): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaagggcttgagtggatgggagaagcatccctttnttgatactccagacctacgcacagaagttccagggcagagtacacgattaccgcggacgaaactcccaacgagcacagtactatagtaggaattgaccagcctagacatacagagacacggcctcttattttgngtcgactagaaaagagacttaccatactacgaagggtcggggaactacgtagtacggcgagcgtagacg

SEQ ID NO: 385555 - DNA, 542 bp, Homo sapiens
  misc_feature: GZ8MTXP02IAE7T.19.1.A01.1.454.CMB.2.raw
  modified_base (270)..(270): a, c, t, g, unknown or other
  modified_base (319)..(319): a, c, t, g, unknown or other
  modified_base (386)..(386): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttcgtggggacaccttcaccttcctattctatcaactggtncgacaagcccctggacaaggcttgagtggatggggagaagcatcctttnttgatactcagactacgcacagagttccaggcagagtcacgattaccgcgacgaatccgagagctanagtacatataggaattgaccagcctagacatacagaggacgacggcgtacttagttttgagtcgaacgaaagaacgagtaactttcaaattactacgacggggacggggcaacgttagcggaacgacgaccgagctaggacgttaacggtcggggg

SEQ ID NO: 385556 - DNA, 646 bp, Homo sapiens
  misc_feature: GZ8MTXP02JR04F.19.1.A01.1.454.CMB.2.raw
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagccgtgggtcctcgggtgaaagtttcctgcgaaggtcttcgtggggacaccgttcacctcctatctatcaacgtggtgcgacaagcccctggacagggcttggagtggatggggagaagctagtccctttgttgatacgtcagtacctacgcacgacgtagttccgagggccaggtacgtcacgtagttaccggcgggaaccgagtcccgagacgcacgtagtctagtagtggtaattcgaccgtagcctagacagtcgaagacggtaccacgggtccgtacttaacgttttgacggtcgacgtaagaaagtacgtactttaccgaacgttaccgacggtaacggggtaccgggggtacctaaaccggttacggttacggggaaccgtaagggtaccccggtaaacggtccggtttaacggaacggtttaacccggggttaaccgggggg

SEQ ID NO: 385557 - DNA, 516 bp, Homo sapiens
  misc_feature: GZ8MTXP02JB6YC.19.1.A01.1.454.CMB.2.raw
  modified_base (278)..(278): a, c, t, g, unknown or other
  modified_base (323)..(323): a, c, t, g, unknown or other
  modified_base (343)..(343): a, c, t, g, unknown or other
  modified_base (370)..(370): a, c, t, g, unknown or other
  modified_base (444)..(444): a, c, t, g, unknown or other
  modified_base (449)..(449): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccgttcaccttcctattctatcaactgggtncgacaagcccctggacaaggctgagtggatggagagcatcctttnttgatctcagacctacgcanagattccgaggcagagtcacgatacgngtacgaatccacgagcacagtctatatagaattcgacagcctagacatcagagacacggccgtcttattttcgngtcanaagaagagactccaatacctacgtacggcggggaactaacgtagtacgggacaacggcgaagtccgg

SEQ ID NO: 385558 - DNA, 579 bp, Homo sapiens
  misc_feature: GZ8MTXP02IM046.19.1.A01.1.454.CMB.2.raw
  modified_base (246)..(246): a, c, t, g, unknown or other
  modified_base (275)..(275): a, c, t, g, unknown or other
  modified_base (327)..(327): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggagcctgggtcctggtgaaagtttcctgcaaggcttcgtggggacnccttcacctcctattctatcaactgggtncgacaacgcccctggacaagggtctgagtggatgggagaagcattccctttnttgactactccagaccctacgcacgagagttccgagggcagagtacacgtacttaccggcggaacgaaactccgacgagacacagttactattagtaggtaacttacgaccaggccctaggaactatacgaaggaacggaccgaccggtccgttactttagtttttggacgtacgaacgtaaggaaaacgagtactttaccaattaccgtacgagggccggggtaacacgtagtcggacacgacacggtacg

SEQ ID NO: 385559 - DNA, 593 bp, Homo sapiens
  misc_feature: GZ8MTXP02JPVL0.19.1.A01.1.454.CMB.2.raw
  modified_base (230)..(230): a, c, t, g, unknown or other
  modified_base (332)..(332): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagccgtgggtcctcggtgaaagtttccngcaaggtcttcgtggggactaccttcaccctcctattctatcaacgtgggtgcgacacgcccctggacagggctgagtggagtggagagctacttccctttnttgatactcagaccctacgcacagaacgttccgagggcaggagtccgaacgacgttaccggacggaacgaactcccgaacgacgacaacgtacgttactataagtagtaacttacgacctagcctagacagtacgacggaacggaccgacggtcccgttacgtttagtttttcgtacgtacgtaacgaaagaaagaggtaacttaccacgttaccgtcgaacgggcggtaacgtacgtacgtcggacgacgacgacgtacg

SEQ ID NO: 385560 - DNA, 533 bp, Homo sapiens
  misc_feature: GZ8MTXP02F14F7.19.1.A01.1.454.CMB.2.raw
  modified_base (315)..(315): a, c, t, g, unknown or other
  modified_base (450)..(450): a, c, t, g, unknown or other
  modified_base (463)..(463): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctgaggtgaggaagcctgggtcctcggtgaaagtttcctgcaaggcttcgtggggacaccttcacctcctattctatcaactggtgcgacaagcccctggacaaggctgagtggatgggagagcatccttnttgatactccagactacgcacacgaagttccaggcagacgtcacgtattaaccggcggtaacgaactccaacgagaccacagtctatatggaactcgacagctagacatcagagacgacggtcgtcttagtttgngacgacagaaagngacttacgactacgtcgacgggacgggacacgtagtcggaacagcgtacgctacggacgtacggtcgggg

SEQ ID NO: 385561 - DNA, 586 bp, Homo sapiens
  misc_feature: GZ8MTXP02IRNGY.19.1.A01.1.454.CMB.2.raw
  modified_base (280)..(280): a, c, t, g, unknown or other
  modified_base (334)..(334): a, c, t, g, unknown or other
  modified_base (459)..(459): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctggaggtgaggagccgtgggtcctcggtgaaagtttcctgcaaggtcttcgtgggacctaccttcacctcctattctatcaactgggtncgacacgcccctggacaggcttgagtggagtagggaggaagctattcccttttnttagactactccagaccctacgacacgagacgttccgagggcagagtcacgacttaccgacggtaacgaactaccacgagacacagtactaagtagtaggtaacttcgaaccagcctagaactanacgaggaacggaccgaccggtccgttcgttaagtttttcgaggacgaaacgtaggaaaacgtagtactaccgtaataccgtacggacgggacggggaactacgtaagtcggacacggacgtaggacg

SEQ ID NO: 385562 - DNA, 492 bp, Homo sapiens
  misc_feature: GZ8MTXP02FG7A0.19.1.A01.1.454.CMB.2.raw
  modified_base (359)..(359): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtctcggtgaaagtttcctgcaaggcttctggggacaccttcacctcctattctatcaactggtgcgacaagcccctggacaaggcttgagtggatgggaggaagcatcctttctttgatactccagactacgcacagaagttccagggcagagtcncgatacgcggacgaatcacgagcacagtctatatgaatgacagcctgacatcagaggacacggccgtctattttgtgtcgacagaaagagattccatactcagcgggcacatgcgagcagctgatcgtagggg

SEQ ID NO: 385563 - DNA, 706 bp, Homo sapiens
  misc_feature: GZ8MTXP02HV6MH.19.1.A01.1.454.CMB.2.raw
  modified_base (224)..(224): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctggaggtgaggaagccgtgggtcctcggtgaaagtttccngcaaggcttcgtggggacaccttcaccctctattctatcaacgtggtgcgacaacgcccctggacaaggcttgagtggagtggggagaagcgtattcccctttgttagatacctccagtactaccgctacagtacgttccgagggcagacgttacacgtacgttaacccggacggaaccgaaactcccgaacgacgacaacacgtctaatagtaggtaaattcggaacacgtccctagaacctagtacgaaggacggaaccgtaccgggtacccgttacgtttaacgtttttggtacggaccgtaaaacggtaaggaaaacggtaacggtaaaacctttaccccggtaaaatttaacccgggttaccggtaaaccgggggtaccgggggaacctaaccggtttaaaccggggtacggggtaaccgtaaaccggtacgtacggtacgtaacgggtaaccgggtttaccgggggtaaccggggg

SEQ ID NO: 385564 - DNA, 550 bp, Homo sapiens
  misc_feature: GZ8MTXP02ICAE4.19.1.A01.1.454.CMB.2.raw
  modified_base (318)..(318): a, c, t, g, unknown or other
  modified_base (513)..(513): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactggtgcgacaacgcccctggacaagggcttgagtggatgggagagcatccctttnttgatactcagactacgcacagaagttccagggcagagtcacgattaccgcggacgaatccagagcacagtctatatgtaattgacagcctagacatcagacggacacggtcccgttattacgtttttggagtcggacaaggaaagagtaactttaccaagttacgtacgaacgggcggggaccaacgttaaggnggaacgacgacgacgacgtaggacgttacgggtcggg

SEQ ID NO: 385565 - DNA, 520 bp, Homo sapiens
  misc_feature: GZ8MTXP02J0APV.19.1.A01.1.454.CMB.2.raw
  modified_base (276)..(276): a, c, t, g, unknown or other
  modified_base (323)..(323): a, c, t, g, unknown or other
  modified_base (389)..(389): a, c, t, g, unknown or other
  modified_base (454)..(454): a, c, t, g, unknown or other
  modified_base (471)..(471): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtncgacaagcccctggacaagggcttgagtggatgggagagcatccttnttgatactcagacctacgcacagagttccagggcagagtcacgattaccgcggacgaatcccacgngacacagtctatagtaggaattgaccagcctagacatcagacgacacggtccgtcttagttttgngacgactaggaaaacgngacttaccgatacctcgacgggccgggcacgtagtcggaccagcagtcg

SEQ ID NO: 385566 - DNA, 682 bp, Homo sapiens
  misc_feature: GZ8MTXP02JYWQM.19.1.A01.1.454.CMB.2.raw
  modified_base (231)..(231): a, c, t, g, unknown or other
  modified_base (329)..(329): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtggggctggaggtgaggagccgtgggtcctcggtagtaagtttcngacaggtcttcgtgggactaccttcacctcttatctatcagtggtgcgacacgccccgtggacaggtctggagtggagtgggagagctacttcctttnttagactacacagacccctacgacacgagtacgtaccgagggcagacgtacaacggtacgtacccgggacggtaacgaaccgtacccgacgtacgaccaacgtagtacgtaagtagtaggtaacttcgaaccgtacgtccctagactacgtaccgaacgggtaaccggaccgtacccggggttacctttacgtttttacggttttacggaaccggtaacccgaaagtaaaacgggtaaaacggtacgttaaccgtttaaacccgaacggtttacccggtaaccgggtacgggggaccccggggtaactaacggttacgggacggtaccggacgaacccggtgttaaaccgggg

SEQ ID NO: 385567 - DNA, 567 bp, Homo sapiens
  misc_feature: GZ8MTXP02JX5AN.19.1.A01.1.454.CMB.2.raw
  modified_base (280)..(280): a, c, t, g, unknown or other
  modified_base (338)..(338): a, c, t, g, unknown or other
  modified_base (503)..(503): a, c, t, g, unknown or other
  modified_base (513)..(513): a, c, t, g, unknown or other
  modified_base (528)..(528): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctggaggtgaggaagccgtgggtcctcgggtgaaagtttcctgcgaaggcttcgtgggacaccttcacctcctattctatcaactgggtncgacaacgccccgtaggacaagggcttgaggtggagtgggaggaagcacttccctttnttgatactccagaccctacgcacaagacgtccgagggcagagtcgacgtatacccgcggaaacgaactacccgaagacgcaacgtagtactatagtaggaattacgaccgaagccgtagacaagtcaaggacgacgaccggtacgttcttagttttgcgtacganaagtaaaagntacgtacacgttacncgacggcggaacgacgtaacgcggacacgacgacgtacg

SEQ ID NO: 385568 - DNA, 545 bp, Homo sapiens
  misc_feature: GZ8MTXP02IKSOA.19.1.A01.1.454.CMB.2.raw
  modified_base (378)..(378): a, c, t, g, unknown or other
  modified_base (474)..(474): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgtagctggtgcagtctggggctgaggtgaggaagcctgggtcctcggtgaaagtttcctgcaaggcttcgtggggacaccttcacctcctattctatcaactggtgcgacaagcccctggacaagggcttgagtggatgggaggaagcatcctttcttgatactcagactacgcacagaagttccaggcagagtcacgattaacccgnggaacgaactccaagacgacacagtctaatagtaggtaattacgaccaagccctagaccatacgagacggaccacggtcccgttattagtttttgngtacggacaaaggaagaagtataccaatacgtacgaggcggggacaacgttgaggccaaggcaacgtgacg

SEQ ID NO: 385569 - DNA, 535 bp, Homo sapiens
  misc_feature: GZ8MTXP02H7OPO.19.1.A01.1.454.CMB.2.raw
  modified_base (282)..(282): a, c, t, g, unknown or other
  modified_base (326)..(326): a, c, t, g, unknown or other
  modified_base (399)..(399): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctgggggctggaggtgaggaagccgtgggtcctcggtgaaagtttcctgcaaggtcttcgtggggaccaccttcacctcctattctatcaactgggtncgacacgcccctggacaggctgagtgagtggagagcatcctttnttgatactcagacctacgcacagacgttccgagggcagagccacgacgttaccggcggaacgaactccacgancacagtctatatagtaatgacagcctgacatacgagagaccgacggtcgtcttagttttgtagcgactaagaaacgagtactacctatacgtacgacggggtacggaacgtacgtagtcggacgacgtacgagtcg

SEQ ID NO: 385570 - DNA, 552 bp, Homo sapiens
  misc_feature: GZ8MTXP02IQ9G6.19.1.A01.1.454.CMB.2.raw
  modified_base (276)..(276): a, c, t, g, unknown or other
  modified_base (322)..(322): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtncgacaacgcccctggacagggctgagtggatggagagcatcctttnttgactactccagaccctacgcacagagttccagggcagcgtcacgattaccgcggacaatccgacgagcacagtctatatggtaattgaccagtccctgaccataccaggaacggaccgacggtccgttcgttaattttgtacgcgaactaaggaaaagacgtactttaccgattaccgtacgacgggaccggggaactaaccgtaagtcggacaacgcgaacggtccg

SEQ ID NO: 385571 - DNA, 517 bp, Homo sapiens
  misc_feature: GZ8MTXP02IUX6Q.19.1.A01.1.454.CMB.2.raw
  modified_base (267)..(267): a, c, t, g, unknown or other
  modified_base (314)..(314): a, c, t, g, unknown or other
  modified_base (395)..(395): a, c, t, g, unknown or other
  modified_base (436)..(436): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctctattctatcaactggtncgacaagcccctggacaaggcttgagtggatgggagagcatcctttnttgatactccagactacgcacagaacgttccagggcagagtcacgattacccggcggacgaactcacgagcacagtcatangaattgacagctgacatcagagacacggcgtcttattttgngacgaactagaaagagtacttaccattacgtcgaacggcgggacacgtagtggcacgcacgctaggactacgggtacgggg

SEQ ID NO: 385572 - DNA, 598 bp, Homo sapiens
  misc_feature: GZ8MTXP02IPA5E.19.1.A01.1.454.CMB.2.raw
  modified_base (279)..(279): a, c, t, g, unknown or other
  modified_base (328)..(328): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagccgtgggtcctcggtgtaaagtttcctgcaaggcttcgtggggacaccttcacctcctattctatcaactgggtncgacacgcccctggacaggctgagtggatggagaagctacttccctttnttgactctcagacctacgcacagacgttccgagggcagagtaccacgtacttaccggacgggaaccgaactcccgaacgacgacacgtaagttctaatagtaggtaacttacgaccagccttagaacatccgaggaacggaccgaccggtccgttacgtttaacgtttttggtacgtacgaacgtaaaggaaaacggtagtaactttaccacgttaaccgtacgtaacgggccggggtaacaaccgtagtcgggacacggtacaacgtcg

SEQ ID NO: 385573 - DNA, 564 bp, Homo sapiens
  misc_feature: GZ8MTXP02GX7MQ.19.1.A01.1.454.CMB.2.raw
  modified_base (277)..(277): a, c, t, g, unknown or other
  modified_base (327)..(327): a, c, t, g, unknown or other
  modified_base (475)..(475): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttcgtggggacaccttcacctcctattctatcaactgggtncgacaacgcccctggacaagggcttgagtggatgggagagcatccctttnttgactactcagacctacgcacagaagttccagggcagagtcacgattaccgcgacgaactccacgagacacacgtctaatagtagaagttcgaaccgaggccctaggacctagtacaaggagaccacggtccgttacttagttttgngtacgaacgaacgtaaaagacgtacttaccaagttacctacgaagggccggggaactaacgtagtacggggacacggaccgaggtacgg

SEQ ID NO: 385574 - DNA, 636 bp, Homo sapiens
  misc_feature: GZ8MTXP02GQFEB.19.1.A01.1.454.CMB.2.raw
  modified_base (230)..(230): a, c, t, g, unknown or other
  modified_base (506)..(506): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctggaggtggaggacgccgtgggtccgtcggtagtaacgtttccgngacgaaggtcttcggtacggggacctaccttccaccttcctattctatacaacgtggtcgcgaacgaaccgccccgtaggacgaacgggtctaggaggtggagtaggggaaggaagctactttccctttattgacttacctccagtactacgacagacgtacgtccgaggcagacgacgacgtacgtaccggacggacgtactaccgacgacgacactacgtactaagtagtagtatcgacagcctagacatcgaagacggacgaccggtacgttnttagtttgagacgaacgtaagaaagacgtacttaccaattaccgtacggacggggacggggtaacctaacgttacggtacggaaccgacggacgtacgacgtacggtaacggttacgggtaacccggggg

SEQ ID NO: 385575 - DNA, 535 bp, Homo sapiens
  misc_feature: GZ8MTXP02FPIK1.19.1.A01.1.454.CMB.2.raw
  modified_base (277)..(277): a, c, t, g, unknown or other
  modified_base (327)..(327): a, c, t, g, unknown or other
  modified_base (452)..(452): a, c, t, g, unknown or other
  modified_base (462)..(462): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagccgtgggtcctcggtgaaagtttcctgcaaggcttcgtggggacaccttcacctctattctatcaactgggtncgacaagcccctggacaagggcttgagtggatgggagaagcactcctttnttgatactccagacctacgcacagaagttccagggcagagtcacgattaccggcgacgaatccaacgagacacagtactatataggaattcgaccagcctagactatcgagagacaccggtcgtnttagttttgngtacgaacaagaaacgagtacttaccgataccgtcgaagggtccggggctaacgtagtcggcagcgacgtacg

SEQ ID NO: 385576 - DNA, 603 bp, Homo sapiens
  misc_feature: GZ8MTXP02J4SML.19.1.A01.1.454.CMB.2.raw
  modified_base (261)..(261): a, c, t, g, unknown or other
  modified_base (370)..(370): a, c, t, g, unknown or other
  modified_base (439)..(439): a, c, t, g, unknown or other
  modified_base (487)..(487): a, c, t, g, unknown or other
  modified_base (493)..(493): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtcccagtcccaggtgcagctgtgcagtctggggctggaggtgaggaagccgtgttccgtcggtgaagtttcctgcaggcttcgtggggacacctctacctcctnttctatcaactgggtgcgacacgaccccgtcggagaaggcgttgtggtggtagaggtaggaaaggctacttcccttttcttttcgattactaccactacccgtacgacncaagtactaaccgttcgggaggttacaaggggtccacgaacgttcaccgggacttacccgagtaccacncgacaccttagtactagttaatggtaaattggacctacggtacccctnaccganacgacgacgggaccgacggtccgttacggttactttaggtgtacggtacgaagaacaaagtaacgtactactacgtacgacgaacggtcggacgtcacggtcacgagtcg

SEQ ID NO: 385577 - DNA, 524 bp, Homo sapiens
  misc_feature: GZ8MTXP02H9BAT.19.1.A01.1.454.CMB.2.raw
  modified_base (269)..(269): a, c, t, g, unknown or other
  modified_base (319)..(319): a, c, t, g, unknown or other
  modified_base (388)..(388): a, c, t, g, unknown or other
  modified_base (454)..(454): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctctaattctatcaactgggtncgacaagcccctggacaagggcttgagtggatgggagaagcatccctttnttgatactcagactacgcacagaagttccaggcagagtcacgacttaccgcggacgaactccgaacganaccaacagtacctataacaggtaattagacctagcctgacatcagaggacacgcgtctagtttcgngtcgacagaagagactacatactcgaggcgggacactagtcgcgacgcagcgtagacgtacggtacgggg

SEQ ID NO: 385578 - DNA, 571 bp, Homo sapiens
  misc_feature: GZ8MTXP02J0NVV.19.1.A01.1.454.CMB.2.raw
  modified_base (246)..(246): a, c, t, g, unknown or other
  modified_base (313)..(313): a, c, t, g, unknown or other
  modified_base (332)..(332): a, c, t, g, unknown or other
  modified_base (351)..(351): a, c, t, g, unknown or other
  modified_base (385)..(385): a, c, t, g, unknown or other
  modified_base (480)..(480): a, c, t, g, unknown or other
tcagtactctcgtgcacgaccggtgctcgatttagacgtctcatcagggggaacaaccacattcctcctctaagaagcccctgggagcacagctcatcaccatggactggacctggaggttcctcttttgcggtggcagcagctacaggtgtccagtccccaggtgcagctggtgcagtctgggggctgaggtgaggagcctgggtcctcggtgaaagtttcctgcaaggcttcgtgggcaccttnacctcctatctatcatggtgcgacagcccctggacagggcttgagtggatggaggagcatccctttnttgattactcagactcgcncagagttccaggcagatcncgattacgcggacgaatccacgagcacagtactntatagggtaatttggaaccaaggcctaggacatcaaggagaccgaccggacccggttcttaacgttttttgacggtcgaacgaaggaaaagggtntaaacttttcccaattacctacgagggggccgggggtactaaccgtaatcggaaccaggccgagtcctggtaacttaaccgggttcggggg

SEQ ID NO: 385579 - DNA, 621 bp, Homo sapiens
  misc_feature: GZ8MTXP02HXIT3.19.1.A01.1.454.CMB.2.raw
  modified_base (272)..(272): a, c, t, g, unknown or other
  modified_base (321)..(321): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttcgtggggacctaccttcacctcctattctatcaacgtggtncgacaacgcccctggacaaggcttgagtggatgggagaagcattccttnttgatactccagactacgcacacgaacgttccgaggccagacgtcacgacgttaaccgcggtaacgaactccgaacgacgaccaacgacgtactaatagtaggtaaacttacgaccgaacgcccttagacaacgtaccgaaaggaacgggaccgtacgggtcccggttatttaagtttttcggacggtaccgtaaacgaaaggaaaacgtagtaacctttaccaaacgttaccgtacgaacggggccggggtacaaccgttagtcggaacgacgacgagcgtacgagtacggtaacgggg

SEQ ID NO: 385580 - DNA, 638 bp, Homo sapiens
  misc_feature: GZ8MTXP02GXYVE.19.1.A01.1.454.CMB.2.raw
  modified_base (232)..(232): a, c, t, g, unknown or other
  modified_base (252)..(252): a, c, t, g, unknown or other
  modified_base (337)..(337): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctggaggtgaggaagccgtgggtcctcggtgtaaagtttccngcgaaggcttcgtggggacnccttcacctcctattctatcaacgtgggtgcgacaacgcccctggacaagggctggagtggagtggggaggagctacttcctttnttgatactccagacctacgacacagaacgttccgagggcagagtacacgtacttaaccggcggaaacgaactacccgaacgacgacaacagtactaagtagtaggtaattacgaaccagcctagactagtacaggacgaccgaccggtaccgttacgttaagtttttcggacgtaccgtaaacgaaaacggtaaaagtaaacggtaaacctttaccgtaaacgttaaccgttaccggtaacggggtaccgggggaacctaacgttaacggtacgggaccctaaggaccgacggtaaccggg

SEQ ID NO: 385581 - DNA, 617 bp, Homo sapiens
  misc_feature: GZ8MTXP02I4UDO.19.1.A01.1.454.CMB.2.raw
  modified_base (330)..(330): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctgaggtgaggaagccgtgggtcctcggtgtaaagtttcctgcaaggtcttcgtggggactaccttcacctcctattctatcaacgtgggtgcgacaacgcccctggacaagggcttgaggtggagtgggagagctacttcctttnttgactactccagactacgcacagacgtccgaggcagacgtacacgtacgttaccggacggaaccgaactccgaacgacgacactagtactatagtaggaattcgaacctacgcctagacacgtacgaacggacggaccgtaccgggtccgtttactttagttttggacgtacgaaacgtaagaaaacgtagtaacttaccgaacttaccgtcggaaacggggtccgggactaacgtacgtcggaaccgagacgacggtcgtaggtacggttacggggtaccggggg

SEQ ID NO: 385582 - DNA, 608 bp, Homo sapiens
  misc_feature: GZ8MTXP02JCW52.19.1.A01.1.454.CMB.2.raw
  modified_base (230)..(230): a, c, t, g, unknown or other
  modified_base (281)..(281): a, c, t, g, unknown or other
  modified_base (333)..(333): a, c, t, g, unknown or other
  modified_base (417)..(417): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctgggctgaggtgaggaagccgtgggtcctcggtagtaagtttccngcaaggtcttcgtggggaccaccttccaccccctattctatcaacgtggtncgacaacgcccctaggacaggctgagtggagtgggagagctacttccctttnttgactactccagacctaccgcacagtaacgttcgaggcagacgtccacgtacgttaccggacggaacgaaactacccgagacncacagtactagtacgtaggtaaatcgaaccagtccctagacctagtcgaacggtacgggaccacccgggtccttacgtttagtttttcgacggtacgaacgaaggtaaaacgacgttacttaccgaataccgttacgaacggggccggggtaactcgttaaaggtcggactaacggcgtacgacgttacgg

SEQ ID NO: 385583 - DNA, 686 bp, Homo sapiens
  misc_feature: GZ8MTXP02HTE98.19.1.A01.1.454.CMB.2.raw
  modified_base (224)..(224): a, c, t, g, unknown or other
  modified_base (326)..(326): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctgaggtgaggaagcctgggtcctcggtagaaagtttccngcaaggtcttcgtgggacaccttcacctctattctatcaacgtggtgcgacacgccccgtaggacgaaggcttgagtggagtgggagagctacttccctttnttagattacctcaagacctacgcaacgacgtaacgttccgaggcagacgtacacgtactaccgacggacgaactccgaacgtacgacaacgtacgtactagtacgtaggtaacttacgaaccagcctagaaccattaccgaaggaacggaacgtaccgggtacccgtttagtttaacgtttttcggacgtaacccggtaaagtaaaacggtaaaacggtaacgtaacttttaaccaaaacggtttaaaccctcggggaaacgggggtacccgggggtaacctaaacggttacgtacgggggaacctaacggacgaacggtcgttaacggtaacggggttacggggtttaaacccgggggg

SEQ ID NO: 385584 - DNA, 603 bp, Homo sapiens
  misc_feature: GZ8MTXP02HMYZ4.19.1.A01.1.454.CMB.2.raw
  modified_base (322)..(322): a, c, t, g, unknown or other
  modified_base (325)..(325): a, c, t, g, unknown or other
  modified_base (481)..(481): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggagccgtggtcctcggtgaaagtttcctgcaaggtcttcgtggggactacccttcacctcctattctatcaacgtggtgcgacaacgccccgtggacaagggcttgagtggatgggagagcatcctttnttnatactccagactacgcacagaagtccgaggtcaggagtcacgtattaccggacggaacgaactccgaacgagaccaacgagttactatagtcggtaaattcggaacacgcctagaccagtacgaagacgggtacacgggtccttagttacttttgngacgtacaaggaaagtagactttaccgaattacctacggacggggaccggggtactaacccgttagtaccggaacgaacgacgtaacggccgtaggtacgggttaaccgggtaaccgggggg

SEQ ID NO: 385585 - DNA, 662 bp, Homo sapiens
  misc_feature: GZ8MTXP02G0WPG.19.1.A01.1.454.CMB.2.raw
  modified_base (243)..(243): a, c, t, g, unknown or other
  modified_base (519)..(519): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtgggctgaggtgaggagccgtgggtcctcggtagtaagtttcctgcgaagtcttcgngggaccaccttcaccttcctattctatcaacgtgggtcgacgacaaccgccccgtaggaccgaaggcttaggaggtggagtggggaagaacgtctactttcccttttagttcgaacttacctccgtaacgaccccgttacacgaacgtaaggtaacgttccgaagggccgaagacgtaccgaacgtaccggttacccgacggggaaacctaaacgtacccgaacgacgaccaacgtacgttactagtagtacggtattacgaccacgtcctagacngtacgaggaacgaccgtacgggtaccttgttttacgtttcggagtaccgaaacgaaaggtaaagacgttaacttaacctagtacccgtaacgggacggggtaccggaactaaacggttagacggcgaaacgccgagttaccgg

SEQ ID NO: 385586 - DNA, 697 bp, Homo sapiens
  misc_feature: GZ8MTXP02HRZD1.19.1.A01.1.454.CMB.2.raw
  modified_base (335)..(335): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctgaggtgaggaagctgggtcctcggtagtaaagtttcctgcaaggcttcgtaggggactaccttcacctcctattctatcaacgtgggtgacgacaacgcccctggaaccgaaggcttggaggtggagtaggggagaagcattccctttnttgatactccagtactacgcaacagaagttccgaggacagacgtacacgtattaccgacggaacgaactcgaaacgagacctaaacgagttacctaagtaagtagggaaactttacgaacccgtaaggaccccttagaaacccgtaagtaccggaaacgggtaaccggaaccggtacccgggttacccgtttaacgtttttaggtttcggtacgaaacccggtaaaagtaaaaccggaaaggtaaacgtaaccgttaacctaaaacgttaccggaacgggtaccggggaccggaacctaaacgttcggagaacgacggtaccgagttaccgaaggtaaccggtttaggggtaaccccggggg

SEQ ID NO: 385587 - DNA, 737 bp, Homo sapiens
  misc_feature: GZ8MTXP02JR3NQ.19.1.A01.1.454.CMB.2.raw
  modified_base (227)..(227): a, c, t, g, unknown or other
  modified_base (344)..(344): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctggaggtgaggaagccgtgggtcctcggtagtaaagtttccngacgaaggtcttcgtagggacctacccttcaccttcctattctatcaacgtggtgacgacaacgccccgtaggacgaaggctaggaggtggagtggggaggagctacttcccgtttnttagacttacgtaccagtacctacgacacgaacgtaacgtccgagggtacaggtacgtaccgacggtaaccgttaccgggaccggaaccgtaaccgtacccgacgaacgacctaacgtacgttacttaagtaagttacgggtaaattaccgaacgtacgtaccgttacgaactaaacgtccgaaaggggaccggtaaccgacccggggttaccgtttaacgttttacggtttttacgggacggtaaaccggtaacgaaaagggtaaaagtacggttaaccttaacccgtaaggtttacccgacgggaacgggggtaccggggtaaccctacggttaagacgggaacgtacggacgacggtacgtacggtaacggttacgggggtaaccggggg

SEQ ID NO: 385588 - DNA, 656 bp, Homo sapiens
  misc_feature: GZ8MTXP02HIO6C.19.1.A01.1.454.CMB.2.raw
  modified_base (332)..(332): a, c, t, g, unknown or other
  modified_base (342)..(342): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctggtgaaagtttcctgcgaaggcttcgtgggaccaccttccaccttcctattctatcaacgtgggtgcgacacgccccgtgacgaaggcttgagtggagtgggagaagcacttcccttntttgagtacncctagaccctacacacaagaagttacccgagggtcaagagtaccgtaacgacgttacccggacggtaaccgaaacgtcccaaacgacgacaacgacgtacctaagtaacgtaggtaaacgttaggaacccacgggttacctaagggacctaacgttacgaaacggtacggaaccggtaaccggtacccggttacctttaagtttttcggacgtaacgtaaacgaaacgtaaaaggacggtaactttaccaaacgttacttacggacggtaccggggtaactaaccgtaagtacgggacaacgccgtaaagtcgg

SEQ ID NO: 385589 - DNA, 550 bp, Homo sapiens
  misc_feature: GZ8MTXP02G102T.19.1.A01.1.454.CMB.2.raw
  modified_base (319)..(319): a, c, t, g, unknown or other
  modified_base (384)..(384): a, c, t, g, unknown or other
  modified_base (467)..(467): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttcgtggggacaccgttcacctcctattctatcaactggtgcgacaagcccctggacaaggcttgagtggatgggagaagcgatcctttnttgatacgtcagactacgcacagaagtccaggcagagtcagtataccggcgacaatccgaaacgngacacaagtctaatagtagaaattcgaaccaacgtccctagacaagtccaaagacggaacaccggaccgttactagtttttgngacgacaagaaagagaattaccatactacgaggacgggacacgtagtaggaacgacgacgacgacgtagacgtacggtacggg

SEQ ID NO: 385590 - DNA, 664 bp, Homo sapiens
  misc_feature: GZ8MTXP02HFEWR.19.1.A01.1.454.CMB.2.raw
  modified_base (271)..(271): a, c, t, g, unknown or other
  modified_base (324)..(324): a, c, t, g, unknown or other
  modified_base (336)..(336): a, c, t, g, unknown or other
  modified_base (404)..(404): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctgaggtgaggaagccgtgggtcctcggtgaaagtttcctgcaaggcttcgtggggacaccttcacctcctattctatcaactggtncgaacacgcccctggacgaggtctagagtggatggggagaagctattcctttnttgactactcanactacgacacacgaacgtccgagggcagacgtcacggacttaccggacggaacaactaccgaacgganaccaatacggtactagtaacgtagggaacttacggaaccagaccctaggaaccagtacgaaggaacggtaccgaaccgggtccgtttacgtttaacgtttttcgcggtaaccggtaagaaacggaaaagtaacgtaactttaacccgtaacgttaaccgttaccgggaccgggggacgggggtaccctaaaggttaccgtacgggaacccgaggtaccgacggtacggtacggtaacgggttaaccggggttaccggggg

SEQ ID NO: 385591 - DNA, 638 bp, Homo sapiens
  misc_feature: GZ8MTXP02JLZAF.19.1.A01.1.454.CMB.2.raw
  modified_base (317)..(317): a, c, t, g, unknown or other
  modified_base (335)..(335): a, c, t, g, unknown or other
tcagtactctcgtgcacgaccggtgctcgatttagacgtctcatcgaggggatcacataacaaccacattcctcctctaaagaagcccctgggagcacagctcagtcaccatggactggacctggaggttcctctttgcggtggcagcagctacaggtgtccagtcccaggtgcagctggtgcagtctggggctggaggtgaggaagcctgggtcctcggtgaaagtttcctgcaaggcttcgtggggaccaccttcactcctattctatcaactgggtgcgaacacgcccctggacaaggctgagtggatggagancatccttcttgatctcanacctacgcacgagtacgtcgaggcagatacgacgtattaccgacgacaaatccgaacggagcacgagttccaagtagtaggtaattacgaaccaggtaccctagaaccttacgtacgaacggtaacggaaccctacggggtccctttacgttttaacgtttttggacggttaccgtaaccgaaaacggggttaaaaggaccttaaacgtttaccccgaaaggtttaacccctacgggaaaacgggtcccgggggaacctaacggtttaaggtaacccggggacgaacggtaccgtaacggtcg

SEQ ID NO: 385592 - DNA, 683 bp, Homo sapiens
  misc_feature: GZ8MTXP02JCBQR.19.1.A01.1.454.CMB.2.raw
  modified_base (245)..(245): a, c, t, g, unknown or other
  modified_base (279)..(279): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcgatggcagcagctacaggtgtccagtcccaggtgcagctggtgcagtcgtggggctggaggtgaggaagccgtgggtcctcggtagtaagtttcctgcaaggcttcgnggggacaccttcacctctattctatcacgtggtncgacaacgcccctaggacgaaggcttgaggtaggagtaggggaggaagctacttccctttgtttagactactaccagtacctaccgcaacgtaaggtaacgttccgaggggtacaaggtagtaccgacgtacgttaccggacggaacgaactacccgacgagtaccgaacgacgttactaagttaagttacgggtaaacgtttacgaacccgtaacgtacccgttacggaacctacgttaaccggaacgggaacgggtaacccgtaccgggtacccggtttaccttttaagtttttcgacggtaacgtaacgaaaggtaaaaggtacgtaacgttaccgaacgttaaccgtacggacggggaacggggtactaacggttacggtacggacacggaccgtaacgg

SEQ ID NO: 385593 - DNA, 603 bp, Homo sapiens
  misc_feature: GZ8MTXP02H56IH.19.1.A01.1.454.CMB.2.raw
  modified_base (229)..(229): a, c, t, g, unknown or other
  modified_base (283)..(283): a, c, t, g, unknown or other
  modified_base (339)..(339): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtggggctggaggtgaggagcgtgggtcctggtgtaagtttccngcgaggtcttcgtgggacctaccttccacctcctattctatacgaactgggtcncgacaacgcccctggacgaggtcttaggagtggagtggggagaagctattcctttnttgactacctccagaccctacgaccacgaagtacgttccgagggcagacgtacacgacgttaccggacgaacgaactaccgacgacgaccaacacgttacttacgtaagtacgggtaaatttacgaccgacgaccgttaggaactagtaccgaaggacggaccgtacggtaccgtttcttaagttttgacgtacgtacgaacgaagtagtactacaacgtacgtacgacgggacggaacgtacgtagtcgacgacgctaacgcg

SEQ ID NO: 385594 - DNA, 585 bp, Homo sapiens
  misc_feature: GZ8MTXP02GG79B.19.1.A01.1.454.CMB.2.raw
  modified_base (319)..(319): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcaccttcctattctatcaactggtgcgacaacgcccctggacaagggcttgagtggatgggagagcatccctttnttgatactccagactacgcacagaacgttccagggcagagttcacggtattacccgacggtaacgaactcccaagacgacacagtctaatataggaattgaccagcctagacatcaggacgacgacggtccgttcttaacgtttttgacgtcggaaacaggtaaaagtagtaacttacccgtaattaccgtacgtaacgggggcggggacctaaacgtgtacgggaaccgagaccgtaagccgtaggtaacgtccgggtacggggg

SEQ ID NO: 385595 - DNA, 660 bp, Homo sapiens
  misc_feature: GZ8MTXP02F1VDF.19.1.A01.1.454.CMB.2.raw
  modified_base (269)..(269): a, c, t, g, unknown or other
  modified_base (316)..(316): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctggaggtgaggagccgtgggtcctcggtgaaagtttcctgcaaggcttcgtgggactaccttcacctctattctatcaactggtncgacacgccctggacaggctgagtggagtgggagagctactcctttnttgatactcagtactacgacacgacgtaagttccgagggtccagtacgtaccgacgtacgttaaccggcggaaccgtaacgtacccgaacggagaccaacgtacgttactaagtacgtaggtaaacttcgaacctagtccctaggtactaatcgaaacggacggaccgaccgggtaccgttacgtttaacgtttttcggacgtacggaaacgtaaggtaaacgtaacggttaacttacccgtaaattaacccggtacggaacggggtaccggggaccgtaaccgtagtacggaacgaacggtacgaacggtccggtaggtaacggttacggggttaaccggggg

SEQ ID NO: 385596 - DNA, 636 bp, Homo sapiens
  misc_feature: GZ8MTXP02IFVC0.19.1.A01.1.454.CMB.2.raw
  modified_base (341)..(341): a, c, t, g, unknown or other
  modified_base (350)..(350): a, c, t, g, unknown or other
  modified_base (422)..(422): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtggggctggaggtgaggaagccgtgggtcctcggtgtaaagtttcctgcaggtcttcgtggggacctaccttcaccctcctattctatcaacgtgggtcgcgacacgcccctaggacaagggcttggagtggagtgggaggaagctattcctttnttgactacnccagtaccctacgcacgagtaagtccgagggcaggactcacgtactaccggacgaacgaactccgaacgacncaacgacgttactaagttacgtaggaacttcgaaccgacggtccctagacaagtacgaagggacggtaaccgaccggtaccgttacgtttagtttttacggcgtacgtaaacgaacggtaaaacgtacgtaaactttaaccccgaagtttaacccgtacgggtacggggaccggggaacttaacggttagacggacgtacgacgtacggtaccg

SEQ ID NO: 385597 - DNA, 629 bp, Homo sapiens
  misc_feature: GZ8MTXP02FL67K.19.1.A01.1.454.CMB.2.raw
  modified_base (330)..(330): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtgggctgaggtgaggaagcctgggtcctcggtgaaagtttcctgcaaggcttctggggacacccttcacctcctattctatcaactgggtgcgacaacgcccctggacgaagggcttgagtggagtgggaggagcatccctttntttagatactccagacctacgcacagaagtccagggcagagtcacgacttaccgcggaacgaaatcccaacggacgacacagtactaatataggtaattacgaccagcctgaacatacgaagggaagaacccgtacgggtacccgtttacgttttaagtttttcggacgtacgaaacgaaacggtaaaaaggtcggttaaaccttacccgaacgttaaccgtaccgggaacgggggtacccgggggtaacaaaacccggtttaggtaccggggaccgtaacggaccgacggttaaccgg

SEQ ID NO: 385598 - DNA, 545 bp, Homo sapiens
  misc_feature: GZ8MTXP02GD8AJ.19.1.A01.1.454.CMB.2.raw
  modified_base (329)..(329): a, c, t, g, unknown or other
  modified_base (425)..(425): a, c, t, g, unknown or other
  modified_base (429)..(429): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgtaaagtttcctgcaaggcttcgtggggacaccttcaccctcctattctatcaactgggtgcgacaagcccctggacaagggcttggagtggatggaggagcatccctttntttgatactccagacctacgcacagaagttccagggcagagtacacgagttaccgacggacgaatccaacgagcacagtcatagtagaatgaccanccgnacatcagagacacgggcctacttagtttcgtacgacgtaacgaaggaaaacgagtacttaccgaattaccgtacgagggaccggggaactacgtacgtcggacagaccgagtaccg

SEQ ID NO: 385599 - DNA, 651 bp, Homo sapiens
  misc_feature: GZ8MTXP02HW6VS.19.1.A01.1.454.CMB.2.raw
  modified_base (343)..(343): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtggggctgaggtgaggagccgtgggtcctcggtagtaaagtttcctgcgaaggtcttcgtgggacctaccttccacctcctattctatcaacgtgggtcgcgacaacgcccctaggacgaaggtcttggagtggagtggggagagctacttcctttnttgactactccagaccctacgcacgagtaagtccgaggcagagtcacgactaccgacggaacgactccaacgacgacacgtagtactaattagtacggtaattacgaacctacgtacccgtagaacccgtagtccgaaaggggaccgtaaccggtacccgggtacccgtttagtttaacgtttttcggacgtaaccggaaagtaaacgggaaaaagttcgtaaacctttccgtaaacgttaccgttaccggtaacggggaccggggtaacctaaggtacggtacggaacgacggacgtacggtaccgg

SEQ ID NO: 385600 - DNA, 608 bp, Homo sapiens
  misc_feature: GZ8MTXP02JZHKN.19.1.A01.1.454.CMB.2.raw
  modified_base (333)..(333): a, c, t, g, unknown or other
  modified_base (345)..(345): a, c, t, g, unknown or other
  modified_base (595)..(595): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctggaggtgaggagccgtgggtcctcggtagtaaacgtttcctgacgaaggtcttcgtgggacctaccttcacccttcctattctatcaacgtgggtcgcgacaacgcccctaggaacgagggtctggagtggagtgggaganctacttcctttnttgactcctcagaccctacgcacacggtacgttccgagggcaaggactaccgacgtacgttacccggacggaaccgaaactcccgaacgacgacaacgtagtactaatacgtaggtaattcgaccgagtccgtagaacacgtacgaacgggacggaaccgtacggtccgttactttagtttcgacgtacgaagtaacgaaagagtacttacgactacgtacggacgggtcggaactacgtacgtcggacngtacgacgtacgg

SEQ ID NO: 385601 - DNA, 524 bp, Homo sapiens
  misc_feature: GZ8MTXP02FHH64.19.1.A01.1.454.CMB.2.raw
  modified_base (327)..(327): a, c, t, g, unknown or other
  modified_base (504)..(504): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtccccaggtgcagctggtgcagtctggggctgaggtgaggaagcctgggtcctcggtgaaagtttcctgcaaggcttcgtggggacaccttcacctcctatctatcaactgggtgcgacagcccctggacaagggcttgagtggatgggaggagcactccctttntttgactactccagaccctacgcacaagagttccagggcagagtcacgacttaccgcgaacgaactaccaacgacgacactagtactatagtaggtattagaccagcctagacatcagagaccgacgcgtacttagtttgagtacgacagaaagagactcatacacgacgggcgggnacgtagtcggcacgcagtcg

SEQ ID NO: 385602 - DNA, 594 bp, Homo sapiens
  misc_feature: GZ8MTXP02FOSY0.19.1.A01.1.454.CMB.2.raw
  modified_base (325)..(325): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttcgtggggacaccttcacctcctattctatcaacgtgggtgcgacaacgcccctaggacaagggcttgagtggagtgggagagctactccctttnttagactactccagacctacgacacgagtaacgttccgagggacagagtaccacggtacttaccggacggtacgaactaccgaacgacgacacgtagtactaagtacgtaggtaacttcgaccagcctacgacactacgagaacggacgacggtccgttacttagttttgacgacgtaagaagaaagtataacttacattacgcgtacgggtacgggactacgtaagtcggaaccgaagcgacgtcgtaggtacgtacgggtacggggg

SEQ ID NO: 385603 - DNA, 529 bp, Homo sapiens
  misc_feature: GZ8MTXP02H562J.19.1.A01.1.454.CMB.2.raw
  modified_base (268)..(268): a, c, t, g, unknown or other
  modified_base (316)..(316): a, c, t, g, unknown or other
  modified_base (358)..(358): a, c, t, g, unknown or other
  modified_base (380)..(380): a, c, t, g, unknown or other
  modified_base (444)..(444): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctggtgaaagtttcctgcaaggcttcgtggggacaccttcacctcctattctatcaactggtncgacaagcccctggacaaggcttgagtggatgggaggagcatcctttnttgatactccagactacgcacagaagttccagggcagagtcncgattaccgcggacatcacgancacatctatatggtaattcgaccagcctagacatcagacggacaccggtccgtacttattttgngcgaacagaaagagtattacatactcgaacggcggggcacgtagtcggctacggacacgacgtacgtacgtacgggttacggggg

SEQ ID NO: 385604 - DNA, 593 bp, Homo sapiens
  misc_feature: GZ8MTXP02GQIAO.19.1.A01.1.454.CMB.2.raw
  modified_base (224)..(224): a, c, t, g, unknown or other
  modified_base (273)..(273): a, c, t, g, unknown or other
  modified_base (327)..(327): a, c, t, g, unknown or other
  modified_base (462)..(462): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctgaggtgaggaagcgtgggtcctcggtgtaaagtttccngcaaggcttcgtggggactaccttcacctcctattctatcaacgtggtncgacaacgcccctaggacaaggcttgagtggagtgggagagctacttccctttnttagatactcagactacgacacagtaacgttccgagggacaaggacgtacacggtacttaaccggacggaacgtaactccgaacgacgaccaacacgtactaatagtagtaattcgaaccagaccctagaactanacaggaacggacgaccgggtaccttacgttaagtttttgacggtacgaacgaagaaagagtacttacaattacacgaacgggcgggactacgtagacgaacacggctacgacgtagacgtacggtacgggg

SEQ ID NO: 385605 - DNA, 558 bp, Homo sapiens
  misc_feature: GZ8MTXP02H5YQX.19.1.A01.1.454.CMB.2.raw
  modified_base (338)..(338): a, c, t, g, unknown or other
  modified_base (473)..(473): a, c, t, g, unknown or other
  modified_base (483)..(483): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttctctttgcggtggcagcagctacaggtgtccagtcccaggtgcagctggtgcagtcgtggggctggaggtgaggaagccgtgggtcctcggtgaaagtttcctgcaaggtctcgtgggacaccttcaccctcctattctatcaacgtgggtgcgacaacgcccctaggacgaagggcttggagtggagtgggaggaagctattccctttnttgactactcagacctacgcacagtacgtcgagggcagatcgacgacttacccggacgtaacgaactaccgagacgcaacagttactaatagtagaattcgaccacgctagacatacaggacgacgacggtcgtnttagttttgngacgaacgaagaaaacgtagaacttacaactcgtacgacgggcggtaacgtacgtagcggacgacgactacgacg

SEQ ID NO: 385606 - DNA, 641 bp, Homo sapiens
  misc_feature: GZ8MTXP02F43AL.19.1.A01.1.454.CMB.2.raw
  modified_base (277)..(277): a, c, t, g, unknown or other
  modified_base (330)..(330): a, c, t, g, unknown or other
  modified_base (338)..(338): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctggaggtggaggaagcgtgggtcctcggtagtaagtttcctgcaaggtcttcgtggggacctaccttccacctcctattctatcaacgtggngcgacacgcccgtaggacgaggctgagtggagtggggagagctacttcctttnttgatacncagactacgacacgagacgtcgaggacagacgacgtaccgtatacccggacggaacgaactacccgaacgagaccaacgtaagttactaagtaatacggtaaatccgaaactcgacctaagactaacgaccggaaggtaaccggtacgaccccgggttacgtttaccgtttacgtttttacggacgaacggtaaacgaaggaaaacgtagtacttaaccgacttacgacgtacggggacggaccgtaagttacgtacgaacgacgtacgacggtctaaacgggacgtttacggggtacggggg

SEQ ID NO: 385607 - DNA, 747 bp, Homo sapiens
  misc_feature: GZ8MTXP02J134A.19.1.A01.1.454.CMB.2.raw
  modified_base (352)..(352): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcaggtcgtggggctggaggtgaggaagccgtgggtcctcggtagtaaagtttcctgacaaggtccttcgtgggacctccttcacccttcctattctatcgtaacgtgggtcaccgaacgtaaccgccccgtaggaacgaaggggtcttaggagggtcgggagtaggggaagggtaaacncctaacgtttcccccttttgttacgaacttacctaccgaacgtaccctacggaccaacgtaccggtaaacgttccgaacgggacgtaaggaccgttacgaccgtaacgttaccccggggacgtaaacgaacgtaccgaacggacacgaacctaggtactaaagtacgtagtaattcgaaccgacgaccttagaaccacgtacgaaaccgggaggtaccccggtaacgggttccctttagtttaagttttcggaccggaacgttaaaacgaaaggaaaagtacgtaaccttaacccgaagttaccgaaaccgggtacgggaccggggtaccaacgttaggacggaacgttacggagttaccgtacgtaggtaaaccgtttcgggggtaaccggggg

SEQ ID NO: 385608 - DNA, 617 bp, Homo sapiens
  misc_feature: GZ8MTXP02F8JK5.19.1.A01.1.454.CMB.2.raw
  modified_base (278)..(278): a, c, t, g, unknown or other
  modified_base (397)..(397): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagccgtgggtcctcggtgaaagtttcctgcaaggcttcgtggggacaccttcaccctctattctatcaactgggtncgacaagcccctggacaagggcttgagtggagtgggagaagctacttcctttctttgatactaccagtaccctacgcacgagtaacgttccgagggtcagagtacacgtattacccggnggaacgaactccaacgacgcaacagtactagtataggaacttgaccaagcctagaccataccgaggacgaacccgtaccggggtacctttacgtttaacgtttttcggacgtaccggtaaaccggtaaaagaaaaacgggtataaccggtttaaccaaacgttaccgttacggaacgggtccggggaactacgtaacgtcggaccaaggccgaagtccgg

SEQ ID NO: 385609 - DNA, 701 bp, Homo sapiens
  misc_feature: GZ8MTXP02JVRES.19.1.A01.1.454.CMB.2.raw
  modified_base (221)..(221): a, c, t, g, unknown or other
  modified_base (234)..(234): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctgaggtgaggagcgtgggtcctcggtgaagtttccngcaaggtcttcgngggacctaccttcacctctattctatcaacgtggtcgacgacacgcccctaggacaagggtcttggagtggagtggggaagacgctacgtttccctttcgtttgaacttcctaccgacgtaaccgtaccgacacgaacggtaacgtccgaagggcaaggacgttacacgtaacttacccggacggtaaacgaacgtcccgaaacggcggaacctaacgtaacgttacgtaaacgttaagtaacgggtaaacttcggaaaccctaacggtacccgttaggaacctaaagtaccgaaggaaccgggtaaccgaccgggtaccgtttacctttagttttacggtacgacgtaacgaacgggtaaaatacgtaactttacccgattaccgtcgggaacgggccggggtacaacgttaggacggaacgtaaccgagtacggtccgtaagtacgggtaacgggtaaccggggg

SEQ ID NO: 385610 - DNA, 636 bp, Homo sapiens
  misc_feature: GZ8MTXP02FMPET.19.1.A01.1.454.CMB.2.raw
  modified_base (338)..(338): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcaggtctggggctggaggtgaggaagccgtgggtcctcgggtgaaagtttcctgcaaggcttcgtggggaccacccgttcacctcctattctatcaacgtgggtgcgacaacgcccctggaacgaagggtcttggagtggataggggaggagctattcccctttnttgactactcacgactacgcacacgtagtccgagggcaaggacgttacgacgtacgtaccggcggaaccgaactccgaacgacgacaacgtagtacttaagtaagtacggtaaattcggaacctaggtacctacgaactaagtacgaggaacggaccgtaccgggtccgtttacgttagtttttaggacgtacggtaaacgaagaaaacggtataacttaccaacgttacgcggaaacgggcgggtacctaacgtagtcggaaccagaccgaagctaaggacgttacgggtacggggg

SEQ ID NO: 385611 - DNA, 712 bp, Homo sapiens
  misc_feature: GZ8MTXP02I20L1.19.1.A01.1.454.CMB.2.raw
  modified_base (370)..(370): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtggggctggaggtgaggaagccgtgggtcctcggtagtaaagtttcctggcaaggtcttcggtggggacctaccgttccaccttcctattcctatctaacgtgggtcgacgacaacggcccctaggaaccgaagggtcttggacgtggagtaggggaaggtaacgcgtaacttccccgtttttntttacggtaacttaccgtaccaagtaacccctaccgcctaacgaaggtaacgttccgagggcgtagacgtaccgaaccgtacgttaacccgggacgggtaaccgaaacgtacccgaacgacgaccaaacgtacgtaactaagttaagtaggttaaacgttacgaccacgccctaggaacctatacccgaaggaccggaacccgtaccggtacccgtttagtttaacgtttttcggacgtaacggtaacgtaaaaggaaacgtaacgttaaccttaccgtaaacgttacgtaccggacggggtaccggaacgtacgtaggtacgacgacgtacgacgttacgg

SEQ ID NO: 385612 - DNA, 643 bp, Homo sapiens
  misc_feature: GZ8MTXP02GRK01.19.1.A01.1.454.CMB.2.raw
  modified_base (322)..(322): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtgggctggaggtgaggagccgtgggtcctcggtagtaacgtttctgacgaggtcttcgtcgggacctaccttcaccctcttacttctactctaacgtgggtcgacgacaaccgccccgtaggaacgagggtctggnggtaggagtagggaggaagtctacgttcctttcttagtacttacctccgagtaccccacgacaactaacggtaacgtccgacgggtcgaggtacgtacgaaccgtacgtaccgggacggaaacaacgtccgaacggtacaccgactaacgttataattacgtacgttaatccgaacgaccgtctaagacctagtacggaagggacgaacccgtacggtccgtttagtttaacgtttggaacgacgaacgtaaagaaacgtacgtacttacgacttacgcgaacgggggacgtcgtaatcggtacggacacgtccaaggtcg

SEQ ID NO: 385613 - DNA, 574 bp, Homo sapiens
  misc_feature: GZ8MTXP02HI3BP.19.1.A01.1.454.CMB.2.raw
  modified_base (272)..(272): a, c, t, g, unknown or other
  modified_base (463)..(463): a, c, t, g, unknown or other
tcagtactctcgtgcacgaccggtgctcgatttagacgtctcatcagggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcgggtgaaagttttcctgacaaggcttcgtgggactaccgttcacctctatctatcaactggtnacgacaagccccgtaggacaaggcttgaggtgagtgggagaagcattcctttacgttgactctccagacctacgctacgacgaacgtcgagggcagagtcacgtacgttaccgcggaacaactccgaacgtacgacaacgacgtactaagtataggtaaattcgaacctagcctagacatacgagacgganacggacgttacttagttttgagacgagtaagaaagactattacacgtacgtacgacgggtcggactacgtacgaggaacgcgacacgtacgtacggtacgtacggtacggg

SEQ ID NO: 385614 - DNA, 754 bp, Homo sapiens
  misc_feature: GZ8MTXP02FRJHH.19.1.A01.1.454.CMB.2.raw
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtgggctggaggtgaggagccgtgggtcctcggtagtaaacgtttcctgacgaaggtcttcgtcgggacctaccttcacccttcctattctatcaacgtgggtcacgacaacgccccgtaggaacgaagggtcttaggaggtaggaggtaggggaacgggaagtccgttaacctttccccgttttagtttacgtaacctaccgtacccgaagtaaccccgtaccggaccaaacgtaacggtaacgttacccggaagggtccgaaggacgtacgtaaccgtaaccgttaacccgggacgggtaaccgaaacgtcccgaaaggtaacgccaaacgtagttacctaaagtttagtaacggggttaaacttaccgaacccgtacggtaccccgtaagtaaccgacgttacggaaacgggaacggtaacccgtaccgggttaccgtttacgttttaaggttttcggaacggtaccgtaaaacgaaaaggtaaaacggtaacttaacttaccgaaatacccgtagggaaccggggtacgggaactaacgtacggcggagacgacggtacgtacgg

SEQ ID NO: 385615 - DNA, 578 bp, Homo sapiens
  misc_feature: GZ8MTXP02HYGNE.19.1.A01.1.454.CMB.2.raw
  modified_base (231)..(231): a, c, t, g, unknown or other
  modified_base (277)..(277): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcaggtcgtggggctgaggtgaggagcgtgggtcctggtagtaaagtttccngcaggtcttgtgggacaccttcacctctattctatcaacgtgggtncgacacgccccgtaggacgaaggcttggagtggagtgggaggacgtctacttcctttcttagatactccagcctacgacacgagtacgtccgaggcagagtccagtacgtaccgacgaacgactccgacgagcacgtagtactatagtagattacgaccacgtctagactagtacgaggacgacgaccggtacctttagttacgtttttagcgtacgtaaccgtaagtaaaagtacgtacttacgaactacgacgtacgggacggggtaaccacggtagtcggacgtacgacgtacgtacg

SEQ ID NO: 385616 - DNA, 598 bp, Homo sapiens
  misc_feature: GZ8MTXP02F1XLJ.19.1.A01.1.454.CMB.2.raw
  modified_base (225)..(225): a, c, t, g, unknown or other
  modified_base (268)..(268): a, c, t, g, unknown or other
  modified_base (453)..(453): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtgggctgaggtgaggagctgggtcctggtagtaagttcngcaggtcttgcgggactaccttcacctctatctatcagtgggncgacacgcccgtggacaggctgagtggagtggagagctacttccctttgttcgactactaccgagtaaccctacgacaacgtacggtacgttccgaagggcgaagacgtacgaacgtacgtaaccggacgggaacgacgtaccgacgagacacgtactactatagtagtactacgaccataccgnaacactacgaacgtacgaccgtaccggtcgttactttagtttacgcgtaacgaacgtaacgtaaaagagtaccgttacaaacgttccgtaacggcggggtaccggaacggtacgttacggacgacgtacggtacgacggtaacgg

SEQ ID NO: 385617 - DNA, 530 bp, Homo sapiens
  misc_feature: GZ8MTXP02IUHUI.19.1.A01.1.454.CMB.2.raw
  modified_base (330)..(330): a, c, t, g, unknown or other
  modified_base (424)..(424): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctagtcaactgggtgcgacaagcccctggacgaagggctgacgtggatggaggaagcagttccctttntttgatactccagactacgcacagaattccagggcagagtcacattaaccgcggacgaactacacgagcacatcatatggaattgacagacctnacatacgagacgaccgacggtactgttatttgagcgaagaaacgaagtagaactactaataccgagacggacggaacgtaactacgtcggacgacgacgacgtacg

SEQ ID NO: 385618 - DNA, 609 bp, Homo sapiens
  misc_feature: GZ8MTXP02JBOHT.19.1.A01.1.454.CMB.2.raw
  modified_base (180)..(180): a, c, t, g, unknown or other
  modified_base (229)..(229): a, c, t, g, unknown or other
  modified_base (324)..(324): a, c, t, g, unknown or other
  modified_base (339)..(339): a, c, t, g, unknown or other
  modified_base (408)..(408): a, c, t, g, unknown or other
  modified_base (458)..(458): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtnccagtctgggctggaggtgaggagccgtggtcctggtagaaagtttccngcaaggtcttgtgggactaccttcaccttctattcgtatctaacgtgggtcgacgacacgccccgtggaacgaggtctggagtgagtaggaaganacgtacttccctttnttacgatacctccagaccctacgcacagtactcgagtcaggatccgacgcgttaaccgcggaactaacncgacgacgagaccagtactagtagtggaattacgacaggcctaggactanacgacgaacggaccgtaccggtcttacgttacgttttacgagacgtaacgaaggtaaacgtacggtaacctttacgaaaccgtttacgtaaccggaggggtacccggaagtaacccggttaaagcggacgacccgtagaaacgggttaccg

SEQ ID NO: 385619 - DNA, 679 bp, Homo sapiens
  misc_feature: GZ8MTXP02HKQVM.19.1.A01.1.454.CMB.2.raw
  modified_base (224)..(224): a, c, t, g, unknown or other
  modified_base (282)..(282): a, c, t, g, unknown or other
  modified_base (345)..(345): a, c, t, g, unknown or other
  modified_base (489)..(489): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagccgtgggtcctggtagaaacgtttccngcgaaggtcttcgtggggacctacccttcaccctccttattctatcgaacgtgggtcncgacaacgccccgtaggacgaaggtctgacggtggagtaggggagaagcctaacttccctttnttcgagttacctaccgagacctagaccacaacgtaacgttccgacggtacagacgtaccacggtacgttaccggacggacgaaccgtccaaacggacgaccagtaggtactaagtagttaggaactttacgaactcgtccgtanaacgactacgaacggacggaacccgtacggtccggtttacctttaagttttcgggtacgacgaaacgaggtaaaacgacggttacgttaacccacgttaaaccggccgaaacgggggtacccgggataaccgtttggacggaacgtcgacggtacgtacgtacggtaacggtacgggttaacccgggggg

SEQ ID NO: 385620 - DNA, 615 bp, Homo sapiens
  misc_feature: GZ8MTXP02FNM97.19.1.A01.1.454.CMB.2.raw
  modified_base (335)..(335): a, c, t, g, unknown or other
  modified_base (506)..(506): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtcgtggggctggaggtgaggaacgccgtgggtcctcgggtagtaaacgtttcctgcaaggtcttcgtaggggacctaccttcaccttcctattctatcaacgtggtgcgacacgcccgtaggacaggtcttgagtggagtgggagagctacttcctttnttgactacctacgagtactacgacacgaacgtacgtccgaggcagagtcacgacttaccggacggacaactaccgacgacgacacgagtactaatagtagaattcgaccacgcctagacagtacgaggacggaccgtacggtccgttacgtttagttttgacgacgtaaanaaggtaaagtacgtaactaccgtaactcgtacggcggggtaccgggactaaccgtagtcggaacgacggacgtaacggtcgtacggtaacggttacgggtacccggggg

SEQ ID NO: 385621 - DNA, 537 bp, Homo sapiens
  misc_feature: GZ8MTXP02JBSNI.19.1.A01.1.454.CMB.2.raw
  modified_base (233)..(233): a, c, t, g, unknown or other
  modified_base (321)..(321): a, c, t, g, unknown or other
  modified_base (331)..(331): a, c, t, g, unknown or other
  modified_base (350)..(350): a, c, t, g, unknown or other
  modified_base (470)..(470): a, c, t, g, unknown or other
  modified_base (522)..(522): a, c, t, g, unknown or other
  modified_base (527)..(527): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtccccgaggaagcctgggtcctcggtgaaagtttccngcaagcttctggggacaccgttcactccgtattctatcaactgggtgcgacaacgcccctggaccaagggctgagtggagtggaggancgattccttnttgatactcagacctacgnacagacgttccgagggccagacgtcacgacttaccggacggacgaactccaacgacgacacagttacatagtaggaattagaccaggcctgacatcgagacgacgcgcgtcttagtttgngcgacaagaacgagtacttaccgaatccgtacgacgggcgggaacacgttanacggnacgcaagtcg

SEQ ID NO: 385622 - DNA, 783 bp, Homo sapiens
  misc_feature: GZ8MTXP02FJLJL.19.1.A01.1.454.CMB.2.raw
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtgggctggaggtgaggagccgtgggtccgtcggtagtaaagtttcctgcgtaaggtcttcggtcgggacctacccttcacccttccttattactataccaacgtggggtacgaccgaccgtaaccggacccccgttgggaaacgtaacggggtcgtttagggaggttgggaaggttaggggaaaggtaaacggtcttaacccgtttcccccgtttttacgtttttacgactttaaccctacccgtaagtaacccccgtaaccgtaccaaagtaacgggttaaaaccttcccggggaacgggataacggggtacgtaccgtaaacgtaaccgttaacccgggaccgggaaaccgtaaaaccgtcccgaaacggaaacgtcccgaaaactagtttacaaacgtttaagaggggttaaaacttcgaacccgtaacggtcccctaaagaacccgtagtaacgaacgggaacggacccgtaacgggtccccgtttattttagtttcgacggagtaaacctaaggaaaacgtacttacgtaaccctagttaacccaggacggggcggtaacctagttacggacggcgaaagcgtaaccgtaag

SEQ ID NO: 385623 - DNA, 671 bp, Homo sapiens
  misc_feature: GZ8MTXP02FRLA2.19.1.A01.1.454.CMB.2.raw
  modified_base (237)..(237): a, c, t, g, unknown or other
  modified_base (446)..(446): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcgagctggtgcagtcgtggggctggaggtggaggacgccgtgggtccgtggtagtaaacgttccgngacgaaggtcttcgtcgggacctaccttcaccctctattctatcaagtgggtcgcgaacaacgcccctaggaacgaggtctaggagtggagtgggagagctacttccctttgttgactacgtaccaggtaccctacgaccaagacggtaacgtacccgagggcagacgttacgaacgtactaccggacggtaacgaacgtccaaacggnacctagagttacagttagtaggtacttacgaccgtaacgtccgagaacgtcgtaacggagggaaacccggaacccgtaaccgggttcccgtttacgtttttaacggtttggaccgaaccgttaagaaaaggtaacgaacgttaccttaaacctacgttaccgacgggtacggggaccggggtaactaacggttacgtaacgggctacggccgtaaggttaaccgg

SEQ ID NO: 385624 - DNA, 695 bp, Homo sapiens
  misc_feature: GZ8MTXP02J0RXN.19.1.A01.1.454.CMB.2.raw
  modified_base (327)..(327): a, c, t, g, unknown or other
tcagtactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggagcctgggtcctcggtgaaagtttcctgcaaggcttcgtggggaccaccttcaccttcctattctatcaacgtgggtgcgacaacgccccgtggaccaagggcttgagtggagtgggaggagcattccctttnttgactactccagactacgcacagacgttccagggcagacgtcacgtacttaccggcggtaacgaactcccaaacgacgacctaacgagttacctaattacgtacgggtaattacgaacccgtaggtcccctaggaacctaagtacgaacgggaacgggaaccgtaccgggttacccccgtttacgtttaagttttttcgggacgaccggtaaaccaaagggttaaaacggacgtaaactttaccccgaaagtaaccgttacgggaaacggggttacccgggggtacaaacccggttaagttccggggaaccacgggtacccgaaacgggtccttacgggtaacgtttaacccgggggttaccggggg

SEQ ID NO: 385625 - DNA, 570 bp, Homo sapiens
  misc_feature: GZ8MTXP02FL74A.19.1.A01.1.454.CMB.2.raw
  modified_base (321)..(321): a, c, t, g, unknown or other
tcagtactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtcgtgggctgaggtgaggaagcctgggtcctggtgaaagtttcctgcaaggcttcgtgggacaccttcacctctattctatcaacgtgggtgcgacacgcccctggacaggctgagtggagtggagagcactcccttnttgactactcagacctacgcacagtagtccgagggcagacgtcacgtagttaccgacggacgaactccgaacgagacacgtagttactagtagtaggaattacgacctacgcctagactatacgaaggacgaaccgacggtcgttacgtttagttttgagacgaacgtaaaggtaaaacgagtaacttaccaacgttaccgtacgacggggaccgggaactaacggtaagtcgggacacggacgagtcg

SEQ ID NO: 385626 - DNA, 504 bp, Homo sapiens
  misc_feature: GZ8MTXP01C7X34.51.80.H03.1.454.CMB.2.raw
  modified_base (304)..(304): a, c, t, g, unknown or other
  modified_base (432)..(432): a, c, t, g, unknown or other
  modified_base (450)..(450): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactatgtctctggtaccaacagcaccaggcaaacgcccccaaatcatgatttangagtcagtaagcgcctcgagggtccctgatcgccttctctgctccaaagtctggcaacacggccctccctgacccgtctctgggctcgaggctgaggatgaggctagattattactggtctgctcacntgcaggcagcagtcggtngctagttcggcggaggacgagcgtgaccgtcgtacggtcacgcccgaaggtccc

SEQ ID NO: 385627 - DNA, 488 bp, Homo sapiens
  misc_feature: GZ8MTXP01DPYPJ.51.80.H03.1.454.CMB.2.raw
  modified_base (304)..(304): a, c, t, g, unknown or other
  modified_base (321)..(321): a, c, t, g, unknown or other
  modified_base (372)..(372): a, c, t, g, unknown or other
  modified_base (413)..(413): a, c, t, g, unknown or other
  modified_base (441)..(441): a, c, t, g, unknown or other
  modified_base (444)..(444): a, c, t, g, unknown or other
  modified_base (455)..(455): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtggttataactatgtctctggtaccaacagcacccaggcaaagcccccaaatcatgatttangagtcagtaagcgcctnagggtccctgatcgcttctctggctccaaagtctggcaaacacggcctccngaccgtctctggctccaggctgaggatgagctgattatacnggctgctcacatgcaggcagcatcggtntgntagttggcggnggaccagctgaccgtctaggcacgccaaggtcc

SEQ ID NO: 385628 - DNA, 527 bp, Homo sapiens
  misc_feature: GZ8MTXP01A18T5.51.80.H03.1.454.CMB.2.raw
  modified_base (305)..(305): a, c, t, g, unknown or other
  modified_base (366)..(366): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctctggtaccaacagcacccaggcaaagcccccaaatcatgatttangagtcagtaagcgccctcgagggtccctgatcgccttctctggctccaaagtctggcaacncggcctcctgaccgtctctgggctccgaggctgacggatgaggctgattatactggctgctcacatgcaggcagccagtcggtgtgcttagttcgggcgggaacgggacccgaaggcctcggacccgtcctaaggggtccacggtccccgaaggggtcccc

SEQ ID NO: 385629 - DNA, 520 bp, Homo sapiens
  misc_feature: GZ8MTXP01AEE05.51.80.H03.1.454.CMB.2.raw
  modified_base (352)..(352): a, c, t, g, unknown or other
  modified_base (418)..(418): a, c, t, g, unknown or other
  modified_base (472)..(472): a, c, t, g, unknown or other
  modified_base (484)..(484): a, c, t, g, unknown or other
  modified_base (508)..(508): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactggaaccagcagtgacgttggtggttataactatgtctcctggtaccaacagccacccaggacaaacgcccccaaatcatgactttangagtcagtaaacgccggccctgacggggtccctgactcgcttctctggctccaagtctggcaaacncggccctccctgacctctcgtgggggctcgaggctggagatggaggctgtattntctgcttgcttnacattgcaggcagctagtcggttntcgcgttaaggg

SEQ ID NO: 385630 - DNA, 529 bp, Homo sapiens
  misc_feature: GZ8MTXP01CDHV6.51.80.H03.1.454.CMB.2.raw
  modified_base (308)..(308): a, c, t, g, unknown or other
  modified_base (313)..(313): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggacaaacgcccccaaatcatgatttangagtnagtaagcgccctcgagggtcctgatcgccttctctgcctcaaagtctggcaaacgacggccctcctgaccgtctcgtgggcctcgaggctggaggatgaggctgattattactggctgctcacatgcagcagctagtcggtgtgctagttcgggacgggtagggacccaaggccgtaaggacccgttcgtacgggtcacgaacccgaaggtccccg

SEQ ID NO: 385631 - DNA, 561 bp, Homo sapiens
  misc_feature: GZ8MTXP01CRCGG.51.80.H03.1.454.CMB.2.raw
  modified_base (230)..(230): a, c, t, g, unknown or other
  modified_base (307)..(307): a, c, t, g, unknown or other
  modified_base (422)..(422): a, c, t, g, unknown or other
  modified_base (458)..(458): a, c, t, g, unknown or other
  modified_base (480)..(480): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtggttataactatgtctctggtaccaacagcaccaggacaaacgcccccaaatcatgtatttangaggtcagtagccgcctcgacgggtccctgatcgccttctctggcctccaaagtctcggacaaccgaccggccctccctcgacccgtctcgtgggcctccgaggcctaggaggtntggaggctagtattattacgtggctgcctcactagngcgaaggctagcagttcgggtntcgcttacgttcgggacggacgggacccaggccttaacggacccgttccgtagggtaccacggtaaccccgaaggtccccg

SEQ ID NO: 385632 - DNA, 511 bp, Homo sapiens
  misc_feature: GZ8MTXP01E2PW6.51.80.H03.1.454.CMB.2.raw
  modified_base (306)..(306): a, c, t, g, unknown or other
  modified_base (460)..(460): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttaataactatgtctctggtaccaacagcacccaggcaaacgcccccaaatcatgatttangagtcagtaagcggccctcgagggtccctgatcgccttctctggctccaaagtctggaccaacaccggcctccctgaccgtctcgtgggctccgaggctgaggatgaggctgattattactgggctgctcacatgcaaggcaagcagtcgggtntgctattcgggcggaagggaccaagctgaccgtctaggcagcccaaggccc

SEQ ID NO: 385633 - DNA, 514 bp, Homo sapiens
  misc_feature: GZ8MTXP01EOTHJ.51.80.H03.1.454.CMB.2.raw
  modified_base (231)..(231): a, c, t, g, unknown or other
  modified_base (313)..(313): a, c, t, g, unknown or other
  modified_base (460)..(460): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtggttataactatgtctctggtaccaacagcaccaggacaaacgcccccaaactcatgatttatgagtnagtaagccggcctcgacggggtccctgactcgccttctctggctccgaaagtctggacaacaccggcctccctgaccgtctcgtggcctcgagctgaggatgaggctgattattactgggcttgctcacatgcaggcagcagtcggntgctagttcggcggagggaccaggctgccgtccgaggtcacgcccgaagtcccg

SEQ ID NO: 385634 - DNA, 505 bp, Homo sapiens
  misc_feature: GZ8MTXP01ED32Q.51.80.H03.1.454.CMB.2.raw
  modified_base (308)..(308): a, c, t, g, unknown or other
  modified_base (459)..(459): a, c, t, g, unknown or other
tcagcgatcgtatacacgaccggtgctcgatttagctgtgcgtcgaaggaaaggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttaataactatgtctcctggtaccaacagcacccaggcaaacgcccccaaatcaatgatttangaggtcagtaagcggccctcgaggggtccctgatcgccttctctggctccaaagtctggcaacacggcctccctgaccgtctctgggctccgaggctgaggatgaggctgattattactggcttgctcacatgcaaggcagctagtcggtntggctagttcggcgagggacagctgacgtctaggcagccaaggtcc

SEQ ID NO: 385635 - DNA, 510 bp, Homo sapiens
  misc_feature: GZ8MTXP01DXNXS.51.80.H03.1.454.CMB.2.raw
  modified_base (349)..(349): a, c, t, g, unknown or other
  modified_base (421)..(421): a, c, t, g, unknown or other
  modified_base (429)..(429): a, c, t, g, unknown or other
  modified_base (464)..(464): a, c, t, g, unknown or other
  modified_base (481)..(481): a, c, t, g, unknown or other
  modified_base (491)..(491): a, c, t, g, unknown or other
  modified_base (499)..(499): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcacccctcctcactcagggcacagggtcctgggcccagtctgccctgactcagcctccctccgcgtccggtctcctggacagtcagtcaccatctctgcactggaaccagcagtgacgttggtgttataactatgtctcctggtaccaacagcacccaggacaaacgcccccaaatcatgatttangagtcagtaaacgcgccctgacggggtccctgactcgcttctctgctcaagtctggacaacacggcctcccngaccgtcncgtcggggctccgaggctgagatgagtctgtattnttactgcttgcttcacnttgcaggcancagtcggntgcttaacggg

SEQ ID NO: 385636 - DNA, 563 bp, Homo sapiens
  misc_feature: GZ8MTXP01B2G8F.51.80.H03.1.454.CMB.2.raw
  modified_base (229)..(229): a, c, t, g, unknown or other
  modified_base (304)..(304): a, c, t, g, unknown or other
  modified_base (331)..(331): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactggaaccngcagtgacgttgtggttataactatgtctctggtaccaacagcaccaggacaaacgcccccaaatcatgatttangagtcagtaagcgcctgacgggtcccngatcgtccttctcgtgcctacccgaaagttcctggacctaaaccgcccgggtcccctccccgtggaccccgttctccgtgggcctccgaggctaggaggtatggaggctagtattaagttactgggtcttgaccttcaactgtgacgaaggccaggcctaagtcggtgtcgttcgttagttcgggacggagggaccgagctcgaccgtctagggcagcccgttaaggtcccg

SEQ ID NO: 385637 - DNA, 516 bp, Homo sapiens
  misc_feature: GZ8MTXP01D6N9J.51.80.H03.1.454.CMB.2.raw
  modified_base (308)..(308): a, c, t, g, unknown or other
  modified_base (370)..(370): a, c, t, g, unknown or other
  modified_base (406)..(406): a, c, t, g, unknown or other
  modified_base (433)..(433): a, c, t, g, unknown or other
  modified_base (435)..(435): a, c, t, g, unknown or other
  modified_base (441)..(441): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttaataactatgtctcctggtaccaacagcacccaggacaaacgcccccaaaatcatgatttangagtcagtaagcgccctcgagggtccctgatcgccttctctggctccaaagtctggcaaacncggccctcctgaccgtctcgtggctcgagctggagntgaggctgattattactggctgctcangngcagcngctgtggtgtcgttcgtaggttcgggacgggaacggaccgagcgtaacgccgtcgtacggcacgcccgaagtccg

SEQ ID NO: 385638 - DNA, 590 bp, Homo sapiens
  misc_feature: GZ8MTXP01BWCBR.51.80.H03.1.454.CMB.2.raw
  modified_base (308)..(308): a, c, t, g, unknown or other
  modified_base (507)..(507): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctcctggtaccaacagcacccaggacaaacgcccccaaatcatgatttangagtcagtaagccggccctcgacggggtccctgactccgtcctttctcgtggcctccgaaaagtctggaccaaaccgaccgggcccctcccgtcgacccgttcctcgtcggggccttccgaggtcctggaacggtatggacgggcttagaatttagtttaccgtggcttgccttcacagtcgcaggcagccagttcggngtgcgttagttccgggacggtacgggacccaaggccgtaacggaccccggtcttacgggccacggtaaccccgaaggtccccg

SEQ ID NO: 385639 - DNA, 574 bp, Homo sapiens
  misc_feature: GZ8MTXP01BCOLW.51.80.H03.1.454.CMB.2.raw
  modified_base (230)..(230): a, c, t, g, unknown or other
  modified_base (306)..(306): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtgttaatactatgtctctggtaccaacagcaccaggaccaaacgcccccaaatcatgatttangagtcagtagcgcctgacgggtccctgactcgtccttctcgtcggctccaaagtctcggacaaacgaccggccctccgtcgacccgtctcgtcgggcctccgaggctggaggatggagctagtattattacgtggctgctacactagtcgacgacgggctaacgcgtagttccgggtgtcggacgttaggttccgggacgggtaacgggaccgttaaggccgtaacggacccgttccgtacggtcgaccggcccgttaacggtccccg

SEQ ID NO: 385640 - DNA, 706 bp, Homo sapiens
  misc_feature: GZ8MTXP01BPRLZ.51.80.H03.1.454.CMB.2.raw
  modified_base (201)..(201): a, c, t, g, unknown or other
  modified_base (274)..(274): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtcctcgtgacngtcagtccactactcctcgtgacctacgtacgaaccagcgtaggtacgtacggtttggttagttaactaactntcgtcctcgtacgaaccacgacgacccaccgagaaccaaacccaccccaatcagtagtatttagagtacgtataacggtacggcccgtcctacgggtaccggtcctagtctccgtccttcgtcgtcgtcctaacgtaacgttcgcgacctaaccgccgtccctccgtacgtccttgtcggtcggtcctacggcggtacgtagggaagtgtaggacggttcttagttaactttacgttacgtcgggtcttcgtacctacgaagtcgtcggacggtaacggcaacggtacgttccgggtttgggtaacgttacgttacgggttacgggaccggggaaaccggggtaaccgttaaccgttccgggttcccgttaacccgggttacccgttcgggtaccggacccggacccggtaacccgggttaacccgtccccg

SEQ ID NO: 385641 - DNA, 512 bp, Homo sapiens
  misc_feature: GZ8MTXP01EURTK.51.80.H03.1.454.CMB.2.raw
  modified_base (307)..(307): a, c, t, g, unknown or other
  modified_base (465)..(465): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtggttataactatgtctctggtaccaacagcacccaggacaaacgcccccaaaatcatgatttangagtcagtaagcgcctgaggggtccctgatcgccttctctgcctccaaagtctggcaacacgggcctccctgaccgtctctcgggctccgagctgacggatgaggctgattattactggctgctcacatgcaggcagcagtcggtgtgctagttcggnggacgggacgacgcgtcgaccgtccgtaggtcacgcccgaagtcccg

SEQ ID NO: 385642 - DNA, 566 bp, Homo sapiens
  misc_feature: GZ8MTXP01C74YE.51.80.H03.1.454.CMB.2.raw
  modified_base (531)..(531): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctcctggtaccaacagccacccaggacaaacgcccccaaatcatcgtactttatagagtcaaggtaaaacgccggcccctcgaacgggggtcccctgactcgtcttctctggcttccgaagtctggactaacgaccggccctccccgtgacccgttctccgtgggggccttcccggaaggtcctagaggtatggaacggtctagtatttagttactggcttgcttcgaacnttacgcaggcagctagtcggttgtcgcgttaacgg

SEQ ID NO: 385643 - DNA, 604 bp, Homo sapiens
  misc_feature: GZ8MTXP01EJK9R.51.80.H03.1.454.CMB.2.raw
  modified_base (246)..(246): a, c, t, g, unknown or other
  modified_base (272)..(272): a, c, t, g, unknown or other
  modified_base (305)..(305): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaaccagcagtgacgtttggngttaataactatgtctctgtaccaanagcaccagacaaacgccccaaatcatgatttangagtacagtaagccgcctcgagggtccctgctcgtcctctcgtgtcctacgtaacgtcgtcggacctaaccgacccgtccctccgtccggtacctcctcggtcgtcctaccggagtcgtaggtaggtagtaggtacgtacgtattaactttaacgttacgtcggtctcgtctaccagtacgtcgacgaacggcaacgtcgtacggttcgggtgtacggttacgttcgggttaccgggacgggaacggaaccgttagcgtaaccgtaccgtcggttacgacgacgaaccgaacgtccccg

SEQ ID NO: 385644 - DNA, 548 bp, Homo sapiens
  misc_feature: GZ8MTXP01BZ2SM.51.80.H03.1.454.CMB.2.raw
  modified_base (347)..(347): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccagcagtgacgttggtgttatactatgtctcctgtaccaacagccaccagcaaacgcccccaaatcatgtacttangagtcagtaaagcgcctcgacgggtccctgactcgcttctctggctcaagtctggaccacgaccggccctcccgtcgaccgtctcgtcgggggctccgaggctggacggatggacggtctagtatttacttacgtcggtcttgccttcaacgtagttcgcgagggccaggcctaggtccgggttgtcgttcgtttaacggg

SEQ ID NO: 385645 - DNA, 513 bp, Homo sapiens
  misc_feature: GZ8MTXP01AWXRI.51.80.H03.1.454.CMB.2.raw
  modified_base (300)..(300): a, c, t, g, unknown or other
  modified_base (338)..(338): a, c, t, g, unknown or other
  modified_base (436)..(436): a, c, t, g, unknown or other
  modified_base (454)..(454): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactatgtctctgtaccaacagcaccagcaaacgccccaaatcatgatttangagtcagtaagcgcctcgagggtccctgactcgcttcnctgctccaaagtctggcaaaccgacggccctccctgacccgtctcgtcgggctccgagctagacggatgaggctgtattattactggcttgctacacntgctaggcagcatcggtntgctagttcgggacggtaggacccagctgacccgtcgtaggcacgcccgaaggtccccg

SEQ ID NO: 385646 - DNA, 603 bp, Homo sapiens
  misc_feature: GZ8MTXP01C1R8H.51.80.H03.1.454.CMB.2.raw
  modified_base (301)..(301): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggaaccagcagtgacgttggtgttataactatgtctctgtaccaacagcaccagcaaacgcccccaaatcatgattangagtcagtaagcgccctcgacggggtccctgatccgccttctcgtggcctccaaagttctgggacctaaaccgaccgggtcccctccccgtcgacccgttccgtcgttcgggcctacccgaggctaggaggagtggaggtctagtattagttactggcttgcctcactagtcgacgaggctaaggcctagtccgggtgtcgttacgttagttccggggacgggtaacgggacccgaaggttcccgtaacggtacccggttccgttaacgggtccgaaccggtccccggaaagggtcccccgg

SEQ ID NO: 385647 - DNA, 529 bp, Homo sapiens
  misc_feature: GZ8MTXP01D4CIU.51.80.H03.1.454.CMB.2.raw
  modified_base (403)..(403): a, c, t, g, unknown or other
  modified_base (406)..(406): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactatgtctctggtaccaacagcacccaggcaaacgcccccaaatcatgatttatgaggtcagtaagcggcctcagggtccctgatcgcttctctgctccaaagtctggcaacacggccctccctgaccgtctctgggctccaggctggaaggntgngctgtattattactggtctgctacactagtgacgaggctagctacggtcggtgtcgttcgttagttccgggacggacggaccacgcgtcgacccgtcgtacggccaccgtcccgaacggtccg

SEQ ID NO: 385648 - DNA, 553 bp, Homo sapiens
  misc_feature: GZ8MTXP01AMYZ6.51.80.H03.1.454.CMB.2.raw
  modified_base (303)..(303): a, c, t, g, unknown or other
  modified_base (434)..(434): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctctggtaccaacagcaccaggcaaagcccccaaatcatgatttangagtcagtaagcggccctcgaggggtccctgatcgccttctctggctccaaagtctggcaaacacggccctcctgaccgtctcgtgggcctccgaggctgaggatgagctgattattactggctgctcacntgcgaggcagccagtcgggtgtcgctacgttcgggacgggaacggggaacccaagccgttaacgggaccccgttaaccgttaaggggtccaacggtccccgttaaacgggggtcccccg

SEQ ID NO: 385649 - DNA, 573 bp, Homo sapiens
  misc_feature: GZ8MTXP01EDT6T.51.80.H03.1.454.CMB.2.raw
  modified_base (270)..(270): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggaaccagcagtgacgttggtgttataactatgtctctggtaccaanagcacccaggcaaacgcccccaaactcatgatttatgaggtcagtaagccggccctcgacgggggtccctgactcgtccttctcgtggccttaccaaagtctggaccaaaccaccggccctcccgtgaccgttctcgtgggcctcgaggcctggaggtatggaggtctgtaattacttactggtctgccttacaacatgcaggctagctcgtcggtgtcgcttacggttcgggcgggaacgggttaccgacggttccgtaacggtacccgtcgtaacgggtccacggccccgaaggtcccccg

SEQ ID NO: 385650 - DNA, 580 bp, Homo sapiens
  misc_feature: GZ8MTXP01C4J2X.51.80.H03.1.454.CMB.2.raw
  modified_base (268)..(268): a, c, t, g, unknown or other
  modified_base (302)..(302): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactggaaccagcagtgtacgttggtgttataactatgtctctgtacaacngcaccaggacaaacgcccccaaatcatgatttangagtcagtacgccggccctcgacgggtccctgactcgtccttctctcggcctaccgaaagttctgggaccaaccgaccggccctcccgtgacccgttctcgtcgggcctcgaggctggaggtatggaggctagtatttacttactggtctgtcctacactagtcgcgaaggcacggtcaacggttcggttgtcgttacgttagttccggggacgggaacgggaccaggcctcggtacccgttccggttaaggtcccgaccgtccccgaagggtccccg

SEQ ID NO: 385651 - DNA, 498 bp, Homo sapiens
  misc_feature: GZ8MTXP01DINUM.51.80.H03.1.454.CMB.2.raw
  modified_base (306)..(306): a, c, t, g, unknown or other
  modified_base (321)..(321): a, c, t, g, unknown or other
  modified_base (329)..(329): a, c, t, g, unknown or other
  modified_base (339)..(339): a, c, t, g, unknown or other
  modified_base (415)..(415): a, c, t, g, unknown or other
  modified_base (423)..(423): a, c, t, g, unknown or other
  modified_base (432)..(432): a, c, t, g, unknown or other
  modified_base (443)..(443): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtggttataactatgtctcctggtaccaacagcacccaggcaaacgcccccaaatcatgatttangagtcagtagcgccnagggtccngatcgcttcntgctcaaagtctggcaacaccggcctcccgtgaccgtctctgggcctccgaggctgaggatgaggctgattatacnggctgctnacatgcagnagcagtcggtntgctagttcgggacggaggaccgagctgacccgtctaggcacgtcccaaggtccc

SEQ ID NO: 385652 - DNA, 582 bp, Homo sapiens
  misc_feature: GZ8MTXP01BVZO3.51.80.H03.1.454.CMB.2.raw
  modified_base (230)..(230): a, c, t, g, unknown or other
  modified_base (244)..(244): a, c, t, g, unknown or other
  modified_base (305)..(305): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggngttatactatgtctctggtaccaacagcaccaggaccaaacgcccccaaatcatgatttangagtacagtaagccggaccgtaagggtccctagactcgtcttcctcgtggctccagtctggccaacgacggccctcccgtgacccgtctcgtggcctccgaggcctaggaggtacgtaggaggtcctaggtatttacgttacgtggtctcggtccttaccaccgtagtcgcgaggaccagcctagtccggtgtcgcgttaggttccgggacggaacgggaccaagttccgacggtaaccgtccgtaacggtcgacgcccgaacggttcccgtcccgg

SEQ ID NO: 385653 - DNA, 509 bp, Homo sapiens
  misc_feature: GZ8MTXP01DM1FQ.51.80.H03.1.454.CMB.2.raw
  modified_base (304)..(304): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactatgtctcctggtaccaacagcacccaggcaaagcccccaaatcatgatttangagtcagtaagcgccctcgagggtccctgatcgccttctctggctccaaagtctggcaacgacggccctccctgaccgtctctgggctccgaggctgaggatgaggctgattattactggctgctcacatgcaggcagcagtcggtgtgctagttcgggcgggacggaccgagctggacccgtctaggcacgcccgaaggtcccg

SEQ ID NO: 385654 - DNA, 541 bp, Homo sapiens
  misc_feature: GZ8MTXP01EZ7WL.51.80.H03.1.454.CMB.2.raw
  modified_base (274)..(274): a, c, t, g, unknown or other
  modified_base (352)..(352): a, c, t, g, unknown or other
  modified_base (464)..(464): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcacgcctccctccgcgtccgggtctcctggacagtcagtcaccatctcctgcactggaaccngcagtgacgttggtgttataactatgtctctggtaccaacagccaccaggacaaacgcccccaaatcatgtactttangagtcagtaaacgcgccctgacggggtccctgactcgcttctctgctcagtctggaccaacaccggtcctccctcgaccgtctcgtcgggggctcccgaggtcgtggacggngtaggacggctagtaatttacttacgtggcttgccttcaacgtacttgcaggcagcagttcggttgtgttcgttcgg

SEQ ID NO: 385655 - DNA, 619 bp, Homo sapiens
  misc_feature: GZ8MTXP01DLEIV.51.80.H03.1.454.CMB.2.raw
  modified_base (229)..(229): a, c, t, g, unknown or other
  modified_base (253)..(253): a, c, t, g, unknown or other
  modified_base (267)..(267): a, c, t, g, unknown or other
  modified_base (299)..(299): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtgttataactntgtctctgtaccanagcaccagcaaacgccccaaatcatgtatttngaggtcaggtaagccggccctcgacggggtccctggatccgtccttctcgtggtcctaccgaaaacgttcgtggaccaaaccgtacccgggtcccctccccgtggacccgtcgtcgtcggggcctccgaggtccttaggaaggtgtggacggtcttagtaatttaattccgtggggtccttgccttaccattgcgcgaaggctagctagtcgggtgtcgttcgttacggttcgggacgggtaacggaacccgaagttccggttccggtaaccccgttcgttaacggggtacccacgggtaacccccgaagggtcccccgg

SEQ ID NO: 385656 - DNA, 582 bp, Homo sapiens
  misc_feature: GZ8MTXP01EOX4B.51.80.H03.1.454.CMB.2.raw
  modified_base (230)..(230): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtgttatactatgtctctgtaccaacagccaccaggaccaaacgccccccaaatcatgtaatttagtagaggtacaggtaacgcccggtccctcgacggggttccctgactccgtccttctcgtcggcctaccgaaagtctggaccaaacgaccggtccctcccgtcgacccgtctcgtcgggcctaccgaggtctaggaaggtatggaggtctagtattatactggctgctacactagtcgcgaggctagctagtcggtgtcgttacgtacggttcgggacgggaacggaaccgagccgtaacgacccgtccgtacggcaccgaacccgaaggtccccg

SEQ ID NO: 385657 - DNA, 546 bp, Homo sapiens
  misc_feature: GZ8MTXP01CE8AJ.51.80.H03.1.454.CMB.2.raw
  modified_base (311)..(311): a, c, t, g, unknown or other
  modified_base (345)..(345): a, c, t, g, unknown or other
  modified_base (475)..(475): a, c, t, g, unknown or other
  modified_base (505)..(505): a, c, t, g, unknown or other
tcagcgatcgtatacacgaccggtgctcgatttagctgtgcgtcgaaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttatactatgtctctgtaccaanagcaccagacaaacgccccaaatcatgactttangagtcagtaaacgccgccctgacggggtccctgactcgtcttctcgtcggctaccgaagtcctaggaccaaaccgtccggccctacccgtcgacccgttctccgtcggggggccttccgaggcgtggagntggagctgatttatactgtcttgcttgacnttacgcacggcaggcctagtcggttgtcgttcgttaacggg

SEQ ID NO: 385658 - DNA, 538 bp, Homo sapiens
  misc_feature: GZ8MTXP01DBJUD.51.80.H03.1.454.CMB.2.raw
  modified_base (302)..(302): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactatgtctctgtaccaacagcaccagacaaacgcccccaaatcatgattangagtcagtagcgcctcgagggtcctgatcgcttctctggctccaaagtctggacaaacgaccggccctcccgtgaccgtctcgtcgggcctccgagctaggagatgaggctagtatttacttacgtggtctgctcactatgcaggcagcagtcggtgtgcgttaggttcggacgggacgggaccaaggttccgtaacggtacccgtccgtaggtccaacgtccccgaaggtccccg

SEQ ID NO: 385659 - DNA, 581 bp, Homo sapiens
  misc_feature: GZ8MTXP01ANS6S.51.80.H03.1.454.CMB.2.raw
  modified_base (269)..(269): a, c, t, g, unknown or other
  modified_base (302)..(302): a, c, t, g, unknown or other
  modified_base (428)..(428): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcactatctcctgcactggaaccagcagtgacgttggtgttatactatgtctctgtaccaanagcaccagacaaacgccccaaatcatgatttangagtcagtaagcggcctcgacgggtccctgactcgtccttctcgtggtcctcaaaagttcgtggaccaaaccgccgggcccctcccgtgtacccgttctcgtcgggcctccgaggtctaggaggtntggagtctagtaatttattacgtggtctgtcctacactagtcgacgaggcctagctagtcggtgtcgttacttggttccggggacggacgggaaccaggttccgtaacggtacccgtccgttaacggtcccgacgtccccgaagggtcccccg

SEQ ID NO: 385660 - DNA, 538 bp, Homo sapiens
  misc_feature: GZ8MTXP01C0EC9.51.80.H03.1.454.CMB.2.raw
  modified_base (230)..(230): a, c, t, g, unknown or other
  modified_base (303)..(303): a, c, t, g, unknown or other
  modified_base (455)..(455): a, c, t, g, unknown or other
  modified_base (473)..(473): a, c, t, g, unknown or other
  modified_base (499)..(499): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtgttataactatgtctcctgtaccaacagcaccagcaaacgcccccaaatcatgatttangagtcagtagccggccctcgacgggtccctgatccgtccttctctggcctcaaacgtctggacctaaaccgaccggccctccctgtacccgtctcgtcgggcctcgaggctaggaggatcggaggctagtattactacgtggtctgctacantgcaggcagcagtcggtntgctacgttcggacggaggaacccgnggcctaagacccgtcgttaggcacgcccgttaagtcccg

SEQ ID NO: 385661 - DNA, 566 bp, Homo sapiens
  misc_feature: GZ8MTXP01DGZOL.51.80.H03.1.454.CMB.2.raw
  modified_base (229)..(229): a, c, t, g, unknown or other
  modified_base (302)..(302): a, c, t, g, unknown or other
  modified_base (428)..(428): a, c, t, g, unknown or other
  modified_base (446)..(446): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtgttataactatgtctctgtacacagcaccaggacaaacgcccccaaatcatgtatttangagtcaagtaagccggccctcgacggggtccctgatcgtccttctctcggtcctccgaaaagttctgggacccaaacgacccgggtccctcccctgacccgtctcgtgggcctccgaggctgaggntcggagctgattattacnggtctgcctcacatgcgaggcagccaagtcgggtgtcgcgtagttcggggacggacgggttaccgaaggttcctaacggtacccgttccgtaacgggtcacggtccccgaagggtccccg

SEQ ID NO: 385662 - DNA, 549 bp, Homo sapiens
  misc_feature: GZ8MTXP01ESM9X.51.80.H03.1.454.CMB.2.raw
  modified_base (229)..(229): a, c, t, g, unknown or other
  modified_base (300)..(300): a, c, t, g, unknown or other
  modified_base (469)..(469): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggaaccngcagtgacgttggtgttataactatgtctctgtaccaacagcaccagacaaacgccccaaatcatgattangagtcagtagcgcctcgagggtccctgactcgtccttctcgtcggcctacccgtaaagtccgtcggaccaaaccgacccgggtcccctccccgtcggacccgttcctcgtcgggctccgaggctaggaggtatggacggtctgaatttacttactgggtctgcctcacntgcaggcagctagtcggtgtgcgtagttcggacggacggaccgagcgtcgtaccgtctaaggcttacgcccgaaggtccc

SEQ ID NO: 385663 - DNA, 571 bp, Homo sapiens
  misc_feature: GZ8MTXP01C0CFW.51.80.H03.1.454.CMB.2.raw
  modified_base (306)..(306): a, c, t, g, unknown or other
  modified_base (479)..(479): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactatgtctctggtaccaacagcaccaggacaaacgcccccaaatcatgtatttangaggtcagtacgccggccctcgagggtccctgatcgtccttctcgtcggcctccgaaagtctgggaccaaaccgaccggccctcccgtcggtacccgttctcgtcgggtcctacccgagggtctaggacggtatggaaggcttagtatttacttacgtgtctgtctacacgtntcgcgaggctaggctagtcggtgtgttcgttagttccgggacgggacggacccgaggctcgaccgtcgtacggtcacgcccgaagggtcccc

SEQ ID NO: 385664 - DNA, 515 bp, Homo sapiens
  misc_feature: GZ8MTXP01DIXF8.51.80.H03.1.454.CMB.2.raw
  modified_base (304)..(304): a, c, t, g, unknown or other
  modified_base (309)..(309): a, c, t, g, unknown or other
  modified_base (426)..(426): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactatgtctcctggtaccaacagcaccaggacaaacgccccaaatcatgattangagtnagtagcggcctgagggtcctgatcgccttctctgctcaaagtctggacaacaccggcctccctgaccgtctcgtggctccgagctgagatggagctgattatactgggctgctcacngtgcaggcagctagtcggtgtgcgttagttcgggacgggacggacgaacgcgtaagacccgtcgtacggtcacggtcccgaagggtccc

SEQ ID NO: 385665 - DNA, 608 bp, Homo sapiens
  misc_feature: GZ8MTXP01EFXRS.51.80.H03.1.454.CMB.2.raw
  modified_base (231)..(231): a, c, t, g, unknown or other
  modified_base (306)..(306): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtgttataactatgtctctgtacaacagcaccaggaccaaacgccccaaactcatgtatttangagtcagtaacgcggccctcgacgggtccctgactcgccttctcgtgcctcaaagtctcggactaaaccgaccggccctccccgtcgacccgttctccgtcgggcctacccgaggtccgtaggaacggtagtggacggcttagtaatttaacttcgtcggggtctcgtacctacacctagtcgacgaggcaaggctagtcgggtgtcgttacgttacgttcggggaccgggaacgggacccgaacgttccggtcggaaccccgttcgtaacgggtcgacccgaacccgttaacgggtccccg

SEQ ID NO: 385666 - DNA, 532 bp, Homo sapiens
  misc_feature: GZ8MTXP01BK8W5.51.80.H03.1.454.CMB.2.raw
  modified_base (480)..(480): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactggaaccagcagtgacgttggtggttataactatgtctcctggtaccaacagccacccgaggcaaacgcccccaaatcatgactttatgaggtcagtaaacgcggccctcgacggggtccctgactcgcttctctgcctcgaagtctggacaacacggccctcccgtgacccgtctcgtcgggggctccgaggctgaggtactggaggtctgtattnttcgtgcttgccttcgactattgcaggcagcagtcggttgtcgcgttaaggg

SEQ ID NO: 385667 - DNA, 524 bp, Homo sapiens
  misc_feature: GZ8MTXP01BSRPM.51.80.H03.1.454.CMB.2.raw
  modified_base (272)..(272): a, c, t, g, unknown or other
  modified_base (346)..(346): a, c, t, g, unknown or other
  modified_base (426)..(426): a, c, t, g, unknown or other
  modified_base (474)..(474): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgcctcctcctcaccctcctcactcagggcacgagggtcctgggcccagtctgccctgactcagcctccctccgcgtccggtctcctggacagtcagtcacatctctgcactggaaccngcagtgacgttggtgttataactatgtctcctgtaccaacagcaccagacaaacgcccccaaatcatgatttangagtcagtaaacgcgcctcgacggggtccctgactcgtcttctcgtgctccaagtctggaccaacgccggtccctcccgngtaccgtctcgtcgggggcctccgaggctgaggatggagtctgtattntctgcttgcttcactattgcaggcagctagtcggttgtcgcgttaacggg

SEQ ID NO: 385668 - DNA, 666 bp, Homo sapiens
  misc_feature: GZ8MTXP01EFDWW.51.80.H03.1.454.CMB.2.raw
  modified_base (232)..(232): a, c, t, g, unknown or other
  modified_base (271)..(271): a, c, t, g, unknown or other
  modified_base (286)..(286): a, c, t, g, unknown or other
  modified_base (305)..(305): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtcccgggtctccgtggacagtcagtcaccatctcctgcactggaaccngcagtgacgttggtgttataactatgtctctgtaccaanagcaccagacaaacnccccaaatcatgtatttangagtacagtaacgccggtccctcgacgggtccctgactcgtccttctcgtcggtcctaccgaaaggttccgtcgggacccaaaccggcccgggtcccccttacccgtcggtaccccgtttcgtccgtcggggtcccttaccggagggtccttagggaaggtacgttgggacggttcttaggtaatttaacgttaccgttggcttgcccttacaacgtagtcggccgaaggccaaagtcctagttcgggtaagttcggttacgtagggttaccgggaccggggtaacggaaccgttaacggttcccgtaacggaccccggttaaccggtacgggtccgaaccgccccggttaacggtccccg

SEQ ID NO: 385669 - DNA, 589 bp, Homo sapiens
  misc_feature: GZ8MTXP01CD90O.51.80.H03.1.454.CMB.2.raw
  modified_base (242)..(242): a, c, t, g, unknown or other
  modified_base (347)..(347): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggtagcgctctcaggacgtcaccaccatggcctgggctctgctcctcctcaccctcctcactcagggcacagggtcctgggcccagtctgccctgactcagcctccctcgcgtccggtctcctggacngtcagtcaccatctctgcactggaaccagcagtgacgttggtgttataactatgtctcctgtaccaacagcacccaggaccaaacgcccccaaatcatgatttangagtcagtagccgccctgacggggtccctgatcgtcttctcgtgtcctacaacgtctacggacaaaccgaccggcccttcccgtacgtacccgtctccgtcgggccttccgaggtcctaggaggtatggacggtctagtatttacttacgtgtcttcggacttacccaagtacgttggaccgttaggggactaaacgcctaaggttccgggtggttccgtaacgttaacggttcccgggggg

SEQ ID NO: 385670 - DNA, 633 bp, Homo sapiens
  misc_feature: GZ8MTXP01EKWDN.51.80.H03.1.454.CMB.2.raw
  modified_base (302)..(302): a, c, t, g, unknown or other
  modified_base (415)..(415): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcactatctctgcactggaaccagcagtgacgttggtagttataactatgtctctgtacacagcaccagacaaacgaccccaaatcatgtatttangagtcagtacgccgcctgacgggtccctgactcgtccttctctggctaccaaagtctcggaccaaaccgaccggtccctccctcggacccgtctcgtcggctcgaggctgagngtgaggtctagtattacgttactcgggtctcgtcctacactacgtcgacgaacggccaagtcctaagttccgggtgtttcggttaccgtttaacgggttccggggaccggggtaaacggggttaacccgaaacgggttcccggttaaccgggtaaccccggtttaacccggttacgggtacccgaacccgggtaaccccggaaaccgggttcccccgg

SEQ ID NO: 385671 - DNA, 591 bp, Homo sapiens
  misc_feature: GZ8MTXP01CK13G.51.80.H03.1.454.CMB.2.raw
  modified_base (272)..(272): a, c, t, g, unknown or other
  modified_base (312)..(312): a, c, t, g, unknown or other
  modified_base (349)..(349): a, c, t, g, unknown or other
  modified_base (544)..(544): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacgagggtcctgggcccagtctgccctgactcagccctccctcgcgtccggtctcctggacagtcagtcaccatcctctgcactggaacngcagtgacgttggtgttataactatgtctctgtaccaacngccacccagaccaaacgcccccaaatcatatacttangagtacagtaaacgccgccctcgtacgggtccctgactcgtcttctcgtcgcctacgtaacgtcgtacggaccaaccgccggtccctaccgtcgacccgttcgtcgtcgggggccttaccggacggtctaggacggtgtacggtacggtccttaggtaattttaccgttacgtcggtcttcgtccttactacgtnttcgcgacgggcacgtcctaggttcggttgtaacgttcgttaacggg

SEQ ID NO: 385672 - DNA, 579 bp, Homo sapiens
  misc_feature: GZ8MTXP01DQD8U.51.80.H03.1.454.CMB.2.raw
  modified_base (229)..(229): a, c, t, g, unknown or other
  modified_base (269)..(269): a, c, t, g, unknown or other
  modified_base (302)..(302): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtagttataactatgtctctgtaccaanagcaccagcaaacgcccccaaatcatgatttangagtcagtaagcgcctgagggtccctgatcgtccttctcgtggcctacaaagttctcggacaaccgaccgggccctcccgtgacccgtctcgtcggtcctccgaggctaggaggagtggaggctagtattacttactgggtctgtctacacagtcgacgaggcaacgcgtaacgttccgggttgtcggttcgttacggttcgggacggggtaacgggaaccgaggttaccgtaacggtaacccgttccgttaaggccaccggcccgaacggtccccg

SEQ ID NO: 385673 - DNA, 560 bp, Homo sapiens
  misc_feature: GZ8MTXP01A92QQ.51.80.H03.1.454.CMB.2.raw
  modified_base (306)..(306): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctccccaccctcctcactcagggcacagggtcctgggcccagtctgccctgactcagcctccctccgcgtccggtctcctggacagtcagtcaccatctcctgcactggaaccagcagtgacgttggtgttaataactatgtctctggtaccaacagcacccaggcaaaacgcccccaaatcatgatttangagtcagtaacgcggccctgacggggtccctgactcgctttcctctggcctaccgagttctagggccaaacgaccggccctccctaggaccctctcgtcgggctccgaggctaggagatgaggtctgattatacgtgctgctcacatgacgaggcaggtctagtcggtgtaatcgttaggttcggacggagggacccaaggttcttacggaaccccgttcaacgggtccacggaccccgtaagcccgtccccgg

SEQ ID NO: 385674 - DNA, 553 bp, Homo sapiens
  misc_feature: GZ8MTXP01DIM7Q.51.80.H03.1.454.CMB.2.raw
  modified_base (272)..(272): a, c, t, g, unknown or other
  modified_base (345)..(345): a, c, t, g, unknown or other
  modified_base (513)..(513): a, c, t, g, unknown or other
tcagcgatcgtatacacgaccggtgctcgatttagctgtgcgtcgaaagggaaagggcacgaccggtgctcgatttagctgtgcgtcgaagggaaagggggctggggtctcaggaggcagcgctctcaggacgtcaccaccatggcctgggctctgctcctcctcaccctcctcactcaggcacagggtcctgggcccagtctgccctgactcagccctccctcgcgtccggtctcctggacagtcagtcaccatctcctgcactggaaccngcagtgacgttggtgttataatatgtctctgtaccaacagcaccagacaaacgcccccaaatcatgtacttangagtcagtaaacgcgccctgacgggtccctgactcgtcttctcgtgcctaccaagtccgtaggaccaaacgccggccctcccgtcgtacccgtctcgtcgggggtccctccgaggtctaggaggtatggaaggtctagtatttacttactgtcttgccttacaacgtnttcgcacggcaagcctagtcggttgtcgttcgttaacggg

SEQ ID NO: 385675 - DNA, 602 bp, Homo sapiens
  misc_feature: GZ8MTXP01CW9MJ.51.80.H03.1.454.CMB.2.raw
  modified_base (212)..(212): a, c, t, g, unknown or other
  modified_base (231)..(231): a, c, t, g, unknown or other
  modified_base (309)..(309): a, c, t, g, unknown or other
  modified_base (558)..(558): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccntcctcctgcactggaaccngcagtgtacgttggtagttaataactatgtctctgtaccaacagcaccaggacaaacgcccccaaatcatgtatttangagtcagtaacgccggtccctggacgggtccctgtactccgtcctttctcgtcggtcctaccgaaaacgttcgtcggaccaaaccgcccgggtccctaccccgtcgtacccgtcgtcgtcgggtcctaccgaggtcttaggaggtctaggacggtctagtaatttacttacgtggtactcgctacactagcgcaggcagtcgtagtcgggtaatcgttacgtaggttccgggaacgggtacggaaccgngttccgtaacgacccgtcgtaggccaccggcccgaaggtccccg

SEQ ID NO: 385676 - DNA, 555 bp, Homo sapiens
  misc_feature: GZ8MTXP01AJBGY.51.80.H03.1.454.CMB.2.raw
  modified_base (234)..(234): a, c, t, g, unknown or other
  modified_base (302)..(302): a, c, t, g, unknown or other
  modified_base (332)..(332): a, c, t, g, unknown or other
  modified_base (344)..(344): a, c, t, g, unknown or other
  modified_base (352)..(352): a, c, t, g, unknown or other
  modified_base (406)..(406): a, c, t, g, unknown or other
  modified_base (410)..(410): a, c, t, g, unknown or other
  modified_base (426)..(426): a, c, t, g, unknown or other
  modified_base (443)..(443): a, c, t, g, unknown or other
  modified_base (448)..(448): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcacgccctccctccgcgttccgggtctcctggacagtcagtcaccatctcctgcactggaaccngcagtgacgttggtgtatactatgtctcctgtaccacagcaccagcaaacgccccaatcatgatttangtagtcagaacgccggccctgacgggtccngactcgccttcncgtggtcncgaaacgtctcggcaaacgcggccctcctcgtacctctcgtggcctcgaggtcngagntgagctgattactacnggtctagtcacactagngtacncggcacgctagcgtgtcgttacgttacggttccgggcgggtaacggaccgttaaaggccgtaacgacccgttcgtaacgcccgttaaaccgcccgaaggttcccccg

SEQ ID NO: 385677 - DNA, 614 bp, Homo sapiens
  misc_feature: GZ8MTXP01CPGZR.51.80.H03.1.454.CMB.2.raw
  modified_base (229)..(229): a, c, t, g, unknown or other
  modified_base (248)..(248): a, c, t, g, unknown or other
  modified_base (306)..(306): a, c, t, g, unknown or other
  modified_base (347)..(347): a, c, t, g, unknown or other
  modified_base (367)..(367): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctctcactcagggcacagggtcctgggcccagtctgccctgactcagccctccctcgcgtccggtctcctggacagtcagtcaccatctctgcacgtggaaccngcagtgacgttggtgttanactatgtctcgtgtacaacagccaaccaggacaaacgaccccctaaatcatgtattangaggtcagtaacgcgcctcgagggtccctgactcgaccttntctggcctaccaaagttcgngaccaaacaccgggtccctcccgtcggacctcgtcgtgggcctaccgagcgtagaaggtgttacgaagggtctaagtaatttacgtttaacgtcgggtcgttcgtactacgtacgtagtacgacgacgacgtacgtacgtacgtcggtggtcgttacggtacggttacgggacgggtaacggaccggttacgttaccgtaaccgtaccgtaaccgtacggtaccgaccgtaacccgaaccggtcccg

SEQ ID NO: 385678 - DNA, 635 bp, Homo sapiens
  misc_feature: GZ8MTXP01C5D05.51.80.H03.1.454.CMB.2.raw
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacgagggtcctgggcccagtctgccctgactcagcctccctcgcgtccggtctcctggacagtcagtcaccatctctgcactgaaccagcagtgacgttggtggttataactatgtctcctaggtaccaacacgaccacccgaggaccaaaccgacccccaaactcatacgtactttatggaagtactaaggtaaaacgcccggtcccgtaccgtacgggggttccctagtactccggtactttcctacgttcggcctaccgaacgttccgtaggacccaaacgcccggtccccttacccgtacgtacccgttccttccggtcgggggtcccttccggacggccgtaggaacggtagtggaacggtctaggttaattacgtttacgtcggtcttcgtccttacgtacagttcgcgacgcacgtcgtacggtcggttgtcgttcgttaacgggg

SEQ ID NO: 385679 - DNA, 563 bp, Homo sapiens
  misc_feature: GZ8MTXP01C4I1U.51.80.H03.1.454.CMB.2.raw
  modified_base (269)..(269): a, c, t, g, unknown or other
  modified_base (303)..(303): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtaggttataactatgtctctgtacanagcaccagcaaacgcccccaaatcatgtatttangagtcagtaacgcgccctcgacgggtcctgatcgccttctcgtggcctccaaagtctggacaaaccgaccggccctcccgtcgaccgtctcgtgggcctcgaggctaggagtcgtgaggtctagtattaattccgtggtctgtctcgaactgtgcgaggcagctagtcggtgtcgttcgttaggttccgggacgggaacggaaccgacgttcgtaacggtaacccggtcgtaacggccgacggtccccgaagggtccccg

SEQ ID NO: 385680 - DNA, 575 bp, Homo sapiens
  misc_feature: GZ8MTXP01ETHPQ.51.80.H03.1.454.CMB.2.raw
  modified_base (273)..(273): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtagtatatatgtctctcgacacacacaccnacgacaacaccccaactacatatattatagtagtacgagtaccgaccggccgtccgtacggtccgtacgtactcgtctctcgtcgtcgtaccgtacgtacgtacgaccgaaccgaccgtacccgtcccgtaccgtaccgtccgtccgtcggccgtccgtacggacgtagaggggagtaggtaggtacgtagtaattagttacgtcgtcgtcgtactacactaacgtcgacgacgacgacgacgttacgttcggttcgtcggtcgtaacggtcgggtacgggacgggtaaccgaacgtaaccg

SEQ ID NO: 385681 - DNA, 540 bp, Homo sapiens
  misc_feature: GZ8MTXP01D0VUF.51.80.H03.1.454.CMB.2.raw
  modified_base (270)..(270): a, c, t, g, unknown or other
  modified_base (303)..(303): a, c, t, g, unknown or other
  modified_base (422)..(422): a, c, t, g, unknown or other
  modified_base (433)..(433): a, c, t, g, unknown or other
  modified_base (446)..(446): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatcctcctgcactggaaccagcagtgacgttggtagttaataactatgtctctagacaangcaccagacaaacgccccaaatcatgtatttangagtacagtaagcgcctgacgggtccctgactcgtccttctctcgctaccgaaagtctggaccaaacgccggccctccgcgaccgtctcgtggcctacgaggtctaggagtatggagtntatattactcngctgctacacagngacgacgcgagacgtcgtgtgtgttcgtacgttcggacggaacggacgacgacgtaacgtaccgtaacgtacgtacgacgtaaccgaacgtccg

SEQ ID NO: 385682 - DNA, 557 bp, Homo sapiens
  misc_feature: GZ8MTXP01ARUIS.51.80.H03.1.454.CMB.2.raw
  modified_base (303)..(303): a, c, t, g, unknown or other
  modified_base (309)..(309): a, c, t, g, unknown or other
  modified_base (333)..(333): a, c, t, g, unknown or other
  modified_base (345)..(345): a, c, t, g, unknown or other
  modified_base (364)..(364): a, c, t, g, unknown or other
  modified_base (414)..(414): a, c, t, g, unknown or other
  modified_base (420)..(420): a, c, t, g, unknown or other
  modified_base (440)..(440): a, c, t, g, unknown or other
  modified_base (453)..(453): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagccctccctcgcgtccggtctcctggacagtcagtcacatcctctgcactgaaccagcagtgacggttggtagttaataactatgtctccgtggtaccaacagccaaccaggacaaacgtccccaaatcatnatttangagtcagtagcgccctgaggtccngactcgtcttcncgtgcctaccgaaagttcnggacctaaaccgcggtcccctcctcgacccgtctcgtcgggctcgagtcngaacgntgagtctagtattacttacngtctgtcacacgngtgacgacgcgtagacgtcgtgtgtcgttacgtacggttacgggacgggaacggaacgacgacgtaacgtacgtaaccgtacgtacgacgtaaccgaacgtccg

SEQ ID NO: 385683 - DNA, 498 bp, Homo sapiens
  misc_feature: GZ8MTXP01B4KJL.51.80.H03.1.454.CMB.2.raw
  modified_base (224)..(224): a, c, t, g, unknown or other
  modified_base (265)..(265): a, c, t, g, unknown or other
  modified_base (297)..(297): a, c, t, g, unknown or other
  modified_base (332)..(332): a, c, t, g, unknown or other
  modified_base (420)..(420): a, c, t, g, unknown or other
  modified_base (422)..(422): a, c, t, g, unknown or other
  modified_base (428)..(428): a, c, t, g, unknown or other
  modified_base (430)..(430): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctctcactcagggcacagggtcctgggcccagtctgccctgactcagcctcctcgcgtcggtctcctggacagtcagtcaccatctctgcactggaaccngcagtgacgttggtgttaataactatgtctctggtaccaanagcaccagcaaacgccccaaatcatgatttangagtcagtaagcgcctgaggtcctgactcgcttcntgctccaaagtctgcaaacgcggcctccgtcgaccgtctcgtaggctccgaggctgagatgaggctagattaatctggctgctcacangngagcgncncgtgtgtgttgtcgttcggacggacggacgacgcgtcgtacgtcgtacgtacgacgaaccgaacgtcg

SEQ ID NO: 385684 - DNA, 515 bp, Homo sapiens
  misc_feature: GZ8MTXP01BCXTT.51.80.H03.1.454.CMB.2.raw
  modified_base (253)..(253): a, c, t, g, unknown or other
  modified_base (268)..(268): a, c, t, g, unknown or other
  modified_base (301)..(301): a, c, t, g, unknown or other
  modified_base (326)..(326): a, c, t, g, unknown or other
  modified_base (334)..(334): a, c, t, g, unknown or other
  modified_base (352)..(352): a, c, t, g, unknown or other
  modified_base (364)..(364): a, c, t, g, unknown or other
  modified_base (370)..(370): a, c, t, g, unknown or other
  modified_base (405)..(405): a, c, t, g, unknown or other
  modified_base (416)..(416): a, c, t, g, unknown or other
  modified_base (420)..(420): a, c, t, g, unknown or other
  modified_base (425)..(425): a, c, t, g, unknown or other
  modified_base (428)..(428): a, c, t, g, unknown or other
  modified_base (438)..(438): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactntgtctctgtaccaanagcaccaggcaaacgccccaaatcatgatttangagtcagtagcgcctgaggtcctgntcgcttcntgctcaaatctggcaacnccggcctcccgngacctnctggctccgagctgaggactgagctgattattacnggctgctcgangtgnacggnagngtcgtcggtntgttacgtcggttcgggacgggtaacggaccgagttcgtcggaccgtcgtacggtccgacgtaacccgaaggtcccg

SEQ ID NO: 385685 - DNA, 600 bp, Homo sapiens
  misc_feature: GZ8MTXP01EQKJG.51.80.H03.1.454.CMB.2.raw
  modified_base (231)..(231): a, c, t, g, unknown or other
  modified_base (302)..(302): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtgttatactatgtctctgtacaacagcaccagacaaacgccccaaatcatgtatttangagtcagtaagccgcctcgacgggtccctgactcgtccttctcgtcggcctaccgaaacgttctcgggacctaaacccgacccgggtccccttacccgtcggtacccgttcttccgtcgggcctccgaggctggacggagttaggacgcgttagtactttaagttaccgtgggtcttcgtacctcaactagtcgacgaggctaacggctacgtcgggtgtcgttacgtacggttcggggacgggaacgggaccgacggttcgtcggacccgtcgtacggcacgcccgaacggtccccg

SEQ ID NO: 385686 - DNA, 633 bp, Homo sapiens
  misc_feature: GZ8MTXP01BQH4P.51.80.H03.1.454.CMB.2.raw
  modified_base (272)..(272): a, c, t, g, unknown or other
  modified_base (306)..(306): a, c, t, g, unknown or other
tcagcgatcgtatacacgaccggtgctcgatttagctgtgcgtcgaagggaaagggggctggggtctcagggggcagcgctctcaggacgtcaccaccatggcctgggctctgctcctcctcaccctcctcactcagggcacagggtcctgggcccagtctgccctgactcaacctccctccgcgtccgggtctcctggacagtcagtcaccatctcctgcactggaaccagcagtgacgttggtggttataactatgtctctggtaccaanagcaccaggacaaacgccccaaatcatgatttangagtcagtaagcgcctgacgggtcctgactcgcttctccgtggctcgaagtctaggccaacgccggtccctcctcgacccgttctcgtcgggcctccgaggtctggacggtatggacggtcttaggtatttacgttactcggtcttcggggcttacactaagttcggccgaaggggcaacggtcctaggttccgggtggtcgaaccgtttaaggttccggggacgggacggggtaacccaacgggttccgttcggttacccggttaacccgtacggggtcccaacgggtaccccgaacggggtcccctttaacccgggtcccccccg

SEQ ID NO: 385687 - DNA, 636 bp, Homo sapiens
  misc_feature: GZ8MTXP01A70C6.51.80.H03.1.454.CMB.2.raw
  modified_base (308)..(308): a, c, t, g, unknown or other
  modified_base (544)..(544): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcacgcctccctccgcgtccggtctcctggacagtcagtcaccatctcctgcactggaaccagcagtgacgttggtgttataactatgtctcctgtaccaacagcaccgaggaccaaacgcccccaaatcatgtattangagtacagtaacgccgccctagacgggtccctgtactcgtccttctcgtcggtcctaccgtaaagtctcggaccaaaccgacccgtccctccctacggtacccgtctccgtcgggtacctcgacggtcgtaggacggtagttacggagggtaccttagttaactttaacgtttaccgtggggtactcgtaccttacgaacctagttcgcgaaacggcaacgtcgtaagtccgggtntcggttacgttacggttccggggacgggaacgaccgacgttcccgtaacggtaaccccgtcgacgtccgaccggtaacccgaacggtccccg

SEQ ID NO: 385688 - DNA, 517 bp, Homo sapiens
  misc_feature: GZ8MTXP01AXPGW.51.80.H03.1.454.CMB.2.raw
  modified_base (505)..(505): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtggttataactatgtctcctggtaccaacagcacccaggacaaacgacccccaaatcatgtactttatgagtcagtaaacgcgccctcgacggggtcctgatcgcttctctgctacagtctgctaacgccgcctccctgaccgtctcgcgggggctccgaggctgagatgaggtctgtattatcgtgcttgcttgactgttgcaggcagcacgtcggttntcgcttaacggg

SEQ ID NO: 385689 - DNA, 544 bp, Homo sapiens
  misc_feature: GZ8MTXP01BARLY.51.80.H03.1.454.CMB.2.raw
  modified_base (199)..(199): a, c, t, g, unknown or other
  modified_base (227)..(227): a, c, t, g, unknown or other
  modified_base (269)..(269): a, c, t, g, unknown or other
  modified_base (304)..(304): a, c, t, g, unknown or other
  modified_base (333)..(333): a, c, t, g, unknown or other
  modified_base (386)..(386): a, c, t, g, unknown or other
  modified_base (434)..(434): a, c, t, g, unknown or other
  modified_base (475)..(475): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctcgcgtccggtctcctggacngtcagtcaccatctctgcactggaaccngcagtgacgttggtgttaataactatgtctctggtaccaacngcaccaggacaaacgcccccaaatcatgtatttangagtacagtacgccgcctcgacgggtccngactcgccttctcgtgcctaccgaaagtctggaccaacgcccggtccctccgngaccgtctcgtcggcctcgaggctggacgatggagtctgtattatcgnggctgcctacgaactgtcgacgacgctacgctagtcgggtntcgttcgtacggttcgggacggaggaccgagccgtaacgaccgtcgtagccgaccgtccgttcgtcccg

SEQ ID NO: 385690 - DNA, 594 bp, Homo sapiens
  misc_feature: GZ8MTXP01AVV91.51.80.H03.1.454.CMB.2.raw
  modified_base (257)..(257): a, c, t, g, unknown or other
  modified_base (270)..(271): a, c, t, g, unknown or other
  modified_base (283)..(283): a, c, t, g, unknown or other
  modified_base (294)..(294): a, c, t, g, unknown or other
  modified_base (299)..(299): a, c, t, g, unknown or other
  modified_base (304)..(304): a, c, t, g, unknown or other
  modified_base (426)..(426): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcactatctcctgcactggaaccagcagtgtacgttggtagttataactntgtctctgtacanncaccagacaacnccccaatcatntattngagtnagtacgcgcctgacggtcctgactcgtccttctcgtcggcctacgtaaagttccgtcggaccaaacccgaccggtcccctcccgtcgtacccgttcctcgtcggcctacgaggtctggaggntggaggtctagtaatttagttaccgtgggtcttcgcctaccgaagtacgtcggaaccgagggtccaagggtccgtaggttcgggcgttcgcgttaacgggttcgggaacggtacgggaccaggttccgtcgtacccgtcgtacggtccacggcccgttaaggtccccg

SEQ ID NO: 385691 - DNA, 722 bp, Homo sapiens
  misc_feature: GZ8MTXP01A2BDW.51.80.H03.1.454.CMB.2.raw
  modified_base (253)..(253): a, c, t, g, unknown or other
  modified_base (267)..(268): a, c, t, g, unknown or other
  modified_base (281)..(281): a, c, t, g, unknown or other
  modified_base (298)..(298): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagccctccctcgcgtccggtctcctggacagtcagtcaccatctctgcacgtggaaccagcagtgacgttggtgttatactntgtctctggtacannacaccagcaaacnccccaatcatgtattangagtcagtaagccggtccctcgacggtcctgactccgtccttctcgtcggtcctccgaaaagttccgtggaccaaaccgaccggtcccctcccgtcgtaccccgtcgttaccgtcggggtccctaccggacgggtaccgtaggggtaaacgggttcgttaggggaaaccgggtttacgttaacggtttaaacgttttaaccgttaccggttacggtaccggttaccggttaccctaaccgtaaacgtacgtaccgggtaacgtacgggaaccgtacggtacggttacggtcgggttaacgttacggttacggttaccgggttaccggggaacgggtaaaccgggttaccgacggttccggtaacccgggtacccggttaacggtaacccgggtaccgaacccggtaacccgttaacgggtcccc

SEQ ID NO: 385692 - DNA, 625 bp, Homo sapiens
  misc_feature: GZ8MTXP01BLLKV.51.80.H03.1.454.CMB.2.raw
  modified_base (258)..(258): a, c, t, g, unknown or other
  modified_base (273)..(273): a, c, t, g, unknown or other
  modified_base (307)..(307): a, c, t, g, unknown or other
  modified_base (469)..(469): a, c, t, g, unknown or other
  modified_base (507)..(507): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcacgcctccctccgcgtccggtctcctggacagtcagtcaccatctcctgcactggaaccagcagtgtacgttggtagttaataactntcgtctctagacacngccaccagacaaacgccccaatcatgtatttagngaggtacaaggtaacggcccggtcccgtacggacggggttccctaggtactccgtccctttcctcggtcggtaccctaccgtaaacgttccgtcggaccaaacccgcccggtccccttccgtcgtacccgttctcgtcggcctcggaggtctaggaacggtntggagtcttagtatttactcgtcggcttcgcctacgancgcgacgacgctacgtcgtacggtggtcgtcggttacgtacgggcgggaacggtaacggacgttcggttccgtaaccggtaccgtaacgtacggccgaccggtaaccgttccgtcccg

SEQ ID NO: 385693 - DNA, 594 bp, Homo sapiens
  misc_feature: GZ8MTXP01BMTIU.51.80.H03.1.454.CMB.2.raw
  modified_base (199)..(199): a, c, t, g, unknown or other
  modified_base (303)..(303): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctcgcgtccggtctcctggacngtcagtcaccatctcctgcactggaaccagcagtgacgttgtgttatactatgtctctggtaccaacagcaccaggacaaacgcccccaaatcatgtatttagngaggtcagtaagccggccctgacggggtcccctgactccgcctttctctcggtcctccgaaaacggttcctcgggaccaaaccgccggtcccctcccgtgacccgttctcgtcgggcctcccggaggccttaggacggtagtaggacgggtccttagtaacgttttacttaccgtgggaccttggaccttacgaactagtcgcgaacggctacgctacgtggtgtcgcttaggttcgggacggacggaccgacgcgtcgtaccgtcgtacggcgacgcccgttaacgcccg

SEQ ID NO: 385694 - DNA, 574 bp, Homo sapiens
  misc_feature: GZ8MTXP01AJEM4.51.80.H03.1.454.CMB.2.raw
  modified_base (458)..(458): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttatactatgtctctggtaccacagcaccgagacaaacgcccccaaatcatgtatttagtgagtcagtaagtcgccctcgacgggtccctgactcgccttctcgtggctaccgaaagtctgggaccaaaccgtccgggtccctccgtcgaccgttctcgtcgggcctccgagggtcctaggacgggatggaaggcttagtagtttacttacgnggtctcgtcctacgactgtcgcgagctagctggttcggtgtgttcgtcggttcgggacggacggttacgacgccgtaaccggccgttaacgacggtacaccgtcccgaacggtccg

SEQ ID NO: 385695 - DNA, 650 bp, Homo sapiens
  misc_feature: GZ8MTXP01BCVUQ.51.80.H03.1.454.CMB.2.raw
  modified_base (203)..(203): a, c, t, g, unknown or other
  modified_base (231)..(231): a, c, t, g, unknown or other
  modified_base (314)..(314): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcacgcctccctccgcgtccgggtctcctggacngtcagtcaccatctctgcactggaaccngcagtgtacgttggtagttataactatgtctcctaggtaccaacacgcaccgaggaccaaacgcccccaaatcatgtatttangagtacagtacgcggtccctcggacgggttccctgacgtccgtccttctacgtcggcctaccaaagttctcgggaccaaaccgaccggtcccctcccgtacggtacccgttcgtcgtacgggtcctccggaggtcgtaggaggtagtaggacgggtcttaggtaatttacgttacgtcgggtcttggtacccttagaacctagtcgacgaacgcgacgtacctaggttccgggtgttcgacgttacggttccggggacgggtaacgggaacccgaggttcccgtaaccgggacccgttcggttaccggccgaccggaacccgttaacggtcccccg

SEQ ID NO: 385696 - DNA, 730 bp, Homo sapiens
  misc_feature: GZ8MTXP01DFS2E.51.80.H03.1.454.CMB.2.raw
  modified_base (230)..(230): a, c, t, g, unknown or other
  modified_base (309)..(309): a, c, t, g, unknown or other
  modified_base (351)..(351): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcggtccggtctcctggacagtcagtcaccatctcctgcactggaaccngcagtgacgttggtgttaataactatgtctctggtaccaacacgcaacccaggaccaaacgcccccaaatcatgattangagtcagtaagcgacctcgagggtccctggactcgccttctntcggctccaaagtcgtcggacaaacgacccggtccctcccgtagtacccgtcgtccttcggggcccttaccgagggccttagggaaacggggtacgttagggaaccgggttacgttaacggtttaaacttttaacgtttaccgttcgggttaccgttacggtacccttaccgtaacgtaacgtcggaccggtaacggtaccgtacggtaccggttacggttcggggttgtaccggttacgggtttaaccgggttaccgggggaaccggggtaaaccgggttaaaccgttaacgggttcccggttaacccggtaccccggtttaaccggtaaaccgggtacccgttaaaccgggtaaccccggttaaccgggttcccccg

SEQ ID NO: 385697 - DNA, 573 bp, Homo sapiens
  misc_feature: GZ8MTXP01C0P8T.51.80.H03.1.454.CMB.2.raw
  modified_base (203)..(203): a, c, t, g, unknown or other
  modified_base (233)..(233): a, c, t, g, unknown or other
  modified_base (303)..(303): a, c, t, g, unknown or other
  modified_base (309)..(309): a, c, t, g, unknown or other
  modified_base (325)..(325): a, c, t, g, unknown or other
  modified_base (335)..(335): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacngtcagtcaccatctcctgcactggaaaccngcagtgacgttggtagttaataactatgtctctgtaccaacagcaccagacaaacgacccccaaatcatntattangagtcagaacgcgccncgagggtccngactcgtcctctctcgctcaaagtctggacaaacgaccggtccctacccgtcgacccgtctcgtcgggcctccgaggctaggaggtatggacggcttagaatttataccgtggtctgcctacactagtgcgaagcaagcctagttcggtggtcgttcgtaacggttccgggacgggaacggaaccgttaaggccgtaacgacccgttcgaacgggtcaaccgtcccgttaagtccccg

SEQ ID NO: 385698 - DNA, 590 bp, Homo sapiens
  misc_feature: GZ8MTXP01BLGDC.51.80.H03.1.454.CMB.2.raw
  modified_base (229)..(229): a, c, t, g, unknown or other
  modified_base (243)..(243): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactggaaccngcagtgacgttggngttataactatgtctctgtacacagcaccagcaaacgccccaaatcatgatttatgagtcagtaagccggcctgacgggtccctgactcgtccttctctaggtcctccaaaacgttctcgggacaaaccgaccggtccccttcccgttcgacccgttctccgttgggcctccgaggctaggaggtactggaacggtctagtatttaacgttcgtgtcgttggtaccttacgaactactcggccgtaaggccctaaggccctaagttcgggtgtgttcgtagttccggggacgacgggacaagcgtaacggcccgtttcgagggtccacgggtcccgaaggttccccg

SEQ ID NO: 385699 - DNA, 548 bp, Homo sapiens
  misc_feature: GZ8MTXP01DEGKY.51.80.H03.1.454.CMB.2.raw
  modified_base (301)..(301): a, c, t, g, unknown or other
  modified_base (318)..(318): a, c, t, g, unknown or other
  modified_base (436)..(436): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatcctcctgcactggaaccagcagtgacgttggtgttataactatgtctctgtaccacagcaccaggcaaacgccccaaatcatgatttangagtcagtagccggccncgagggtccctgatccgtcttctctggcctaccgaaagttctggaccaaacgtaccggcctccccgtgtacccgtctcgtgggcctccgaggctggagtatggagctagattaattcnggctgctacacgatgcaggccaagccagtccggtaagtcgcgttaggttcccggagggacgggaacccagccgtcggaccgtcgttacgggcacgtaacccgaagggtcccg

SEQ ID NO: 385700 - DNA, 548 bp, Homo sapiens
  misc_feature: GZ8MTXP01ASMDF.51.80.H03.1.454.CMB.2.raw
  modified_base (466)..(466): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtggttataactatgtctcctggtaccaacagcaccaggcaaacgccccaaactcatgatttatgagtcagtaagcgccctcgaggggtccctgatcgccttctctggctccaaagtctggcaacacggcctcccgtcgaccgtctcgtggctccgaggctgagatgaggtctgtattattacgtgggcttcgctcacagtgcgaggcagcctagtccggtgnttcgtaacgttcggacgggacggggacccaaggccgttcggacccgttccaagggttcccacggtccccgaaagggtccccg

SEQ ID NO: 385701 - DNA, 743 bp, Homo sapiens
  misc_feature: GZ8MTXP01BNH2V.51.80.H03.1.454.CMB.2.raw
  modified_base (242)..(242): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctctcactcagggcacgagggtcctggcccagtctgccctgactcacgcctcctcgcgtccggtctccgtggacngtcagtcactatcctctgcacgtacggaaccagcgagtgtacggtttgggtaggtttaactaaacttagtcgttccttaccgtacggttaacccaaacgacgaccccaaccccgaacgggaacccaaaaacccggaccccccctaaaaaacgtcctaaagttacggttaacttttaacggtacggtaacggttaccgaaaggttaaaacccgggcccgggtccccgttacgggtaaaccgggggttcccctaggtacgttccgtcgtttccgtccggttacggtcctacgtaaacgttccgttaacggacccaaaccgccgtccccgttccgtcgtacccgttcgtaccggtcgggggtccctccggaacggtccgtacggagggtcttagggtaccggttcgttacgttactttacgttcgtcgtcgttacgtccttacgtaacgtagttcgacgcggaactacgtcgttacggtcggttacgtcgttaacggttaacgg

SEQ ID NO: 385702 - DNA, 583 bp, Homo sapiens
  misc_feature: GZ8MTXP01C9DTQ.51.80.H03.1.454.CMB.2.raw
  modified_base (253)..(253): a, c, t, g, unknown or other
  modified_base (266)..(266): a, c, t, g, unknown or other
  modified_base (298)..(298): a, c, t, g, unknown or other
  modified_base (496)..(496): a, c, t, g, unknown or other
  modified_base (516)..(516): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaatcagcagtgacgttggtgttatactntgtctctgaccangcaccagacaaacgccccaatcatgtatttangagtcagtaagccggcctcgacgggtcctgactcccgcttctcgtcggcctaaccgaagtcgtggaccaaaccgaccggccccttcccgtcgacccgttctcgtcgggcctccgaggtcgtaggagtagtcggaggtctaggtaactttattacgtgtcttacgcttacgactagtgaccgaggtcagctagtcggtnttgtacgttaggtccggggnggaacgggaccttaaggtccgttacggcccggttacgtacgggttaccaaccggttcccgtaaccgg

SEQ ID NO: 385703 - DNA, 713 bp, Homo sapiens
  misc_feature: GZ8MTXP01CG560.51.80.H03.1.454.CMB.2.raw
  modified_base (232)..(232): a, c, t, g, unknown or other
  modified_base (256)..(256): a, c, t, g, unknown or other
  modified_base (271)..(271): a, c, t, g, unknown or other
  modified_base (305)..(305): a, c, t, g, unknown or other
  modified_base (321)..(321): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacgttggtgttataactntgtctctgtaccaangcaccaggacaaacgcccccaaatcatgatttangagtcagtagccgccncgacgggtcctgactcgcctttctcgtcggacctacccgaaagttccgtgggacccaaaccgtacccgggtccccttaccccgtcgggtaccccgttccgttcccggttcgggtcccttcccggacgggtccgttagggaacgggtagttcgggaacgggtccgttagtaattttaacgtttacgttcggggtccgttcggtccttaccacgtaacgttcggacgtaacgggcgtaacggtcgtaacggttcgggtttcggtcggttccggtttaacggggttccggggtacggggtaaccggggttaaccgaaacgggttcccgttaaccgggtaaccccggttcggttaccgggtcccgaaccgggtaaccccggaaacgggttcccccg

SEQ ID NO: 385704 - DNA, 610 bp, Homo sapiens
  misc_feature: GZ8MTXP01DWS2G.51.80.H03.1.454.CMB.2.raw
  modified_base (201)..(201): a, c, t, g, unknown or other
  modified_base (232)..(232): a, c, t, g, unknown or other
  modified_base (258)..(258): a, c, t, g, unknown or other
  modified_base (275)..(275): a, c, t, g, unknown or other
  modified_base (309)..(309): a, c, t, g, unknown or other
  modified_base (340)..(340): a, c, t, g, unknown or other
  modified_base (567)..(567): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcacgcctccctcgcgtccggtctcctggacngtcagtcaccatctcctgcactacggaaccngcagtgtacgttggtagttataactntgtctctaggtaccaanagcaccgagacaaacgaccccaatcatgtattangagtacagtacgccgtccgtcgacgggtccngtctcgtccttctcgtcggcctaccgtaaagtctcggaccaaacccgacccgggtcccctcccgtacggtacccgttctcggtcgggtccctaccggaggtccttaggaaaggtcttggacggtcttagttaatttacgtcgtcgggttctcgtacctacgactagtcgacggaagcgaggtacctggttcggtaagtcgttagtcggacgggacggtacgaaacgngttcgtaacggacccgttgacggcttacgaacccgcggtcccc

SEQ ID NO: 385705 - DNA, 633 bp, Homo sapiens
  misc_feature: GZ8MTXP01CMM0W.51.80.H03.1.454.CMB.2.raw
  modified_base (308)..(308): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactggaaccagcagtgacgttggtgttataactatgtctcctgtaccaacagcacccaggacaaacgcccccaaatcatgatttangagtcagtaagcgccctcgacgggtccctgactcgccttctctggcctccgaaagttcctggaccaaaccgaccgggtccctcccgtcggacccgtctccgtcgggcctccgaggtcctaggaggtagtcggaggtcttagtaatttacgttacgtcggggtcttcggccttacgaacctagtcgacgaacgggccaagtcctaaggttccgggttgtcggttacgttacggttccggggaacggggtacgggaacccgttaaggttcccgtaacggtacccgttccgtaacgggtccaccgggtaaccccgaacggggtccccg

SEQ ID NO: 385706 - DNA, 622 bp, Homo sapiens
  misc_feature: GZ8MTXP01D2ZHD.51.80.H03.1.454.CMB.2.raw
  modified_base (323)..(323): a, c, t, g, unknown or other
  modified_base (458)..(458): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactggaaccagcagtgacgttggtagttataaactatgtctcctaggtaccaaacagccaacccgaaggaccaaaacgaccccccaaaatccaaatgtatttagngaaggtacaggtaagccgggccctcgacggggtccctggactcgtccttctgtcggctaccaaaacgtcgtcggacaaacgaccggtccctcccgtcgaccgtctcgtggcctccgaggctaggagatgacggtntagtattatactcgtctcgtactacactagtcgacgacggacgtacgtcgtacgttcggtaagtcgttacgttacggttcgggacgggaaacgggaaccgacggttaccgtaacggtacccgttaaccgtacggtaccgacgtaaccccggttaacggtccccg

SEQ ID NO: 385707 - DNA, 616 bp, Homo sapiens
  misc_feature: GZ8MTXP01DR8I1.51.80.H03.1.454.CMB.2.raw
  modified_base (302)..(302): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactggaaccagcagtgacgttggtgttataactatgtctctggtaccaacagcaccaggcaaacgcccccaaatcatgatttangagtcagtaagccgcctgacggtccctgatcgtccttctctcggcctccaaagtctcggactaaaccgaccggtccctccccgtgtacccgtctcgtcggcctccgaggtctaggaacggattggaggtcttagtaactttattaccgtgggtctgaccttacaacagttcgcgtaaacgggcaaacgtccgtaagttccgggttgtcggttcgttaacggtttccggggacgggtaacgggaaaccccgaggttccgtaaccggtaacccggttccgtaaacggtccaaccgggtcccgaacggggttccccg

SEQ ID NO: 385708 - DNA, 591 bp, Homo sapiens
  misc_feature: GZ8MTXP01ATBCH.51.80.H03.1.454.CMB.2.raw
  modified_base (230)..(230): a, c, t, g, unknown or other
  modified_base (269)..(269): a, c, t, g, unknown or other
  modified_base (306)..(306): a, c, t, g, unknown or other
  modified_base (427)..(427): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggaaccngcagtgacgttgtagtataactatgtctctggtaccaanagcacccaggaccaaacgcccccaaatcatgatttangagtcagtagcgccctgacgggtcctgatcgccttctgtgctcaaagtctgacaacaccggcctccctggacccgtctcgtgggtcctccgaggtctgacggatcgagctagatttaatcncggctgtccagtaacctgtcgacgacgtcgtacgtacgtacgtcggtgtacggttacgttacggttaccggggacgggtaacggaacccgttacggttccggtaacccgggtacccgttaaccggtacgtacccggaacccggtaacccggttaacggtccccg

SEQ ID NO: 385709 - DNA, 624 bp, Homo sapiens
  misc_feature: GZ8MTXP01A2YKL.51.80.H03.1.454.CMB.2.raw
  modified_base (212)..(212): a, c, t, g, unknown or other
  modified_base (229)..(229): a, c, t, g, unknown or other
  modified_base (253)..(253): a, c, t, g, unknown or other
  modified_base (301)..(301): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcacgcctccctccgcgtccggtctcctggacagtcagtcaccntcctctgcactgaaccngcagtgacgttggtgttataactntgtctctgtacacagcaccagacaaacgccccaaatcatgtatttagngagtacagtaacgccgtccctacggacgggtccctgtactcgtcccttctcgtacggtcctaccgtaaagtcgtcggaccaaaccgaccgggtcccctccgtacgaccgttctcgtggcctcgaggtctaggaggagtgacggtctagtattagttccgtggggtcttgacctcgactagcgacgacgcacggtctaggttcgggtaagttcgttacgtttacggttccggggaaccggggtaacgggaacccgttaggttccgttaaccggtaccccgttcggtacgggtacccaccgggtaacccgaacggggttcccccg

SEQ ID NO: 385710 - DNA, 634 bp, Homo sapiens
  misc_feature: GZ8MTXP01AR0J3.51.80.H03.1.454.CMB.2.raw
  modified_base (251)..(251): a, c, t, g, unknown or other
  modified_base (258)..(258): a, c, t, g, unknown or other
  modified_base (265)..(265): a, c, t, g, unknown or other
  modified_base (296)..(296): a, c, t, g, unknown or other
  modified_base (301)..(301): a, c, t, g, unknown or other
  modified_base (466)..(466): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcacatctctgcactggaaccagcagtgacgttggtagttatactntgtctcngtacaanagcaccagacaaacgccccaatcatgattangagtnagtagccgtccctgacgggtcctgactcgtccttctcgtaggtcctaccgaaacgttcctggaccaaccgaccgggtcccctcccgttcgaaccgttcctcgtacgggggtcctccgacgggtctaggaagggtgtacggacgtcgttagttaatttacgttacnggtctgtcctacgacgtcgtcgacgacgacgtacgtacgtcggtcggtgtcggttacgtacggttaccgggtacggggtaacgggaaccggttacggttaccgtaaccggtacccggtaaccggttaccggtacccggttaccggtaacccggttaaccggtaacccg

SEQ ID NO: 385711 - DNA, 578 bp, Homo sapiens
  misc_feature: GZ8MTXP01ELG10.51.80.H03.1.454.CMB.2.raw
  modified_base (230)..(230): a, c, t, g, unknown or other
  modified_base (271)..(271): a, c, t, g, unknown or other
  modified_base (306)..(306): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtgttaataactatgtctcgtgtacaacngcaccaggacaaacgcccccaaatcatgtatttangaggtcagtaagccggccctgacgggtccctgactcgtccttctcgtggcctaccgaaacgttctcggacaaaccgaccgggcccttcccgtcgacccgttctcgtcgggtcctccgaggccgtggaaggtataggagggtctagtatttaactcgttcgggcttcggcttacacgtagtcgacgaggccagtaccagtccggtgtgacgttgttcgggacggaaggacgacgcgtcggaccgtcgtacggacgaccgtcccgaacgtcccg

SEQ ID NO: 385712 - DNA, 535 bp, Homo sapiens
  misc_feature: GZ8MTXP01DQBXA.51.80.H03.1.454.CMB.2.raw
  modified_base (227)..(227): a, c, t, g, unknown or other
  modified_base (303)..(303): a, c, t, g, unknown or other
  modified_base (377)..(377): a, c, t, g, unknown or other
  modified_base (407)..(407): a, c, t, g, unknown or other
  modified_base (424)..(424): a, c, t, g, unknown or other
  modified_base (436)..(436): a, c, t, g, unknown or other
  modified_base (456)..(456): a, c, t, g, unknown or other
tcagcgatcgtatacacgaccggtgctcgatttagctgtgcgtcgaaggaaaggggctggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactggaaccngcagtgacgttggagttataactatgtctcctggtaccaacagcacccaggcaaacgcccccaaatcatgatttangagtcaggtaagccggcctcgaggggtccctggatcgcttctctggctccaaagtctggcaacgacggcctccngaccgtctcgtaggcctccaggctgaaggntgaggctgattattacnggctgctcaacntgacgagcagctagtcggtntcgttacgttacggttcggacgggaacggacgttacgcgtaacgaccgtcgtacggcacggtaacccgttaacggtccc

SEQ ID NO: 385713 - DNA, 567 bp, Homo sapiens
  misc_feature: GZ8MTXP01ANR9Y.51.80.H03.1.454.CMB.2.raw
  modified_base (202)..(202): a, c, t, g, unknown or other
  modified_base (233)..(233): a, c, t, g, unknown or other
  modified_base (252)..(252): a, c, t, g, unknown or other
  modified_base (256)..(256): a, c, t, g, unknown or other
  modified_base (258)..(258): a, c, t, g, unknown or other
  modified_base (271)..(271): a, c, t, g, unknown or other
  modified_base (304)..(304): a, c, t, g, unknown or other
  modified_base (310)..(310): a, c, t, g, unknown or other
  modified_base (474)..(474): a, c, t, g, unknown or other
  modified_base (480)..(480): a, c, t, g, unknown or other
  modified_base (508)..(508): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagccctccctccgcgtccggtctcctggacngtcagtccacatcctcctgccactggaaccngcagtgacgttgtgttaanactntntctctgtaccaangcaccagcaaacgccccaaatcatgtatttagngagtanacgtacgccgccctcggacgggtccctgacttcgtccttcgtcgtcggcctaccgtaaagtccgtcggaccaaaccgccggtcccctaccgtacggacccgttctccggttcgggaccctccgaggtccgtaggacggtatggaacgtctagtacttagttcgngtctcncacactgtgacgacgctgtctgtcggtntcgttgtacggcggacggacgacgcgttcgtaacgtccgtcgacgcacgtccgcgtccg

SEQ ID NO: 385714 - DNA, 509 bp, Homo sapiens
  misc_feature: GZ8MTXP01A7CB5.51.80.H03.1.454.CMB.2.raw
  modified_base (307)..(307): a, c, t, g, unknown or other
  modified_base (333)..(333): a, c, t, g, unknown or other
  modified_base (346)..(346): a, c, t, g, unknown or other
  modified_base (358)..(358): a, c, t, g, unknown or other
  modified_base (388)..(388): a, c, t, g, unknown or other
  modified_base (395)..(395): a, c, t, g, unknown or other
  modified_base (398)..(398): a, c, t, g, unknown or other
  modified_base (403)..(403): a, c, t, g, unknown or other
  modified_base (413)..(413): a, c, t, g, unknown or other
  modified_base (423)..(423): a, c, t, g, unknown or other
  modified_base (445)..(445): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctctggtaccaacagcacccaggacaaacgcccccaaatcatgtatttangagtcagtacgcgcctgacgggtccngatcgccttctcngctacaaagtcngcaacgcgcctcctgcgtctcgtggctcgngctgagntgngtctntattacttanggctgctcanagtgcaggcagtctagtcggtntcgcgtagttcgggaggaacggacaggcgtaacgacccgtcgacgtccgacgcccgaagtcccg

SEQ ID NO: 385715 - DNA, 628 bp, Homo sapiens
  misc_feature: GZ8MTXP01CPH62.51.80.H03.1.454.CMB.2.raw
  modified_base (257)..(257): a, c, t, g, unknown or other
  modified_base (275)..(275): a, c, t, g, unknown or other
  modified_base (367)..(367): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacgagggtcctgggcccagtcctgccctgacctcagccctccctcgcgtccgggtctcctgacagtcagtcaccntctcctgcactggaaccngcagtgacgttggtagttataactatgtctccgtaggtaacccaacacgccaacccgacggacaaaccgcccccaaatcatgtaactttagngagtacaacggtaaacgcccggtccctcgtaccggggtccctagtactcgtcttcgtcgtacgccttacgacgttccgtacggacctaaaccgccggtacccctccgttacgtcccgtcttacggtcgggggcctcccggagggcctaggaggtacgttggaacggtcttaggtacttttaacgttcgcgtaccgttgtccttacgtaaacgtcgttacgcgacggtaacagcttacggtcggttgtcgttcgttaacggg

SEQ ID NO: 385716 - DNA, 603 bp, Homo sapiens
  misc_feature: GZ8MTXP01B4ZHX.51.80.H03.1.454.CMB.2.raw
  modified_base (253)..(253): a, c, t, g, unknown or other
  modified_base (255)..(255): a, c, t, g, unknown or other
  modified_base (265)..(265): a, c, t, g, unknown or other
  modified_base (298)..(298): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcacgcctccctccgcgtccggtctcctggacagtcagtcaccatctcctgcactggaaccagcagtgacgttggtgttatactntntctctgacangcaccagacaaacgccccaatcatgtatttagngagtcagtacgccgccctcgacgggtccctgactccgtccttccgtcgtcggtcctaccgtaaacgtctaacggacaaacccgaccggtcccctcccgtcgacccgttcgtccgtcggccctcgaggtcgtaggaacggagtcggaggtcgtagttaatttacttacgttcgggtctcgtctacactacgtcgacgacggcctagcgtacgccgggtgtcgttcggtacgttcgggaacgggacggaccgaacgttccgtaacgtacccgtcgtacggtaccgacccgtccggaacggttccccg

SEQ ID NO: 385717 - DNA, 654 bp, Homo sapiens
  misc_feature: GZ8MTXP01AIZZ3.51.80.H03.1.454.CMB.2.raw
  modified_base (230)..(230): a, c, t, g, unknown or other
  modified_base (267)..(267): a, c, t, g, unknown or other
  modified_base (301)..(301): a, c, t, g, unknown or other
  modified_base (329)..(329): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcacgcctccctccgcgtccggtctcctggacagtcagtcaccatctcctgcactggaaccngcagtgtacgttggtgtatactatgtctctgaccacngcaccaggacaaacgcccctaaatcatgtattangtagtcagtagccgcctcgacgggtccngtactcgtccttctcgtcgctacgtaaagtctcggaccaaacgaccggccctccgtcgaccttctcgtcgggcctcgacggtctaggacgtagtggacggtctgtaatttacgttaccgtgggtcgtgtacccttacgaaacgtcgttcgaacccgaaggggtcctacggggaacttcggttcgggttggtacgttaccgggttaacgggttacgggggaccggggtaaacgggaaccccgttaaaggggttcccgttaaccggggtaccccggttaaccgtacgggtacccgacgggtaacccccggttaacgggttcccccgg

SEQ ID NO: 385718 - DNA, 567 bp, Homo sapiens
  misc_feature: GZ8MTXP01EY5PZ.51.80.H03.1.454.CMB.2.raw
  modified_base (228)..(228): a, c, t, g, unknown or other
  modified_base (253)..(253): a, c, t, g, unknown or other
  modified_base (273)..(273): a, c, t, g, unknown or other
  modified_base (314)..(314): a, c, t, g, unknown or other
  modified_base (341)..(341): a, c, t, g, unknown or other
  modified_base (351)..(351): a, c, t, g, unknown or other
  modified_base (404)..(404): a, c, t, g, unknown or other
  modified_base (413)..(413): a, c, t, g, unknown or other
  modified_base (422)..(422): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacgagggtcctgggcccagtctgccctgactcagcctccctcgcgtccggtctcctggacagtcagtcaccatctctgcactggaaccngcagtgacgttggtagttataactntgtctcgtaggtaaccaacncgccaaccaggaccaaaccgcccccaaatcatgtatttagngagtacagtacgccgcctgacggtccngatcgctctngctcgaagtcgtgacaaccgccgtcctccgtgaccgtctcgtcggctaccggngcgaggagntaggacgtntagtacttacgtcgtggtctgcctacacgtagcgacgagtcgtagtcgtacggtcgtgtcgttacggtggttacgggacgaacggttaacgacgttccgtaaccggtaccgtaacgtacgcgaccgtaacccggttaacgtcccg

SEQ ID NO: 385719 - DNA, 536 bp, Homo sapiens
  misc_feature: GZ8MTXP01CC3YD.51.80.H03.1.454.CMB.2.raw
  modified_base (230)..(230): a, c, t, g, unknown or other
  modified_base (254)..(254): a, c, t, g, unknown or other
  modified_base (269)..(269): a, c, t, g, unknown or other
  modified_base (343)..(343): a, c, t, g, unknown or other
  modified_base (460)..(460): a, c, t, g, unknown or other
  modified_base (462)..(462): a, c, t, g, unknown or other
  modified_base (464)..(464): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtgttataactntgtctctgtacaacngccaccaggcaaacgcccctaaatcatgatttatgaggtcagtaagcgccctgacgggtcctgatcgccttctntaggctccaaagtctcggcaaacgccggtccctccctagaccgtctctgggcctaccaggcgttgaaggagttgaggcttgatttagttactgggcttgcttacacagtgccgaggngngncgtgtcgtgttgtcgttcggtcggacggacggacgacgaacgtacgtccgtcgtacgacgtaaccgcgtccg

SEQ ID NO: 385720 - DNA, 586 bp, Homo sapiens
  misc_feature: GZ8MTXP01BXVMA.51.80.H03.1.454.CMB.2.raw
  modified_base (227)..(227): a, c, t, g, unknown or other
  modified_base (265)..(265): a, c, t, g, unknown or other
  modified_base (296)..(296): a, c, t, g, unknown or other
  modified_base (416)..(416): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctctgcactgaaccngcagtgacgttggtgttatactatgtctctgtacaacngcaccagcaaacgccccaaatcatgatttangagtacagtaacgccggccctcgacgggtccctagactcgtccttcgtcgtcggcctccgaaacgtctcggacaaaccgccggtccctccgtcgtacccgtcgtccgtcgggcctaccgnggtctaggaaggtagtggaacgtcgtagtaactttacgttaccgtcggtcgtttcgacctacgtactagtcggacgaacgggcaggtacctaggttcggtgtcgttacgtacggttcgggacggacggaccgagttcgaacgtaccgtcgtagcacgccgaacgtccccg

SEQ ID NO: 385721 - DNA, 596 bp, Homo sapiens
  misc_feature: GZ8MTXP01DMMBE.51.80.H03.1.454.CMB.2.raw
  modified_base (231)..(231): a, c, t, g, unknown or other
  modified_base (255)..(255): a, c, t, g, unknown or other
  modified_base (267)..(267): a, c, t, g, unknown or other
  modified_base (299)..(299): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccngcagtgacgttggtagttatactntgtctctgacangcaccagacaaacgccccaatcatgtatttangagtcagtagccgtcctgacgggtcctgatccgtccttctcgtgctccgaaacgttcgtcggacaaaccgaccggtccctcccgtgtaccgtctcgtcgggccttccgaggtcctaggaacggtgtaggagggtcttagtaactttacttacgtggtcttggaccttacgaatacgtcgacgaacgggcagtccaggttccggttgtcgttccgttagggttacgggcgggaacggttaaaccgcggttcgtcggtacccggttcgttacggacgttaccggcccgaaggttccccg

SEQ ID NO: 385722 - DNA, 594 bp, Homo sapiens
  misc_feature: GZ8MTXP01AR3PW.51.80.H03.1.454.CMB.2.raw
  modified_base (301)..(301): a, c, t, g, unknown or other
  modified_base (306)..(306): a, c, t, g, unknown or other
  modified_base (463)..(463): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgcccctgactcagcctccctccgcgtccgggtctcctggacagtcagtcacatctctgcactggaaccagcagtgacgtttggtgttatactatgtctctggtaccaacacgcaccagcaaacgccccaaatcatgattangagtnagtagcgccctgacgggtccctgactcgtccttctcgtgcctcaaagtctgcaacgcgcctcctgaccgtctcgtcgggcctccgaggccgtaggacggagtcggaacggcttagtaactttacttcgcgggtcttcggccttaccacgtagtcggnaaccggcgaggcctacggttcgggtgtacgttaccgttaacggttccgggacgggtaacggggacccttaacggttccgttcggaaccccgttccgtaaacggtcgaaccggtaaccccgaagggtccccg

SEQ ID NO: 385723 - DNA, 573 bp, Homo sapiens
  misc_feature: GZ8MTXP01ATNMD.51.80.H03.1.454.CMB.2.raw
  modified_base (304)..(304): a, c, t, g, unknown or other
  modified_base (346)..(346): a, c, t, g, unknown or other
  modified_base (375)..(375): a, c, t, g, unknown or other
  modified_base (381)..(381): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctcgcgtccggtctcctgacagtcagtcaccatctcctgcactggaaccagcagtgacgttggtgtataactatgtctctggtaccaacagcacccagaccaaacgcccccaaatcatgtatttangagtacagtaacgcggcctcgacgggtccctgatcgccttcntgctcaaatctggcaacgacgtccctccngtaccncgtctgggcctcacggctggaggattggagtgttagatttaaagtttacgtcggtcgtcgtcctacgtaatacgacgacgacggacgtacgtacgtacgtcggttcggtcgttcgtacggttacgggtacgggaacgggacgaacgttacgtaacgtaccgtccgtacgacgaccgtaaccgaaccggtccg

SEQ ID NO: 385724 - DNA, 497 bp, Homo sapiens
  misc_feature: GZ8MTXP02JYBCE.51.80.H03.1.454.CMB.2.raw
  modified_base (325)..(325): a, c, t, g, unknown or other
tcagcgatcgtatacacgaccggtgctcgatttagctgtgcgtcgaaggaaaggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctcctggtaccaacagcacccaggcaaagcccccaaactcatgatttatgaggtcagtaagcggccctnaggggtccctgatcgccttctctgctccaagtctggcaaacacggcctccctgacctctctggctcaggctgagatgaggctgattatactgctgctcacatgcgaggcagcagtcggtgtgctagttcggcggaggaccaagctgaccgtctaggtcacgcccgaagcccg

SEQ ID NO: 385725 - DNA, 494 bp, Homo sapiens
  misc_feature: GZ8MTXP02HQL7B.51.80.H03.1.454.CMB.2.raw
  modified_base (306)..(306): a, c, t, g, unknown or other
  modified_base (395)..(395): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtggttataactatgtctcctggtaccaacagcacccaggcaaacgccccaaactcatgatttangagtcagtaagcgcctcagggtccctgatcgccttctctgctcaagtctggcaacacgccctcctgaccgtctctggctcaggctgagntgaggctgattattactgcttgctcacatgcaggcagcagtcggtgtgctacgttcgggcgagggaccaagctgaccgtcgtagcacgcccaaggtccc

SEQ ID NO: 385726 - DNA, 509 bp, Homo sapiens
  misc_feature: GZ8MTXP02IU1JW.51.80.H03.1.454.CMB.2.raw
  modified_base (307)..(307): a, c, t, g, unknown or other
  modified_base (436)..(436): a, c, t, g, unknown or other
tcagcgatcgtatacacgaccggtgctcgatttagctgtgcgtcgaaggaaaggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggccaacgcccccaaactcatgatttangaggtcagtaagcggccctcgaggggtccctgatcgccttctctgctcagtctggcaacacggcctccctgacccgtctcgtgggcctccgaggcctgaggatggaggctgattatactgctgctcacntgcaggcagcagtcggtgtgctagtcgggacggagggaccagcgtgacccgtcgtacggtcacgcccaaggcc

SEQ ID NO: 385727 - DNA, 537 bp, Homo sapiens
  misc_feature: GZ8MTXP02F19I9.51.80.H03.1.454.CMB.2.raw
  modified_base (299)..(299): a, c, t, g, unknown or other
  modified_base (328)..(328): a, c, t, g, unknown or other
  modified_base (407)..(407): a, c, t, g, unknown or other
tcagcgatcgtatacacgaccggtgctcgatttagctgtgcgtcgaaggaaaggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactatgtctctgtaccaacagcaccagcaaacgccccaaatcatgatttangagtcagtaacgcggcctcgacgggtccngactcgccttctctggctccaagtctggaccaacaccggccctccctgacccgtctcgtcgggcctcgaggctagaggntggaggtctagtatttaattcgtgcttgctcacagtgcgagcgagcgtagtcggtcgtgtcgtacgttcggacggacggaaccgaacgacgtaacgaccgtaccgtacggtacgacgaccgaacggcccg

SEQ ID NO: 385728 - DNA, 498 bp, Homo sapiens
  misc_feature: GZ8MTXP02IJLML.51.80.H03.1.454.CMB.2.raw
  modified_base (245)..(245): a, c, t, g, unknown or other
  modified_base (306)..(306): a, c, t, g, unknown or other
  modified_base (324)..(324): a, c, t, g, unknown or other
  modified_base (333)..(333): a, c, t, g, unknown or other
  modified_base (432)..(432): a, c, t, g, unknown or other
tcagcgatcgtatacacgaccggtgctcgatttagctgtgcgtcgaaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggnggttataactatgtctctggtaccaacagcacccaggcaaagcccccaaatcatgatttangaggtcagtaagcgcctnagggtcccngatcgcttctctgctcaagtctggcaacacggccctccctgaccgtctctgggcctaccgaggctgaggatgaggctgattattactgcttgctcaacntgcaggcagcagtcggtgtgctagttcggacggaggaccagctgaccgtctaggcacgccaaggcc

SEQ ID NO: 385729 - DNA, 522 bp, Homo sapiens
  misc_feature: GZ8MTXP02HIJSN.51.80.H03.1.454.CMB.2.raw
  modified_base (307)..(307): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtggttataactatgtctcctggtaccaacagcacccaggcaaacgcccccaaactcatgatttangaggtcagtaagcggccctgaggggtccctgatcgccttctctgctcaagtctggcaacacggcctccctgaccgtctcgtggcctccgaggctggaggatggaggctagatttatactgctgctcacatcgcaggcagcagtcggtcgtgtcgtacgttcggcggacgggacgaacgcgtcgtacgtaccgtacggtacgacgaccgaacgccg

SEQ ID NO: 385730 - DNA, 508 bp, Homo sapiens
  misc_feature: GZ8MTXP02JVZS6.51.80.H03.1.454.CMB.2.raw
  modified_base (307)..(307): a, c, t, g, unknown or other
  modified_base (327)..(327): a, c, t, g, unknown or other
  modified_base (372)..(372): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaacgcccccaaatcatgatttangaggtcagtaagcggccctnaggggtccctgactcgccttctctggcctccaagtctggcaaacncggcctcctgaccgtctctggggcctccgaggctgaggatggaggctgatttattactgctgctcacatgacaggcagcagtcggtgtgctagtcggcggagggaccaagctgaccgtctaggtcacgcccaggcc

SEQ ID NO: 385731 - DNA, 529 bp, Homo sapiens
  misc_feature: GZ8MTXP02FVD91.51.80.H03.1.454.CMB.2.raw
  modified_base (304)..(304): a, c, t, g, unknown or other
  modified_base (410)..(410): a, c, t, g, unknown or other
tcagcgatcgtatacacgaccggtgctcgatttagctgtgcgtcgaaggaaaggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagccccaaatcatgatttangaggtcagtaagtggccctagacgggtccgtgatcgtccttctctggctccaacgtctggcaacacggcctccctcgaccgtctctggtctccacggcgtcgaggngtgaggcgtagattattactgctgctcacatgcaggcacgacagtcggtcgtgctacgttcgggcggacgggaaccgacgacgtcgtaccgtaccgttacggcgacgacccgacggccg

SEQ ID NO: 385732 - DNA, 518 bp, Homo sapiens
  misc_feature: GZ8MTXP02FY944.51.80.H03.1.454.CMB.2.raw
  modified_base (307)..(307): a, c, t, g, unknown or other
  modified_base (433)..(433): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtggttataactatgtctcctggtaccaacagcacccaggcaaacgccccaaatcatgatttangaggtcagtaagcgcctcgacgggtccctgatcgccttctctgctccaagtctggacaaacaccggccctccctgacccgtctcgtcgggcctccgaggctggaggatggagctagatttattacngctgctacacatgcaggcagcagtcggtgtgcttagtcgggacggacggaccagctgaccgtcgtaggtcacgcccgaaggtccc

SEQ ID NO: 385733 - DNA, 502 bp, Homo sapiens
  misc_feature: GZ8MTXP02FNG9W.51.80.H03.1.454.CMB.2.raw
  modified_base (435)..(435): a, c, t, g, unknown or other
  modified_base (453)..(453): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtggttataactatgtctcctggtaccaacagcacccaggcaaagcccccaaactcatgatttatgagtcagtaagcggccctgaggggtccctgactcgccttctctggctccaagtctggcaacacggcctccctgacccgtctcgtgggcctccgaggctgaggatgaggctgattatactgctgctcacntgcaggcagcagtcggtntgctagtcggcggaggaccaagctgaccgtctaggtcagcccaaggccg

SEQ ID NO: 385734 - DNA, 443 bp, Homo sapiens
  misc_feature: GZ8MTXP02IHT25.51.80.H03.1.454.CMB.2.raw
  modified_base (214)..(214): a, c, t, g, unknown or other
  modified_base (226)..(229): a, c, t, g, unknown or other
  modified_base (242)..(242): a, c, t, g, unknown or other
  modified_base (244)..(244): a, c, t, g, unknown or other
  modified_base (246)..(246): a, c, t, g, unknown or other
  modified_base (251)..(252): a, c, t, g, unknown or other
  modified_base (257)..(257): a, c, t, g, unknown or other
  modified_base (266)..(269): a, c, t, g, unknown or other
  modified_base (271)..(272): a, c, t, g, unknown or other
  modified_base (274)..(274): a, c, t, g, unknown or other
  modified_base (276)..(276): a, c, t, g, unknown or other
  modified_base (278)..(278): a, c, t, g, unknown or other
  modified_base (282)..(282): a, c, t, g, unknown or other
  modified_base (288)..(291): a, c, t, g, unknown or other
  modified_base (294)..(295): a, c, t, g, unknown or other
  modified_base (298)..(298): a, c, t, g, unknown or other
  modified_base (301)..(301): a, c, t, g, unknown or other
  modified_base (303)..(303): a, c, t, g, unknown or other
  modified_base (316)..(316): a, c, t, g, unknown or other
  modified_base (324)..(324): a, c, t, g, unknown or other
  modified_base (327)..(327): a, c, t, g, unknown or other
  modified_base (329)..(329): a, c, t, g, unknown or other
  modified_base (331)..(331): a, c, t, g, unknown or other
  modified_base (333)..(333): a, c, t, g, unknown or other
  modified_base (339)..(339): a, c, t, g, unknown or other
  modified_base (341)..(341): a, c, t, g, unknown or other
  modified_base (343)..(343): a, c, t, g, unknown or other
  modified_base (354)..(355): a, c, t, g, unknown or other
  modified_base (357)..(357): a, c, t, g, unknown or other
  modified_base (362)..(363): a, c, t, g, unknown or other
  modified_base (365)..(365): a, c, t, g, unknown or other
  modified_base (374)..(374): a, c, t, g, unknown or other
  modified_base (383)..(383): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatcncctgcactgacnnnngtgtgtatatatntncngacanncacancacaccacnnnntnngnanancgcncgcgcnnnnctnngcncancngcacacgcctccncgctctcngcncngngngagagngngntatatattatnntnctcanngngagcagagngtgtcgtgngtacgtcggacggacggaacgaacgacgtaacgtacgtacgtacgtacgacgacgacgcg

SEQ ID NO: 385735 - DNA, 527 bp, Homo sapiens
  misc_feature: GZ8MTXP02FNVI3.51.80.H03.1.454.CMB.2.raw
  modified_base (230)..(230): a, c, t, g, unknown or other
  modified_base (307)..(307): a, c, t, g, unknown or other
  modified_base (438)..(438): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtgttataactatgtctctggtaccaacagcacccaggcaaacgcccccaaaactcatgatttangagtcagtaagcggccctgaggggtccctgatcgccttctctggctccaagtctggcaacacggccctccctgacccgtctctgggactcccgaggctgaggatgaggctagatttatactgctgctcaantgcaggcagcagtcggtgtcgctacgttcgggcgggaacgggaccaaggctcggaacccgtcgtaacgggtcacggccccaaggtcccg

SEQ ID NO: 385736 - DNA, 506 bp, Homo sapiens
  misc_feature: GZ8MTXP02F03WB.51.80.H03.1.454.CMB.2.raw
  modified_base (306)..(306): a, c, t, g, unknown or other
  modified_base (416)..(416): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaacgccccaaatcatgatttangagtcagtaagcgcctcgagggtccctgatcgcttctctggctcaagtctggcaacgacggcctcctgacctctctggctcaggctgagatgagctgattatactgctgntcacagtgcaggcagcagtcggtgtgctagttcgggacggacgggaccaagctaaggacccgtcgtacggtccaacgcccgaaaggtccc

SEQ ID NO: 385737 - DNA, 511 bp, Homo sapiens
  misc_feature: GZ8MTXP02GV6DM.51.80.H03.1.454.CMB.2.raw
  modified_base (305)..(305): a, c, t, g, unknown or other
  modified_base (332)..(332): a, c, t, g, unknown or other
  modified_base (363)..(363): a, c, t, g, unknown or other
  modified_base (451)..(451): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctctggtaccaacagcacccaggcaaacgcccccaaatcatgatttangagtcagtagcgcctcgcggggtcccngatcgccttctctggctccagtctgcaaacncggccctccctgacccgtctcgtgggcctccgaggctgaggatgaggctgactttatactgctgcttcacatgcaggcagcagtcggngtgcttacgtcgggcggacgggaccaggctcggaacctcgtacggcacgcccaaggtccc

SEQ ID NO: 385738 - DNA, 494 bp, Homo sapiens
  misc_feature: GZ8MTXP02H9CDO.51.80.H03.1.454.CMB.2.raw
  modified_base (230)..(230): a, c, t, g, unknown or other
  modified_base (267)..(267): a, c, t, g, unknown or other
  modified_base (298)..(298): a, c, t, g, unknown or other
  modified_base (325)..(325): a, c, t, g, unknown or other
  modified_base (382)..(382): a, c, t, g, unknown or other
  modified_base (405)..(405): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtgttatactatgtctctgtacacngcaccagcaaagcccccaaatcatgatttangaggtcagtaagcgcctgagggtcccngatcgctctctgctcagtctggcaacacgcctccctgaccgtctctggctccaggcngaggatgaggctgattatactgntgctcacatgcaggcagcagtcggtgtgctagttcgggacggacggaccaagcgtcgaccgtacgtacggtcacgcccgaacggtcccg

SEQ ID NO: 385739 - DNA, 535 bp, Homo sapiens
  misc_feature: GZ8MTXP02HZJWU.51.80.H03.1.454.CMB.2.raw
  modified_base (230)..(230): a, c, t, g, unknown or other
  modified_base (307)..(307): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgtttggtggttataactatgtctcctggtaccaacagcacccaggcaaacgccccaaatcatgatttangagtcagtaagcgcctcgacgggtccctgactcgtccttctctggctcaagtctcggcaaacaccggccctccctgacccgttctcctcgggcctccgaggctggagagtgagctagtattattactgcttgcttacactagtcgcgaggcagccagtcggtgtgtctacgttcgggacggacgggaccaagcgtaagacccgtcgtacggcacgccgtaacggcccg

SEQ ID NO: 385740 - DNA, 528 bp, Homo sapiens
  misc_feature: GZ8MTXP02JZV16.51.80.H03.1.454.CMB.2.raw
  modified_base (306)..(306): a, c, t, g, unknown or other
  modified_base (365)..(365): a, c, t, g, unknown or other
  modified_base (438)..(438): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactatgtctcctggtaccaacagcacccaggcaaacgcccccaaatcatgatttangagtcagtaagcggcctgacgggtccctgatcgcttctctggctcaagtctggcaaacnccggccctccctgacccgtctcgtcggcctccgaggctgaggatggaggctagtattattactgctgctcacntcgacaggcagcagtcggtgtcgctacggttcgggcggacgggaccaaggctcggacccgtcgtacggtccacggtcccgaacggtcccg

SEQ ID NO: 385741 - DNA, 574 bp, Homo sapiens
  misc_feature: GZ8MTXP02JTD3H.51.80.H03.1.454.CMB.2.raw
  modified_base (303)..(303): a, c, t, g, unknown or other
  modified_base (308)..(308): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactatgtctctgtaccaacagcaccaggacaaacgccccaaatcatgatttangagtnagtacgcgcctgacgggtccctgactcgtccttctcgtcgcctaccgaagttcgtcgggaccaaaccgccggtccctcccgtcgacccgttctcgtcggcctcgaggctgagatggagtctagtattactcgtgtctgctacactagcgcgaggacagctagtccggtgtcgtacgttaacggttccgggacgggacgggaacccgaaggtccgtaacggtaccccgttacgtacgggtaccgaccggtacccgaacggtccccgg

SEQ ID NO: 385742 - DNA, 593 bp, Homo sapiens
  misc_feature: GZ8MTXP02G2KWS.51.80.H03.1.454.CMB.2.raw
  modified_base (347)..(347): a, c, t, g, unknown or other
  modified_base (537)..(537): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcaggcacagggtcctgggcccagtctgccctgactcagcctccctccgcgtccggtctcctggacagtcagtcaccatctcctgcactggaaccagcagtgacgttggtggttataactatgtctcctggtaccaacagcaccagacaacgcccccaaatcatgactttangtacgtacagtaacgcggccctcgacggggtccctgactcgtcttctcgtggcctaccgtaagtcgtcggtaccaaaccgcccggtcccctttacccgaccgtacccgttccttccggtcggggcccttacccggacggtcccgttagggacggtagtcggaacggtctagtactttacgttacgtcgtntacgtctacgaactgtcgacgtaggcagacacgttcggtacgtcgtcgtttacggg

SEQ ID NO: 385743 - DNA, 552 bp, Homo sapiens
  misc_feature: GZ8MTXP02HG5VL.51.80.H03.1.454.CMB.2.raw
  modified_base (270)..(270): a, c, t, g, unknown or other
  modified_base (305)..(305): a, c, t, g, unknown or other
  modified_base (343)..(343): a, c, t, g, unknown or other
  modified_base (354)..(354): a, c, t, g, unknown or other
  modified_base (360)..(360): a, c, t, g, unknown or other
  modified_base (368)..(368): a, c, t, g, unknown or other
  modified_base (399)..(399): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactatgtctctgtaccaacngcacccaggaccaaacgccccaaatcatgatttangagtcagtaagcgcctgacgggtcctgactcgccttcnctgctcagtcngcaacncgcctccngaccgtctcgtggacctccgaggctgagtgnggagtctagtattacgtcgtgctcgctacactagtcgacgacgacgacgtacgtacgtcggtcgtacgtacgtacgtacgggtaccgggacgggaaccgaacgtacgtaaccgtaccggtaccgtacggtaccgtaccgaccggaccggtccg

SEQ ID NO: 385744 - DNA, 507 bp, Homo sapiens
  misc_feature: GZ8MTXP02F0UMC.51.80.H03.1.454.CMB.2.raw
  modified_base (409)..(409): a, c, t, g, unknown or other
  modified_base (426)..(426): a, c, t, g, unknown or other
  modified_base (435)..(435): a, c, t, g, unknown or other
  modified_base (453)..(453): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttaataactatgtctcctggtaccaacagcacccaggcaaagcccccaaatcatgatttatgaggtcagtaagcggccctcgacggggtccctgatcgccttctctggctcaagtctggcaacacggcctccctgaccgtctcgtgggcctccaggctgaggntgaggctgattattacngctgctcanatgcaggcagcatcggtntgctagtcggcggaggaccaagctaagaccgtcgacggtcacgcccaaggtccg

SEQ ID NO: 385745 - DNA, 524 bp, Homo sapiens
  misc_feature: GZ8MTXP02JU0XV.51.80.H03.1.454.CMB.2.raw
  modified_base (315)..(315): a, c, t, g, unknown or other
  modified_base (347)..(347): a, c, t, g, unknown or other
  modified_base (505)..(505): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaangcacccaggcaaagccccaaatcatgatttangagtcagtaacgcgccctgagggtccctgatcgcttctctggctccaagtctggacaacgcggccctcctgaccgttctcgttcgggccttcgaggtctagacggatggaggctggtatttaactacgtcgcttgcttcactactggcagcgacgacngtcggtcgtgtcgttacgg

SEQ ID NO: 385746 - DNA, 540 bp, Homo sapiens
  misc_feature: GZ8MTXP02H0UF0.51.80.H03.1.454.CMB.2.raw
  modified_base (230)..(230): a, c, t, g, unknown or other
  modified_base (306)..(306): a, c, t, g, unknown or other
tcagcgatcgtatacacgaccggtgctcgatttagctgtgcgtcgaaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtgttataactatgtctcctggtaccaacagcacccaggcaaacgcccccaaatcatgatttangagtcagtaagtgcctcagggtccgtcgatcgtcctctctggctccaacgtctcggcaaccaccggccctccctcgaccgtctcgtggccgtccacggctgtaggagttgaggctgattaatttactgcgtcgctcacatgcgaggcagctagtcggttggtgtcttacgttcgggacgggacgggaaccaagcgtcgaacccggtccgtacggtcgacgacccgaacggtccg

SEQ ID NO: 385747 - DNA, 525 bp, Homo sapiens
  misc_feature: GZ8MTXP02GNM0G.51.80.H03.1.454.CMB.2.raw
  modified_base (415)..(415): a, c, t, g, unknown or other
  modified_base (434)..(434): a, c, t, g, unknown or other
  modified_base (463)..(463): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctctggtaccaacagcacccaggcaaacgcccccaaatcatgtatttatgaggtcagtaagcggccctgacggggtccctgactcgccttctctggctcaagtctggacaacacggccctcccgtgacccgtctcgtcgggcctccgaggctgaggntggaggctagattattacngctgctcacatgcaggcagcagtcggtgngtctagtcgggacggtacgggaccaaggctcggacccgtcgtacggtcacgccgaaggtccc

SEQ ID NO: 385748 - DNA, 623 bp, Homo sapiens
  misc_feature: GZ8MTXP02GF3SM.51.80.H03.1.454.CMB.2.raw
  modified_base (227)..(227): a, c, t, g, unknown or other
  modified_base (241)..(241): a, c, t, g, unknown or other
  modified_base (300)..(300): a, c, t, g, unknown or other
tcagcgatcgtatacacgaccggtgctcgatttagctgtgcgtcgaaggaaaggggctggggtctcaggaggcagcgctctcaggacgtcaccaccatggcctgggctctgctcctcctcaccctcctcactcagggcacagggtcctgggcccagtctgccctgactcagcctcctccgcgtccggtctcctggacagtcagtcaccatctcctgcactggaaccngcagtgacgttggngttataactatgtctcctggtaccaatgcacccaggcaaagccccaaatcatgatttangagtcagtagcgcctgagggtccctagactcgccttacgtcgtggcctaccgaagttccgtcggaccaaaccgtccggtaccccttcccgtaggaacccgttcgtccgtacggggtcccttacccgaaggtcccttaggaaacggtcgttacggacggtcttagtaactttacgttacgtcgtacgttcgctacgactacgtcgaccgaggtccaggtctaggttcggtacgtacgtacgttacggttccggacggtacgtaccaaggttccgaaccggtaaccgttcgtaacggtcctaccggtacccgaagggtttccccg

SEQ ID NO: 385749 - DNA, 551 bp, Homo sapiens
  misc_feature: GZ8MTXP02JLVMF.51.80.H03.1.454.CMB.2.raw
  modified_base (307)..(307): a, c, t, g, unknown or other
  modified_base (368)..(368): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaacgccccaaatcatgatttangaggtcagtaagcggcctgacgggtccctgatcgccttctcgtgctccaagtctggcaacncggccctccctgacccgtctcgtgggcctccgaggcctgagatgaggtctagtattattactgctgctcacatgacaggcaggctagtcggttgtgtaccttagttcggggacggacggggaacccaaggtcctaacggacccgttccgtaacgggtccaacggtacccccgaagggtccccg

SEQ ID NO: 385750 - DNA, 554 bp, Homo sapiens
  misc_feature: GZ8MTXP02GU09Q.51.80.H03.1.454.CMB.2.raw
  modified_base (230)..(230): a, c, t, g, unknown or other
  modified_base (269)..(269): a, c, t, g, unknown or other
  modified_base (347)..(347): a, c, t, g, unknown or other
  modified_base (370)..(370): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtgttataactatgtctctgtaccaanagcacccaggcaaacgccccaaatcatgatttatgaggtcagtaacgcggcctcgacggggtccctgactcgccttcnctggcctcaagtctcgggcaacnccggccctccctgaccgtctcgtgggcctcgaggctgagagtggacggtctagtatttaattactggtcctgccttacactagtcgacgaggacagcctagtcggtgtgtaccttggttccgggacggacgggaccaacggcgtcggtaccgtaccgtacgggtcacggacccgacggtccccg

SEQ ID NO: 385751 - DNA, 568 bp, Homo sapiens
  misc_feature: GZ8MTXP02IS3LO.51.80.H03.1.454.CMB.2.raw
  modified_base (269)..(269): a, c, t, g, unknown or other
  modified_base (389)..(389): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcaggcacagggtcctgggcccagtctgccctgactcagcctccctccgcgtccgggtctcctggacagtcagtcaccatctcctgcactggaaccagcagtgacgttggtgttataactatgtctctgtaccaacngcaccaggccaaacgccccccaaatcatgtatttatgaggtcaagtaagccggccctcgacggggtcctgatcgtccttctctgcctaccaagttctcggcaacgaccggtccctcccgngacccgtctcgtggcctccgaggtctgaggtactgaggtctagtatttaaacttccgtgtccttcgtccttacaacgtatcggcaagggccaaggctagtcggtgtgcgttacgttcgggacggaggggaaccctaagcgtcgtaacccgtcgtaacggtcaccgaccgaacggtcccg

SEQ ID NO: 385752 - DNA, 588 bp, Homo sapiens
  misc_feature: GZ8MTXP02HREOZ.51.80.H03.1.454.CMB.2.raw
  modified_base (227)..(227): a, c, t, g, unknown or other
  modified_base (266)..(266): a, c, t, g, unknown or other
  modified_base (299)..(299): a, c, t, g, unknown or other
  modified_base (324)..(324): a, c, t, g, unknown or other
  modified_base (407)..(407): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctcctcactcaggcacagggtcctgggcccagtctgccctgactcagcctccctccgcgtccggtctcctggacagtcagtcaccatctcctgcactggaacngcagtgacgttggtgttataactatgtctctgtaccaanagcaccagacaaacgccccaaatcatgatttangagtcagtaagcgcctgagggtccngatcgcttctctgctctagtctcggacaaacgcggccctcctcgaccgttctcgtcggcctcgagcgtgagtatggaacggtntagtacttattacgtgtcgttgactacactgtacgacgacgacgacgtacgtacgtcggttcggtcggttacggttacggttaccggggtacgggtaacgggtaaccggtaaccggtaccgtaaccggtacccggtaccggttaccggtaccgtaaccggtacccggtaaccggtacccgg

SEQ ID NO: 385753 - DNA, 529 bp, Homo sapiens
  misc_feature: GZ8MTXP02GBALC.51.80.H03.1.454.CMB.2.raw
  modified_base (351)..(351): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtggttataactatgtctcctggtaccaacagcacccaggcaaacgcccccaaatcatgatttangagtcagtaagcgcctcgacgggtccctgatcgcttctctggctcaagtctgacaacacggcttcccgtcgaccgtctcgtcggtctccgaggtctagacggatcggagtctgtatttagttactgtctgctcactatcgcgaaggccaagcctaggtcggtgtcgtacgtttacggg

SEQ ID NO: 385754 - DNA, 565 bp, Homo sapiens
  misc_feature: GZ8MTXP02I9F4Z.51.80.H03.1.454.CMB.2.raw
  modified_base (358)..(358): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctctgcactggaccagcagtgacgttggtggttaataactatgtctcctaggtaccaacagccacccgaggaccaaaccgacccccaaatcatgtaactttanagagtacaagtaacgccgtccctcgacggggtccctagactccgtcttctcgtgcctaccgaagtcctggaccaaccgaccggtcccctccgtacgaccgttctcgtcggctccgaggtccaggagacgtggaggctagtacttatacgtcgctagctcactagtcgaccaggcctaagctaaggtccgtgtacggtactttacggg

SEQ ID NO: 385755 - DNA, 549 bp, Homo sapiens
  misc_feature: GZ8MTXP02HBKXM.51.80.H03.1.454.CMB.2.raw
  modified_base (232)..(232): a, c, t, g, unknown or other
  modified_base (307)..(307): a, c, t, g, unknown or other
tcagcgatcgtatacacgaccggtgctcgatttagctgtgcgtcgaaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccaggtctcctggacagtcagtcaccatctcctgcactggaaccngcagtgacgttggtgttataactatgtctctggtaccaacagcaccaggacaaacgacccccaaatcatgattangaggtcagtaagcggcctcgaggggtccctgactccgcttctctcggctccgaggtctggacaaccgacgccctccgtcgacccgtctcgtggcctccgaggctagaggatgaggtctagtatttacttcgtgtctgcctacaagtatcgacgacggcagcacgttcggtgtcgtcgttagttcgggacgggaacggacgaacgtcgtacggtacccgtcgtaaggccacggacccgaacgg

SEQ ID NO: 385756 - DNA, 649 bp, Homo sapiens
  misc_feature: GZ8MTXP02G0ZR2.51.80.H03.1.454.CMB.2.raw
  modified_base (231)..(231): a, c, t, g, unknown or other
  modified_base (314)..(314): a, c, t, g, unknown or other
tcagcgatcgtatacacgaccggtgctcgatttagctgtgcgtcgaaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtagttataactatgtctcctggtaccaacagccacccaggaccaaaacgcccccaaactcatgtatttangaggtcaagtacgccggcctcgacggggtccctgactcgtccttctcgtcgctaccgaagtctcgggaccaacgaccggtccctccgtcgtacccgtcgtcgtcggggtccctacccggacggtccgttagggaaacggtcgtacggaacgggtcctaggttaactttaacgttacgttcgtccgttagtcccttacgaacctagttcggacgaacgggccaggaccgtacggttcggtcgtcgtacgtttacggttccggggacggtaacgggaacccaggtacctaaccggtacccgtacgtacggtacgacccgtacccgtaacggtccccg

SEQ ID NO: 385757 - DNA, 508 bp, Homo sapiens
  misc_feature: GZ8MTXP02H5LZ4.51.80.H03.1.454.CMB.2.raw
  modified_base (269)..(269): a, c, t, g, unknown or other
  modified_base (302)..(302): a, c, t, g, unknown or other
  modified_base (358)..(358): a, c, t, g, unknown or other
  modified_base (372)..(372): a, c, t, g, unknown or other
  modified_base (387)..(387): a, c, t, g, unknown or other
  modified_base (393)..(393): a, c, t, g, unknown or other
  modified_base (395)..(395): a, c, t, g, unknown or other
  modified_base (397)..(397): a, c, t, g, unknown or other
  modified_base (409)..(409): a, c, t, g, unknown or other
  modified_base (411)..(411): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctctgtaccaanagcaccaggcaaacgccccaaatcatgatttangagtcagtaacgcgcctgagggtcctgatcgcctctctgctcaagtctgacaaacncgcctcctgacctncgtggctccgagcgngagagngngntgtatatatgtntncacactagacgacgacgacgacgacgtagtcgtcgtagtcgtacgtcggacggacggacgacgacgtcgtacgtacgtacgtacgacgaccgacgcg

SEQ ID NO: 385758 - DNA, 535 bp, Homo sapiens
  misc_feature: GZ8MTXP02GX71C.51.80.H03.1.454.CMB.2.raw
  modified_base (315)..(315): a, c, t, g, unknown or other
  modified_base (341)..(341): a, c, t, g, unknown or other
  modified_base (351)..(351): a, c, t, g, unknown or other
  modified_base (430)..(430): a, c, t, g, unknown or other
  modified_base (440)..(440): a, c, t, g, unknown or other
  modified_base (499)..(499): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacgttggtggttataactatgtctctggtaccaanagcaccaggccaaaacgcccccaaancatgatttangagtcagtaacgcgccctgacggggtccctgatcgcttctctggcctaccgaagtctggacaacgacggtcctttcccngacccgttcnctgggcctaccgaggtcctgaggatcggagctagatttatactgccttgactcgactancgcgacgaacgacgacgacgtcgtcgtcgtacgtcg

SEQ ID NO: 385759 - DNA, 554 bp, Homo sapiens
  misc_feature: GZ8MTXP02HLOTH.51.80.H03.1.454.CMB.2.raw
  modified_base (265)..(265): a, c, t, g, unknown or other
  modified_base (299)..(299): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcaggcacagggtcctgggcccagtctgccctgactcagcctccctccgcgtccggtctcctggacagtcagtcaccatctcctgcactggaaccagcagtgacgttggtgtatactatgtctctgtaccaanagcaccaggacaaacgccccaaatcatgatttangagtcagtaagcgcctcgacgggtccctgactcgccttctcgtgcctccaagtctggaccaaacgaccggccctacccgtgacccgtctcgtgggcctcccgaggctggacgatggaggctagatttattacgtgcttgctacacatgacaggcaagctacgtcggttgtcgtacttacggttcgggacgggacggacccaaggtccgtaacggacccgttaccgtacgggtaccaccggacccaacggtccccg

SEQ ID NO: 385760 - DNA, 544 bp, Homo sapiens
  misc_feature: GZ8MTXP02G7LD2.51.80.H03.1.454.CMB.2.raw
  modified_base (230)..(230): a, c, t, g, unknown or other
  modified_base (253)..(253): a, c, t, g, unknown or other
  modified_base (267)..(267): a, c, t, g, unknown or other
  modified_base (300)..(300): a, c, t, g, unknown or other
  modified_base (329)..(329): a, c, t, g, unknown or other
  modified_base (422)..(422): a, c, t, g, unknown or other
  modified_base (429)..(429): a, c, t, g, unknown or other
  modified_base (461)..(461): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcactggaaccngcagtgacgttggtgttatactntgtctctgaccacngcaccagacaaacgccccaaatcatgtatttangagtcaagtagccgtcctgacgggtcccngtactcgcccttctcgtcggacctccgaagttccgtgggacctaaaccgccggtccctcccgtacgaccgtctcgtcgcctcgaggctgaganggacgtntagtacttatctgctgctacactagtcgacgnggcagtcgtagtcggttgcgtcgttacggtcgggacggaccggacacgtcgtccgacgtcgtacgccacgaccgacggtcccg

SEQ ID NO: 385761 - DNA, 616 bp, Homo sapiens
  misc_feature: GZ8MTXP02IFILZ.51.80.H03.1.454.CMB.2.raw
  modified_base (230)..(230): a, c, t, g, unknown or other
  modified_base (306)..(306): a, c, t, g, unknown or other
  modified_base (333)..(333): a, c, t, g, unknown or other
  modified_base (393)..(393): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtgtataactatgtctctgtaccaacagcacccaggacaaaacgccccaaaatcatgtatttangagtcagtaagcgcctgacggggtccngactcgccttctctggctacaagtctcggacaaacaccggtccctcccgtgacccgttcnccgtcgggcctccgagggtctggaggtatggaggtctgtaacttattaccgtgtcgttcgtcttacaacctgttacggccgaacggggtacaacggccgtaagtccggggttaggtcggttaccgttaacggttccggggacgggtaacgggtaaccccgaaaggtccgtaacggtacccgttaccgttacggggacctaccggaccccgtaagggtcccccg

SEQ ID NO: 385762 - DNA, 532 bp, Homo sapiens
  misc_feature: GZ8MTXP02I2S07.51.80.H03.1.454.CMB.2.raw
  modified_base (249)..(249): a, c, t, g, unknown or other
  modified_base (270)..(270): a, c, t, g, unknown or other
  modified_base (305)..(305): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtggttanaactatgtctctggtaccaanagcacccaggcaaacgcccccaaatcatgatttangagtcagtaagcgcctgagggtccctgatcgccttctctggctcaagtctggcaaacgacggccctccctgaccgtctcgtgggcctccgaggctgaggatggaggctagatttagttactgctgcctcactatgcaggcagcagtcggtgtcgtctacgttcggggcggtacgggacccaaggccgtcggaacccgttccgtaggaccacggacccgaaggtcccg

SEQ ID NO: 385763 - DNA, 542 bp, Homo sapiens
  misc_feature: GZ8MTXP02JY01X.51.80.H03.1.454.CMB.2.raw
  modified_base (305)..(305): a, c, t, g, unknown or other
  modified_base (433)..(433): a, c, t, g, unknown or other
  modified_base (440)..(440): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctcctgtaccaacagcacccaggcaaacgccccaaatcatgatttangagtcagtaagcggccctcgacggggtccctgactcgccttctctggcctccaagtctggacaacaccggcctcccgtcgaccgtctcgtgggctccgaggctgaggatggagctagtattagttacngctgctnacatgcaggcagcagtcggtgtcgtctacggttccgggcgggaacgggaccctaaggccgtaacggacccgtccgtaacggtccacgacccgaaggtccccg

SEQ ID NO: 385764 - DNA, 553 bp, Homo sapiens
  misc_feature: GZ8MTXP02H7H4M.51.80.H03.1.454.CMB.2.raw
  modified_base (230)..(230): a, c, t, g, unknown or other
  modified_base (271)..(271): a, c, t, g, unknown or other
  modified_base (303)..(303): a, c, t, g, unknown or other
  modified_base (425)..(425): a, c, t, g, unknown or other
  modified_base (428)..(428): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtgttaataactatgtctctgtaccaacngcaccaggcaaacgccccaaatcatgatttangaggtcaagtagcggccctgacgggtcctgatcgcttctctgctacagtctgacaacgcgccctccgtgaccgtctcgtggctcgagctgagactggacgctgtattattactgcttgcctnacntgcgaggcagcgagtcggtgtcgtacgttacggttaccggggcgggtaacgggaccgtaacgggtcccgtaacggtaccccggttaccgttacgggtacccgaccggtacccgtaaacggtcccg

SEQ ID NO: 385765 - DNA, 566 bp, Homo sapiens
  misc_feature: GZ8MTXP02FP4LJ.51.80.H03.1.454.CMB.2.raw
  modified_base (317)..(317): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtcctgccctgactcagccctccctccgcgtccgggtctcctggacagtcagtcaccatctcctgcactggaaccagcagtgacgttggtggttataactatgtctcctggtaccaanagcacccagcaaacgcccccaaatcatgatttatgagtcagtaacgcggccctcgacggggtccctgactcgcttctctggcctcaagtctggaccaacgaccggccctccctgacccgtctccgtgggcctccgaggtcgtaggacggtatgggaacgtcgtagtattttaattacgtgcttaggccttaccaacgtagttcgcgaacggccaagaccgtaacgttcggttgtcgacctttaacgggg

SEQ ID NO: 385766 - DNA, 553 bp, Homo sapiens
  misc_feature: GZ8MTXP02FZEA9.51.80.H03.1.454.CMB.2.raw
  modified_base (415)..(415): a, c, t, g, unknown or other
  modified_base (467)..(467): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagccacccaggacaaacgcccccaaatcatgatttatgaggtcagtaagccggccctgacggggtccctgactcgccttctctggctcagtctggcaacaccggcctccctgaccgtctcgtcgggcctccgaggctgaaggntggaggctagatttattactgctgctacacagtgcaggcagctagtcgggtntgtcttacggttcgggacgggtacgggaacccaaggtcctaacggtacccgtaccgttacgggaccacggacccgaagggtccccg

SEQ ID NO: 385767 - DNA, 570 bp, Homo sapiens
  misc_feature: GZ8MTXP02GISU6.51.80.H03.1.454.CMB.2.raw
  modified_base (270)..(270): a, c, t, g, unknown or other
  modified_base (338)..(338): a, c, t, g, unknown or other
  modified_base (350)..(350): a, c, t, g, unknown or other
  modified_base (423)..(423): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttaataactatgtctctgtaccaanagcacccaggacaaacgccccaaatcatgaatttatgagtacaagtaagcggcctacgaggggtcccngactcgccttcnctacgctacaagtctggaccaacgaccggccctcccgtggaccttctcgtcgggctccgaaggctagaggagngagagtagtattattactgtctcgtactactactagtacgacgacgacgacgtacgtacgtacggtcggtacgtacgttacggtacgggtacgggaacggaacgaacgacgtaacgtaccgtacgtacgtacgacgaccgacgtccg

SEQ ID NO: 385768 - DNA, 560 bp, Homo sapiens
  misc_feature: GZ8MTXP02JD818.51.80.H03.1.454.CMB.2.raw
  modified_base (230)..(230): a, c, t, g, unknown or other
  modified_base (344)..(344): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtgttataactatgtctcctggtaccaacagccacccaggaccaaaacgccccccaaactcatgtaatttatgaggtcagtaacgcgccctgacgggtcccngatcgcttctctgctcagtctggcaacacggcctccctgaccctctcgtcgggcctccgaggctgaggacgtggaggtctagtaatttagttactggtcttgccttacaactagtcgacgaggcagcgtacgtcgggtgtcgtacgttaggttcgggacgggtacgggaccctaagccctaaggaccccgttcgaaggtccacgcccgaaggtccc

SEQ ID NO: 385769 - DNA, 542 bp, Homo sapiens
  misc_feature: GZ8MTXP02HQASQ.51.80.H03.1.454.CMB.2.raw
  modified_base (230)..(230): a, c, t, g, unknown or other
  modified_base (306)..(306): a, c, t, g, unknown or other
  modified_base (369)..(369): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtagttataactatgtctctggtaccaacagcacccaggacaaacgccccaaatcatgatttangagtcagtaacgcgcctcgacgggtcctgactcgtccttctcgtcgctcagttctggcaaacncgccctccgtcgaccgtctcgtcgggacctccgaggctgacggatggacggctagtactttattacgtgcttgccttacacctgtacgcgaaggcagcgtagtcggtgtcgtacgtcgtcgggacggacggaccaagcgtaacgaccgtcgtacgacacgacccgaggtcccg

SEQ ID NO: 385770 - DNA, 511 bp, Homo sapiens
  misc_feature: GZ8MTXP02FFPIK.51.80.H03.1.454.CMB.2.raw
  modified_base (307)..(307): a, c, t, g, unknown or other
  modified_base (428)..(428): a, c, t, g, unknown or other
  modified_base (437)..(437): a, c, t, g, unknown or other
  modified_base (455)..(455): a, c, t, g, unknown or other
tcagcgatcgtatacacgaccggtgctcgatttagctgtgcgtcgaaggaaaggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaacgcccccaaaatcatgatttangaggtcagtaagcggccctcgaggggtccctgatcgccttctctggctccaagtctggcaacacggccctccctgacccgtctctgggcctccgaggctgagatgaggctagattattacngctgctcantgcaggcagcatcggtgngcttacgtcgggcggacgggaccaagctcgaccgtcgtaggccagcccaaggtccc

SEQ ID NO: 385771 - DNA, 559 bp, Homo sapiens
  misc_feature: GZ8MTXP02FLMZL.51.80.H03.1.454.CMB.2.raw
  modified_base (232)..(232): a, c, t, g, unknown or other
  modified_base (310)..(310): a, c, t, g, unknown or other
  modified_base (338)..(338): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacgttggtgttataactatgtctctggtaccaacagccacccaggacaaacgcccccaaatcatgtatttangagtcagtaacgcgccctgacgggtccngactcgcttctctgctcagtctcggacacgaccgccctcctgacccgtctcgtcgggtccctccggaggtcgtgaggagtggacggtctagtattagttctgctagctacatagtgcgaggcagctagtggtcgtgtacgttacggttcggggacggaacgggacccgtaagtccgtaaccgtacccggtacgtacggtaccacggtacccgacggtcccg

SEQ ID NO: 385772 - DNA, 535 bp, Homo sapiens
  misc_feature: GZ8MTXP02JD83N.51.80.H03.1.454.CMB.2.raw
  modified_base (229)..(229): a, c, t, g, unknown or other
  modified_base (367)..(367): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtggttataactatgtctcctggtaccaacagcacccaggcaaacgcccccaaactcatgatttatgagtcagtaagcggccctcacggggtccctgatcgccttctctgctcaagtctggcaacncgcctcccgtgaccgtctcgtgggcctccgaggctgagatggagctgattattactgctgctcgacatgcaggcagcagtcggtgtcgcttacggttcgggacgggacggaaacccgaagtccgtaacgtacccgtccgtaaggtccacggaccccgaaaggtccccg

SEQ ID NO: 385773 - DNA, 559 bp, Homo sapiens
  misc_feature: GZ8MTXP02HZ1D4.51.80.H03.1.454.CMB.2.raw
  modified_base (300)..(300): a, c, t, g, unknown or other
tcagcgatcgtatacacgaccggtgctcgatttagctgtgcgtcgaaggaaaggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaaccagcagtgacgttggtgttataactatgtctctgtaccaacagcaccagcaaacgccccaaatcatgatttangagtcagtaagcgcctcgagggtccctgactcgccttctctggctccaagtctggcaaacaccgcctccctcgaccgtctcgtggcctccgaggctgagatggaggctagattattactgcttgctcacagtgcaggctagcagttcgggtgtcgtacgtagttccgggacgggtaacggggacccaaaggccgttaacgggaaccccgtttcccggtaaggggttcccaaccggggtacccccaaaggggttcccccg

SEQ ID NO: 385774 - DNA, 515 bp, Homo sapiens
  misc_feature: GZ8MTXP02I2XLF.51.80.H03.1.454.CMB.2.raw
  modified_base (243)..(243): a, c, t, g, unknown or other
  modified_base (300)..(300): a, c, t, g, unknown or other
  modified_base (408)..(408): a, c, t, g, unknown or other
  modified_base (425)..(425): a, c, t, g, unknown or other
  modified_base (431)..(431): a, c, t, g, unknown or other
  modified_base (449)..(449): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggngttataactatgtctctgtacaacagcaccaggcaaagcccccaaatcatgatttangagtcagtaagcggccctgacggggtccctgatcgcttctctggctccaagtctggcaacgaccggcctcccgtgacccgtctcgtggcctcgagctgagatgaggcngatttatactgctgctnaacgtngcagcagcgtagtcggtntgtacgtacgtcgggacggacggaaccagtccgtcgtaccgtacgtacgacgacgacccgagtccg

SEQ ID NO: 385775 - DNA, 527 bp, Homo sapiens
  misc_feature: GZ8MTXP02FR3X7.51.80.H03.1.454.CMB.2.raw
  modified_base (349)..(349): a, c, t, g, unknown or other
  modified_base (462)..(462): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaacgcccccaaatcatgattangagtcagtaacgcgccctgacggggtccctgactcgcttctctgcctcgaagtctggacaaccgacggccctccctacgacccgttctcgtcgggcctccgaggcctgacggntggaggtctgatttatactgctgctacacatcgcaggccagacctgtcggtgtcgactttacggg

SEQ ID NO: 385776 - DNA, 593 bp, Homo sapiens
  misc_feature: GZ8MTXP02GB1QZ.51.80.H03.1.454.CMB.2.raw
  modified_base (306)..(306): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactatgtctcctggtaccaacagcacccaggcaaacgcccccaaatcatgatttangagtcagtaagcgccctgacgggtcctgctcgtcctctcgtcgcctacgtacgttcgtcgaccaacgccgtccctccgtacgaccgttctcggtcggtccctacgacggtcgtacggtagtacgtagggacgtcgtagttaactttacgttactcggtcgtcgtcctaccatacgtcggacgacggacacgtcgtaggtcggtgtcgtacgtacgggttccgggacgggaaccgtacgagtccgaaccggtaccgtaccggtacggaccgaccggacgacggtcccg

SEQ ID NO: 385777 - DNA, 574 bp, Homo sapiens
  misc_feature: GZ8MTXP02JOY5Y.51.80.H03.1.454.CMB.2.raw
  modified_base (343)..(343): a, c, t, g, unknown or other
  modified_base (358)..(358): a, c, t, g, unknown or other
  modified_base (367)..(367): a, c, t, g, unknown or other
  modified_base (481)..(481): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctctggtaccaacagcacccaggcaaacgccccaaactcatgatttatgaggtcagtagcggccctgagggtcctgatcgccttcnctggtctcaagttcnggacaaacnccggcctccctgacccgtctcttcggggcctccgaggctgaggatggaggctagtattatactgctgctcacatgcaggcaggcctagtcggtgtcgtactacgttcccggggngggaaacggggacccgtaaaaggccgttaacgggaaccccggttaccgttaacggggtacccaaccggtacccccgtaaaacgggtcccccgg

SEQ ID NO: 385778 - DNA, 662 bp, Homo sapiens
  misc_feature: GZ8MTXP02HPMZZ.51.80.H03.1.454.CMB.2.raw
  modified_base (229)..(229): a, c, t, g, unknown or other
  modified_base (326)..(326): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactggaaaccngcagtgtacgtttggtagttaataactatgtctccgtacggtaaccaacacgaccaacccgaggaaccaaaccgacccccaaactcatagtatttanaggagtacaagtaacgccggtcctacggacgggtcctgactcgtccttctcgtacgtctaccgtaagtctcggaccaaaccgaccgtccccttcccgtacgtaccgttcgtcgtcggcctaccgaggtcgtaggaggtacgtgtacggtacgtagtaagtttaatttaacgttacgtcgttacgtacctacctaacgtacgtacgtacgacggacgacgacgtacgtcggttcggttcggttacgttacggttacgggtacgggaacgggaaccgtaacgtacgtaaccggtaccgttaccgtacggtaccgtaccgtaacccgtaaccggtaccg

SEQ ID NO: 385779 - DNA, 527 bp, Homo sapiens
  misc_feature: GZ8MTXP02JYFM1.51.80.H03.1.454.CMB.2.raw
  modified_base (272)..(272): a, c, t, g, unknown or other
  modified_base (308)..(308): a, c, t, g, unknown or other
  modified_base (324)..(324): a, c, t, g, unknown or other
  modified_base (345)..(345): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtggttaataactatgtctcctggtaccaanagcacccaggacaaacgccccaaactcatgatttangagtcagtaagcgccngagggtcctgactcgccttcnctggctccgaagtctggcaaacgaccggccctccctcgtaccctctccgtgggcctcccgaggctgaggatggaggctagtattaagttctgcttgcttcacatgcaggcagctagtcggtgtgctagtccgggcggacgggaccaagcctgaccgttccgaagtcgacgaccgaagtcccg

SEQ ID NO: 385780 - DNA, 522 bp, Homo sapiens
  misc_feature: GZ8MTXP02G8Z3W.51.80.H03.1.454.CMB.2.raw
  modified_base (256)..(256): a, c, t, g, unknown or other
  modified_base (348)..(348): a, c, t, g, unknown or other
  modified_base (425)..(425): a, c, t, g, unknown or other
  modified_base (454)..(454): a, c, t, g, unknown or other
  modified_base (478)..(478): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtccaccntctcctgcactggaaccagcagtgacgttggtgtataactatgtctcctggtaccaacagcaccaggcaaacgcccccaaatcatgatttangagtacagtaacgcggccctcgacggggtccctgactcgcttctcgtcgcctcaagtctgacaacgccgcccttccncgaccgtctcgtgggccctcgaggctagngatggagctgtattatactgctcnctcactcgtcgcgagcgacgtactacgtcgtcgtcgtacgtagg

SEQ ID NO: 385781 - DNA, 526 bp, Homo sapiens
  misc_feature: GZ8MTXP02IF02S.51.80.H03.1.454.CMB.2.raw
  modified_base (307)..(307): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttaatactatgtctcctggtaccaacagcacccaggacaaacgcccccaaactcatgatttangagtcagtaagccggccctcgacggggtccctgactcgccttctcgtcggctccaagtctggccaacgacggccctccctgaccgtctcgtggcctccgaggctgagatgaggtctgattatactgctgctcacatgcaggcagctagtcggtgtgcttagttccgggcggacgggaccaaggcgtgacccgttcgtacggtcacgccgaacggtcccg

SEQ ID NO: 385782 - DNA, 570 bp, Homo sapiens
  misc_feature: GZ8MTXP02I60XV.51.80.H03.1.454.CMB.2.raw
  modified_base (319)..(319): a, c, t, g, unknown or other
  modified_base (360)..(360): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatcctcctgcactggaaccagcagtgacgttggtaggttataactatgtctcctaggtaccaacngaccacccaggaccaaacgaccccccaaactcatgatttanagagtcagtagcgcactcgacggggtccctgactcgtcttctcgtgctaccagtctacgccaacgccgtccctcctgacccgtctcgtcgggtcctcccgaggcctaggacggtagtcggaggtccttaggaattttacgtacgtgtccttacggctacgtaacgcgtacgacgaacgtacgacgtacgtaggttcggtcgttacgtacg

SEQ ID NO: 385783 - DNA, 556 bp, Homo sapiens
  misc_feature: GZ8MTXP02GAZOM.51.80.H03.1.454.CMB.2.raw
  modified_base (308)..(308): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatcctcctgcactggaaccagcagtgacgttggtagttataactatgtctcctgtaccaacagcaccaggcaaacgcccccaaatcatgtatttagngagtacagtaacgccgccctcgacggggtccctgactcgccttctcgtgcctcgaagtctgacaacgccggccctccctcgaccgtctcgtcggtcctcgagcgtgaggacgtgaggtctagtatttagtactgctgctcacagtcgcgagcgagtctagtcgtagtgcgttacgttcgggacggtacgggaccgaaggtccgtaacggtaccgtaccgtacggtaccgacgacccgtaacggtcccg

SEQ ID NO: 385784 - DNA, 626 bp, Homo sapiens
  misc_feature: GZ8MTXP02F92I2.51.80.H03.1.454.CMB.2.raw
  modified_base (231)..(231): a, c, t, g, unknown or other
  modified_base (276)..(276): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaaccngcagtgtacgttggtgttaataactatgtctcctagtaccaacancaccagacaaacaccccaaatcatgtattatgagtacagtaacgccgccctcgacggtcctgactcgtccttctcgtacggtcctacgaacgttcgtcggaccaaacgtaccggtccctacccgtacgtacccgtctccgtcggtacctccgacggtcgtaggaaggtacgtaggacggtacttagtaatttaaacttaccgtgtactcgtacctacaacgtacgtcgacgacgtacgacgtacgtacgtacggtacggtcgtacgtacggttacgggtacgggaacgggtaacgaacggtacgtaaccgtacccgtaccgtacggtaccgtaccgaccgaacggtaccg

SEQ ID NO: 385785 - DNA, 607 bp, Homo sapiens
  misc_feature: GZ8MTXP02HA906.51.80.H03.1.454.CMB.2.raw
  modified_base (231)..(231): a, c, t, g, unknown or other
  modified_base (445)..(445): a, c, t, g, unknown or other
  modified_base (485)..(485): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagccctccctcgcgtccggtctcctggacagtcagtcaccatcctcctgcactggaaccngcagtgacgttggtgttatactatgtctcctgaccaacagccacccaggacaaacgacccccaaatcatagtatttatgaggtcaaggtaagccggccctcgacggggtccctgactcgcccttctcgtcgcctaccgaagttccgtggacctaaaccgacccggtccctccctcggtacccgttcctcgtcgggcctcccgaggtctaggagngtagacggtctagtattattacctgtctgctacaactcgngcgtagggccagtaccgtagtcggtagtggtacgtttacggtaccgggacgggtaacgggaaccgaagtccgtaacgtcccgtaaccggttacggaccgaccggtacccggaacggtccccg

SEQ ID NO: 385786 - DNA, 617 bp, Homo sapiens
  misc_feature: GZ8MTXP02JSXQZ.51.80.H03.1.454.CMB.2.raw
  modified_base (271)..(271): a, c, t, g, unknown or other
  modified_base (344)..(344): a, c, t, g, unknown or other
  modified_base (367)..(367): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactatgtctcctggtaccaangcacccaggcaaagcccccaaatcatgatttatgaggtcagtaagcgcctcgaggggtccctgatcgccttcnctggctcgaagttctggcaaacncggaccctcctagacccgtctcgtcgggcctcccgaggcctgacggatgacggctgattacttacgcgcttcggacttccaactatcggacgacgggcacggaccgaacgttccgggttagtcggtaccttaaggtttcccggggacgggggtaaacggggaaccccgaagggtaacccgttcgggtaaaacccccggtttccgtaaccgggggttacctaccgggaacccccgaaagggggttcccccg

SEQ ID NO: 385787 - DNA, 591 bp, Homo sapiens
  misc_feature: GZ8MTXP02HVNO1.51.80.H03.1.454.CMB.2.raw
  modified_base (305)..(305): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactatgtctcctggtaccaacagcacccaggcaaacgcccccaaatcatgatttangagtcagtaagcgcctcgagggtcctgatcgccttctctggctcagtctggcaacacgcctcctcgacctcctctgggcctcgaggctgaggatgagctgattattactgcttgcttacactagtcgacgaacggcaacggccgaaggttccggtggttcgtacggttaacgttccgggggaaccgggtaacggggtaacccgaaaggtcccgttaaccgggtaacccccggttacccggttacgggtacccgaacccggtaccccggaaaaccgggttcccccgg

SEQ ID NO: 385788 - DNA, 563 bp, Homo sapiens
  misc_feature: GZ8MTXP02IINTK.51.80.H03.1.454.CMB.2.raw
  modified_base (230)..(230): a, c, t, g, unknown or other
  modified_base (308)..(308): a, c, t, g, unknown or other
  modified_base (421)..(421): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtggttatactatgtctcctggtaccaacagcacccaggacaaacgccccccaaatcatgatttangaggtcaagtaacgccgccctcgacggggtccctgatcgccttctctggcctccaagtctggccaacgaccggtccctcccgtgaccgtctcgtgggcctccgaggctgaggntggagctgattatacgtgctgcctcacagtgcaggcagctagtcggtgtcgacttaggttccgggacgggtaacgggaaccctaaggtccgtaacggtaacccgtccgttacgggtaccaaccggacccgaagggtcccccg

SEQ ID NO: 385789 - DNA, 542 bp, Homo sapiens
  misc_feature: GZ8MTXP02IIH14.51.80.H03.1.454.CMB.2.raw
  modified_base (298)..(298): a, c, t, g, unknown or other
  modified_base (308)..(308): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctcctggtaccaacagcacccaggacaaacgcccccaaacncatgtattangaggtcagtaagcgcctcgacgggtcctgatcgtccttctctgctcagtctgacaacaccggcctaccctgacctctcgtggcctccgaggctaggacgatgaggcttagtaactttagttactgtctcgtctacacatgacgaggcagactagtcggtgcgtcgttacggtcgggcggacggaccaacgtctaacggtcccgtacgtacggtaccacggacccgacggccccg

SEQ ID NO: 385790 - DNA, 527 bp, Homo sapiens
  misc_feature: GZ8MTXP02G98FH.51.80.H03.1.454.CMB.2.raw
  modified_base (229)..(229): a, c, t, g, unknown or other
  modified_base (248)..(248): a, c, t, g, unknown or other
  modified_base (301)..(301): a, c, t, g, unknown or other
  modified_base (496)..(496): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtgttanaactatgtctctggaccaacagcacccagcaaacgccccaaatcatgatttangagtcagtaagccgcctgcgggtcctgatcgccttctctcggctcaagtctggacaacgaccgtccctcccgtgacccgtctcgtgggcctcgaggcctgacggatggaggctaggtatttagttacgtgcttgccttacaactctgccgaggcagtcagtcggtagtgctacgtcggacggagggaccaagtcncgaccgtcgtacggcacgtacccgagtcccg

SEQ ID NO: 385791 - DNA, 581 bp, Homo sapiens
  misc_feature: GZ8MTXP02FXXZC.51.80.H03.1.454.CMB.2.raw
  modified_base (229)..(229): a, c, t, g, unknown or other
  modified_base (271)..(271): a, c, t, g, unknown or other
  modified_base (306)..(306): a, c, t, g, unknown or other
  modified_base (448)..(448): a, c, t, g, unknown or other
  modified_base (454)..(454): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtgttataactatgtctcctggtaccaacngcacccaggacaaacgcccccaaatcatgatttangagtcagtaagcggccctgacgggtccctgactcgccttctctggctcaagtctggacaaacgacggtccctccctgacccgttctccgttcggggccctccgaggctagaggatggaggctagatttattactgctgcctnactagngacgaggcagtcgtacggttcggtgtcgtacgttacggttaccggggacgggtaacgggaacctaacggtccgtaaccggtacccggttaccgtacgggtacccgaacggaccccgtaacggtcccg

SEQ ID NO: 385792 - DNA, 545 bp, Homo sapiens
  misc_feature: GZ8MTXP02H7GG4.51.80.H03.1.454.CMB.2.raw
  modified_base (307)..(307): a, c, t, g, unknown or other
  modified_base (384)..(384): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcacccctcctcactcagggcacagggtcctgggcccagtctgccctgactcagcctccctccgcgtccggtctcctggacagtcagtcactatctcctgcactggaaccagcagtgacgttggtgttataactatgtctctgtaccaacagccaccaggacaaacgcccccaaactcatgtatttangaggtcagtaagcgcctgacggggtccctgatcgcctctcgtcgctacaagtctggaccaaacaccggtccctcccncggaccttctcgtgggctcccgaggcctgaggatggacgctgtaattacgttactgcttgctcacagtcgcaggcagcctaggtcgtgtgtctagttccggggacggacgggacaacgcgtaacgcccgtacgtacggaccaccggaccgtaacggccccg

SEQ ID NO: 385793 - DNA, 671 bp, Homo sapiens
  misc_feature: GZ8MTXP02JW5GL.51.80.H03.1.454.CMB.2.raw
  modified_base (232)..(232): a, c, t, g, unknown or other
  modified_base (309)..(309): a, c, t, g, unknown or other
  modified_base (349)..(349): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcacccttcctcactcaggcacagggtcctgggcccagtctgccctgactcagcctccctccgcgtccgggtctccctggacagtcagtcaccatctcctgcactggaaccngcagtgacgttggtgttataactatgtctctggtaccaacagccacccaggacaaacgcccccaaatcatgatttangagtcagtagcggccctgagggtccctgactcgcctctcngctcagtctggaccacacggcctcctcgccgttctctcgggcctccgaggctaggacggtacgtgaacgggtcttaggtaatttattaccgtggtcttcggcccttacgaacctagttacggaccgtaggaccgtaagacccgtaagttacccgggggttaatcgggttacccgtttaaacgggtttccccgggggacggggtaaaaccgggggtaacccaaacggtccccgggtttaacggaaacccccggggttttacccggttaacgggggtttaccccaaacccgggtacccccgaaaaccgggggtttaccccccgg

SEQ ID NO: 385794 - DNA, 570 bp, Homo sapiens
  misc_feature: GZ8MTXP02JUP0T.51.80.H03.1.454.CMB.2.raw
  modified_base (452)..(452): a, c, t, g, unknown or other
  modified_base (458)..(458): a, c, t, g, unknown or other
  modified_base (468)..(468): a, c, t, g, unknown or other
  modified_base (482)..(482): a, c, t, g, unknown or other
  modified_base (485)..(485): a, c, t, g, unknown or other
  modified_base (490)..(490): a, c, t, g, unknown or other
  modified_base (492)..(492): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttaataactatgtctcctaggtaccaaacagccacccaggcaaacgcccccaaactcatgtaattttagagtaggtacaaggtaaacgcccgggtacccgtcgggtaaccgggtctcgtacttccgtcccttccgtgtcgtcctactacgtcgtacgaccaacggtcccgtccctccgtcgtacctcgcgtcgtctcgcgtgtagagngagcgngtagtatatntgtcgtctcacacncgngacgngngagtgtgtgtcgtcgtcgtcggtacggacggacgacgacgtacgtaacgtacgtacgtacgacgaccgacgacgtccg

SEQ ID NO: 385795 - DNA, 570 bp, Homo sapiens
  misc_feature: GZ8MTXP02FUVNA.51.80.H03.1.454.CMB.2.raw
  modified_base (358)..(358): a, c, t, g, unknown or other
  modified_base (489)..(489): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacgagggtcctgggcccagtctgccctgactcagccctccctccgcgtccggtctcctggacagtcagtcaccatctctgcactggaaccagcagtgacgttggtggttataactatgtctcctggtaccaacagccacccaggaccaaacgccccccaaaactcaactgatttangaggtcaagtaacgcggtccctcgacggggtccctgactcgtcttctctggcctcaagtctggccaaccgcggtcccctaccgtcgacccgttcgtcgtcgggcctaccgcggctggacgtatggacggtntagtatttactacgtcgtcgtacgtctacacgacgtcgacgacggccgtacgtacgtacggttcggtcgtcgtacgtacgg

SEQ ID NO: 385796 - DNA, 639 bp, Homo sapiens
  misc_feature: GZ8MTXP02J2CWQ.51.80.H03.1.454.CMB.2.raw
  modified_base (276)..(276): a, c, t, g, unknown or other
tcagcgatcgtatacacgaccggtgctcgatttagctgtgcgtcgaagggaaagggcacgaccggtgctcgatttagctgtgcgtcgaaagggaaagggggctggggtctcaggaggcagcgctctcaggactcaccaccatggcctgggctctgctcctcctcaccctcctcactcagggcacgagggtcctgggcccagtctgccctgacctcacgccctccctccgcggtccggtctctggacagtcagtcaccatctctgcacgtggaaccngcagtcgtacggttggtagttaataactatgtccttccgtaggtaaccaactacgccaacccgagaccaaaccgacccccaaatcactagtacttagtagacgtactagtaacgccggtccctcggaccggggttccctgtactccgtcttctcgtaccgctaccgtacgtcgtcgacaccgacccggtccctacccgtacgtaccccgttcgtccggtcggtcccgtccgtaacgggtccgttaagggacgtagttacgggacggttactaggttaactttacgtacgtcgtaccgtgacctacaacgcgtcggacgacgtaacgaacgtacgtcgtttacggtcgtacgttacgttcgggg

SEQ ID NO: 385797 - DNA, 560 bp, Homo sapiens
  misc_feature: GZ8MTXP02HCZ8A.51.80.H03.1.454.CMB.2.raw
  modified_base (229)..(229): a, c, t, g, unknown or other
  modified_base (268)..(268): a, c, t, g, unknown or other
  modified_base (294)..(294): a, c, t, g, unknown or other
  modified_base (300)..(300): a, c, t, g, unknown or other
  modified_base (464)..(464): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtgttataactatgtctctgtaccaangcaccagacaaacgccccaaatcatnatttangagtcagtaagccgcctgacgggtcctgactcgtccttctcgtcggctacgaagttcgtggacctaaacgcccggtccctcccgtgacccgtctcgtcgggtacctcgaggtcgtaggaggtacgtggaacgtcgtagtattagttacctgcgtgactcaactntcgacagcagactgtcggtgtgtacgttacggtcggacgggacgaaccgaggtcgtaacgacccgtacgtacggacgacccgaccgaacgtccccg

SEQ ID NO: 385798 - DNA, 533 bp, Homo sapiens
  misc_feature: GZ8MTXP02GOOWS.51.80.H03.1.454.CMB.2.raw
  modified_base (211)..(211): a, c, t, g, unknown or other
  modified_base (229)..(229): a, c, t, g, unknown or other
  modified_base (271)..(271): a, c, t, g, unknown or other
  modified_base (309)..(309): a, c, t, g, unknown or other
  modified_base (350)..(350): a, c, t, g, unknown or other
  modified_base (352)..(352): a, c, t, g, unknown or other
  modified_base (375)..(375): a, c, t, g, unknown or other
  modified_base (384)..(384): a, c, t, g, unknown or other
  modified_base (400)..(400): a, c, t, g, unknown or other
  modified_base (409)..(409): a, c, t, g, unknown or other
  modified_base (421)..(421): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctcgcgtccggtctccgtggacagtcagtcaccntctcctgcactggaaccngcagtgtacgttggtgttaatactatgtctcgtaggaccaancgcaccaggaccaaacgtccccaaatgatgtatttagngagtcagtacgccgtacctgacgggtcctgactcgccttcncngctcagtctggacacgcgcctcngactctcgnggtctcgagctagagngtgacggtntagtattagtcngtctcgactacacgtgtcgacgacgacgacgtacgtacgtcgtcgtacgtacgtacggtacggtacggacgacgacgacgtaacgtacgtacgtacgacgacgacgacgtcg

SEQ ID NO: 385799 - DNA, 547 bp, Homo sapiens
  misc_feature: GZ8MTXP02ISUIE.51.80.H03.1.454.CMB.2.raw
  modified_base (230)..(230): a, c, t, g, unknown or other
  modified_base (271)..(271): a, c, t, g, unknown or other
  modified_base (304)..(304): a, c, t, g, unknown or other
  modified_base (360)..(360): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtggttataactatgtctctgtaccaacngcaccagacaaacgcccccaaatcatgatttangagtcagtaagccggccctcgacggggtccctgactcgccttctctgttccagtcngcacgcggtcctcctgaccgtctcgtcggctccgagctgagatggagctagtattatactgctcgctacacagtcgcgacggcagcgtagtcggtgtacgtcgtagtccggggacggacgggaaccaacggccgtacggtaaccgtaccggttacggaccaccggacccgaacggtccgtaccccgg

SEQ ID NO: 385800 - DNA, 578 bp, Homo sapiens
  misc_feature: GZ8MTXP02JPDU9.51.80.H03.1.454.CMB.2.raw
  modified_base (253)..(253): a, c, t, g, unknown or other
  modified_base (266)..(266): a, c, t, g, unknown or other
  modified_base (300)..(300): a, c, t, g, unknown or other
  modified_base (431)..(431): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactntgtctctgtacangcaccagacaaacgccccaaatcatgtatttagngtagtcagtaacgccgtccctgacgggtcctgactcgtccttctcgtcgctacagtcgtcggaccaacgccggtccctccgtacgtccgtctcgtcgggtcctaccgaggtctaggagtacgtggaacgtntagtactttacgtcgtcgtctcgactacacgtgtcggacgacgacacgtacgtacgtcggtgtacgtacgttacgggcggggaacggtacggacctacggtccgtaacggtaccgtacggtacgaccgaccggtaccgtacgtcccg

SEQ ID NO: 385801 - DNA, 554 bp, Homo sapiens
  misc_feature: GZ8MTXP02JIQI2.51.80.H03.1.454.CMB.2.raw
  modified_base (230)..(230): a, c, t, g, unknown or other
  modified_base (271)..(271): a, c, t, g, unknown or other
  modified_base (304)..(304): a, c, t, g, unknown or other
  modified_base (331)..(331): a, c, t, g, unknown or other
  modified_base (452)..(452): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtgttataactatgtctctggtaccaacngcacccaggcaaacgccccaaatcatgatttangagtcagtaagccgcctgacgggtccngactcgccttctctgctccgaagtctggaccaacgaccggccctcccgtgacccgtctcgtcgggcctccgaggctggagctggacggtctagtatttacttacgtgtctgacctacaacngtcgacgacggcacgtacgtagttcggtcgtcgtacgttacggtcgggacggacgaccgacgcgtaacgtaccgtacgtacggaccgacgtaccgacgtccg

SEQ ID NO: 385802 - DNA, 505 bp, Homo sapiens
  misc_feature: GZ8MTXP02FW2AE.51.80.H03.1.454.CMB.2.raw
  modified_base (257)..(257): a, c, t, g, unknown or other
  modified_base (349)..(349): a, c, t, g, unknown or other
  modified_base (365)..(365): a, c, t, g, unknown or other
  modified_base (374)..(374): a, c, t, g, unknown or other
  modified_base (384)..(384): a, c, t, g, unknown or other
  modified_base (447)..(447): a, c, t, g, unknown or other
  modified_base (460)..(460): a, c, t, g, unknown or other
  modified_base (470)..(470): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatcnctgcactggaaccagcagtgacgttggtgttataactatgtctcctggtaccaacagcacccaggcaaacgcccccaaactcatgactttangagtcagtagcgcctnaggggtccngatcgcttcnctgctcaagtctggcaacgacggccctccgtacgaccgtctcgtggcctccaggctgagatgngctgacttatacncgtctgctanactagtcgcaggcacgcagtcggtcgtgcttacgg

SEQ ID NO: 385803 - DNA, 632 bp, Homo sapiens
  misc_feature: GZ8MTXP02JT4FJ.51.80.H03.1.454.CMB.2.raw
  modified_base (304)..(304): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactatgtctcctggtaccaacagcacccaggcaaacgccccaaatcatgatttangagtcagtaagcgcctgagggtccctgatcgccttctctcggctcaagttctggccaaacgccggtccctcccgtgaccctctcgtcgggcctcccgaggtcctgaggtatggaacgggtctagtaatttaacgttacctggtcttcgcctttacccgaactaagttcggccgtaaagggccaagccgtaagtccgggttaggtacgtccgttaaacggttccggggaaccggggtaacggggtaaccccaaagggtccgtaaccggtaccccggtttacccggtaaagggttccccgaaaaccggtccccggtaaaagggtcccccg

SEQ ID NO: 385804 - DNA, 543 bp, Homo sapiens
  misc_feature: GZ8MTXP02ICUPC.51.80.H03.1.454.CMB.2.raw
  modified_base (243)..(243): a, c, t, g, unknown or other
  modified_base (315)..(315): a, c, t, g, unknown or other
  modified_base (355)..(355): a, c, t, g, unknown or other
  modified_base (386)..(386): a, c, t, g, unknown or other
  modified_base (397)..(397): a, c, t, g, unknown or other
  modified_base (409)..(409): a, c, t, g, unknown or other
  modified_base (464)..(464): a, c, t, g, unknown or other
tcagcgatcgtatacacgaccggtgctcgatttagctgtgcgtcgaagggaaagggcacgaccggtgctctatttagctgtgcgtcgaagggaaagggggctggggtctcaggaggcagcgctctcaggacgtcaccaccatggcctgggctctgctcctcctcaccctcctcactcaggcacagggtcctgggcccagtctgccctgactcagcctccctccgcgttccggtctcctggacngtcagtcaccatcctcctgcactggaaccagcagtgacgttggtgttataactatgtctcctggtaccaacngaccacccaggaccaaacgccccccaaaatcatgtattangaggtcagtaacgcgccctcgacgggtcccngactcgcttcnctgcctcgatcngcaacgcgcctcctcgtaccgtctcgtcgggacctccgaggctaggacgatcggnggtcttaggatttagtacctgtccttgccttacactagtccgagaacgcaacgtcgattccgggtcttcgtacgtacgg

SEQ ID NO: 385805 - DNA, 518 bp, Homo sapiens
  misc_feature: GZ8MTXP02JBMTL.51.80.H03.1.454.CMB.2.raw
  modified_base (350)..(350): a, c, t, g, unknown or other
  modified_base (457)..(457): a, c, t, g, unknown or other
  modified_base (472)..(473): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacagggtcctggcccagtcctgccctgactcagcctccctccgcgtccggtctcctggacagtcagtcaccatctcctgcactggaaccagcagtgacgttggtgtataactatgtctccgtggtaccaacagcacccaggacaaagccccccaaaatcatgatttangagtcagtaagcggcctcaggggtccctgatcgcttctctgctccaagtcctgcaacacggccctccctgacccgtctcgtgggcctccgaggctagacgatgaggntgtatatagtcgtcnncacacactacgcgacgcgacgacgtacgtcgtcgtcgtacgtacg

SEQ ID NO: 385806 - DNA, 636 bp, Homo sapiens
  misc_feature: GZ8MTXP02IQW3I.51.80.H03.1.454.CMB.2.raw
  modified_base (230)..(230): a, c, t, g, unknown or other
  modified_base (312)..(312): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtggttataactatgtctcctggtaccaacagcaccccgaggaccaaacgcccccaaatcatgtatttangaggtcaagtacgccggcctacgcggggtccctgactcgccttcgtcgtcggtcctacctaacgtcgtcggaccaacgacccggtccctcccgtcgacccgttcctcgtcgggtcctccgaggctaggagacgttaggacggtctagtatttaacttcgtgccgtgtcctccgtaaactcgtacgacggacggaccgaagtaccgtacggttccgggttggtcgtaccgttaacggttccggggacgggtaaccgggaaccaacggtccgtaaccggaaccccgttccggtaacggacccgaaccggtacccgaacggtccccg

SEQ ID NO: 385807 - DNA, 570 bp, Homo sapiens
  misc_feature: GZ8MTXP02HGXUQ.51.80.H03.1.454.CMB.2.raw
  modified_base (230)..(230): a, c, t, g, unknown or other
  modified_base (308)..(308): a, c, t, g, unknown or other
  modified_base (332)..(332): a, c, t, g, unknown or other
  modified_base (355)..(355): a, c, t, g, unknown or other
  modified_base (454)..(454): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtgttataactatgtctcctgtaccaacagcacccaggacaaacgcccccaaactcatgtatttangagtcagtaagcgcctgcggtccngactcgcctctcgtgctcagtcnggcaacgaccggccctccctgaccgttctcgtcgggctccgaggcctggagagtggaggtctagtaatttacgttactgcgtttgcccttacaaccgtntcggccagggaccagtacgtgttccggtgtcggtcttacggcgggtacgggacgggaaccaaggtccttaacggaacccgttcgtacgggtaccacggacccgtaacgggtccccg

SEQ ID NO: 385808 - DNA, 561 bp, Homo sapiens
  misc_feature: GZ8MTXP02HEPPB.51.80.H03.1.454.CMB.2.raw
  modified_base (352)..(352): a, c, t, g, unknown or other
  modified_base (373)..(373): a, c, t, g, unknown or other
  modified_base (415)..(415): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctctcactcagggcacagggtcctgggcccagtctgccctgactcagcctcctccgcgtccggtctcctggacagtcagtcaccatctcctgcactgaaccagcagtgacgttggtgtataactatgtctcctaggtaccaacacgcacccaggaccaaacgcccccaaaatcaatgaactttangagtcaagtaacgccgtcccncgacggggtccctgatcgcttcgtctggccctacaacgttcncgggacaaccgaccggccctcccgtcgacccgtctccgtcgggcttacccgaggtcgtacgaggatggaagtcgtagatttaatacgttcgcgtcgactacacgtagcgcgaaggccagaccgtagtccggtgtcgtactttcggg

SEQ ID NO: 385809 - DNA, 621 bp, Homo sapiens
  misc_feature: GZ8MTXP02I9VJ0.51.80.H03.1.454.CMB.2.raw
  modified_base (269)..(269): a, c, t, g, unknown or other
  modified_base (306)..(306): a, c, t, g, unknown or other
  modified_base (422)..(422): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactggaaccagcagtgacgttggtgttatacgtatgtctctggtaccaacngcacccaggaccaaacgccccaaactcatgtatttangagtcagtaacgccggcctcgacggggtccctggactccgtcttccgtcgtacggtcctaccgtaacgtcgtcgggacccaaacggtcccggtcccttccccgtcggtaccccgtnttccgtcggggtcccttcgaggtcgtaggaaggtgtaggtacgtcttagtactttacgtctcgtactcgtctacactagcggacgacggcacggtcgtagtcgggttcgtacgtacggttacgggtaccggggacgggaacggtaccgtaggcgtaacggtaccggttacgtacggacgaccggtacccgacggtcccg

SEQ ID NO: 385810 - DNA, 583 bp, Homo sapiens
  misc_feature: GZ8MTXP02IRZ3Q.51.80.H03.1.454.CMB.2.raw
  modified_base (255)..(255): a, c, t, g, unknown or other
  modified_base (270)..(270): a, c, t, g, unknown or other
  modified_base (302)..(302): a, c, t, g, unknown or other
  modified_base (492)..(492): a, c, t, g, unknown or other
tcagcgatcgtatacacgaccggtgctcgatttagctgtgcgtcgaagggaaagggggctggggtctcagggggcagcgctctcaggacgtcaccaccatggcctgggctctgctcctcctcaccctcctcactcagggcacagggtcctgggcccagtctgccctgactcaacctccctccgcgtccggtctcctggacagtcagtcaccatctcctgcactggaaccagcagtgacgttggtgttaataactntgtctctgtaccaanagcaccagacaaacgccccaaatcatgattangagtcgagtaacgcgccctacgacgggtccctgactcgtcttctccgtcggcctaccgaagtctacggacaccgaccggcccttcccgcgtaccccgtcgtccgttcgggcctccgacggtcgtaggacgtagtggacggtctagtaattacttacgtgtactcgacttaccaatcgacgccgaggaccngcgtagtcggtgtcgtcgtaggtcgggacggaacggacgacgtcgtacgtaccggtcgtacggaccgacgaccgacgtcccgtccgtcccg

SEQ ID NO: 385811 - DNA, 572 bp, Homo sapiens
  misc_feature: GZ8MTXP02GLGZ7.51.80.H03.1.454.CMB.2.raw
  modified_base (231)..(231): a, c, t, g, unknown or other
  modified_base (270)..(270): a, c, t, g, unknown or other
  modified_base (277)..(277): a, c, t, g, unknown or other
  modified_base (305)..(305): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacgttggtgttataactatgtctctgtaccaangcacccnggacaaacgccccaaatcatgtatttangaggtcagtaagccggcctcgacggggtccctgactcgtccttctcgtggcctccaagttctggacaaaccgccggccctcccgtgaccctctcgtcggcctccgagggctaggagagtggacggtcttaggaattttattacgtgtcgtgtcctacacgtgtcggacagggccagacctagttcgggtgtcgacttaggtccgggacggacggaaccaggtccgtaacggtcccgtacggtaccgtcgacgacccgtaggtccccg

SEQ ID NO: 385812 - DNA, 562 bp, Homo sapiens
  misc_feature: GZ8MTXP02HFT64.51.80.H03.1.454.CMB.2.raw
  modified_base (254)..(254): a, c, t, g, unknown or other
  modified_base (314)..(314): a, c, t, g, unknown or other
  modified_base (350)..(350): a, c, t, g, unknown or other
  modified_base (380)..(380): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccntcctctgcactgaccagcagtgacgttggtggttataactatcgtctcctggtaaccaanagccaccaggacaaacgcccccaaatcatgatttangagtacagtaacgcgccctgacgggtcccngtactcgcttctctggcctaccgaagtctagaccaacgccggcccttcctacgaccgttcgtccgttacggccttccgaggtcgtacgaggtgtacggagtctagtatttactcgtacgtctcgtctacgacgtacgtcgacgacgaacgacgtacgtacgtacggtcgtacgtacgtacgg

SEQ ID NO: 385813 - DNA, 608 bp, Homo sapiens
  misc_feature: GZ8MTXP02HEJ3K.51.80.H03.1.454.CMB.2.raw
  modified_base (274)..(274): a, c, t, g, unknown or other
  modified_base (309)..(309): a, c, t, g, unknown or other
  modified_base (350)..(350): a, c, t, g, unknown or other
  modified_base (377)..(377): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacgagggtcctgggcccagtctgccctgactcagcctccctccgcggtccggtctcctggacagtcagtcaccatctcctgcactggaaccagcagtgacggtttggtgttataactatgtctctggtaccaacngccaccaggacaaacgccccaaatcatgtatttangagtcagtaagccgtcctgacgggtcctgactcgtccttcncgtgtctacgaagtctcggaccaaacncccggtcccttcccgtgtaccccgttcgtccgtcgggaccctccgaggtccgtaggacggtatcggtggcttagtaactttagttcgtgtcttgcttacaacgtcgtcgacgacggcacgtacgtacgttcggtgtcgttacggttacggtccggggacggaccggaccgaacggtccgtaaccggtacccgtacggtaccggtaccgaccggtacccggtacggtccccg

SEQ ID NO: 385814 - DNA, 589 bp, Homo sapiens
  misc_feature: GZ8MTXP02IQEDQ.51.80.H03.1.454.CMB.2.raw
  modified_base (306)..(306): a, c, t, g, unknown or other
  modified_base (334)..(334): a, c, t, g, unknown or other
  modified_base (451)..(451): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactatgtctcctggtaccaacagcacccaggacaaacgcccccaaatcatgtattangagtcagtaagcggcctgacgggtcccngatcgccttctctgctcaagtctggacaaacgaccggcctcccgtgaccttctcgtcgggcctccgaggctagacgatcggaggtctagtatttaatcgtgcttgccttagactagngaccgtaggcagacctagttccgggtagttcggaccttaggttcccggggaacgggtacgggaacccttaaggcccgtaacggtaacccccgttaccgttaggtacccgaaccggtaaccccggtaacggtcccccgg

SEQ ID NO: 385815 - DNA, 628 bp, Homo sapiens
  misc_feature: GZ8MTXP02IEP0J.51.80.H03.1.454.CMB.2.raw
  modified_base (230)..(230): a, c, t, g, unknown or other
  modified_base (254)..(254): a, c, t, g, unknown or other
  modified_base (271)..(271): a, c, t, g, unknown or other
  modified_base (305)..(305): a, c, t, g, unknown or other
  modified_base (331)..(331): a, c, t, g, unknown or other
  modified_base (374)..(374): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcatcctccctccgcgtccggtctcctggacagtcagtcaccatctcctgcactggaaccngcagtgacgttggtgttataactntgtctcctgtaccaacngcacccaggacaaacgccccaaatcatgatttangagtcagtacgcgcctgacgggtccngactcgtccttctcgtcggcctacgaagttctcggaccaaacncccggtcccttcccgtggaaccccgttctccgttcgggcccttcccggaaggtccttaggacggtacgtgggaacggtcgttaggttaactttaagttaccgtgtcgttcgtccttacgaacctagtcgacgacggacacgtccgagttccggtagtcgtaccgtacgttaccggggacggtaacgggacccaaaggtccgtaaccgtaacccggttaccgtacggaccgacccgtacccggaacggtcccccg

SEQ ID NO: 385816 - DNA, 577 bp, Homo sapiens
  misc_feature: GZ8MTXP02IJUFD.51.80.H03.1.454.CMB.2.raw
  modified_base (306)..(306): a, c, t, g, unknown or other
  modified_base (458)..(458): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactatgtctcctgtaccaacagcaccaggaccaaacgcccccaaatcatgtatttangagtcagtagcggcctcgacggggtccctgactcgtccttcgtctggcctaccgaagttctcggaccaaacgacccggcccttacccgtgacccgttcgtcgtcgggcctccgagcgtagaggatggagctagattattacgtgcttgctanacagtcgacaggcagctagtcggtgtacgtacgttacgttccggggacggtaacggaaccctaaggtccgtaacggtacccgtaccgtaacggtaccaccggacccgtaacgggtcccg

SEQ ID NO: 385817 - DNA, 539 bp, Homo sapiens
  misc_feature: GZ8MTXP02HCPVA.51.80.H03.1.454.CMB.2.raw
  modified_base (229)..(229): a, c, t, g, unknown or other
  modified_base (270)..(270): a, c, t, g, unknown or other
  modified_base (304)..(304): a, c, t, g, unknown or other
  modified_base (330)..(330): a, c, t, g, unknown or other
  modified_base (341)..(341): a, c, t, g, unknown or other
  modified_base (431)..(431): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtgttataactatgtctctggtaccaacngccaccaggacaaacgccccaaatcatgatttangagtcaagtagcgcctgacgggtccngatcgccttcnctgctcagtctgacacacgcctcctgaccgtctcgtcggcctcgacggctagaggatgacggctgtaactttattacgtgcttgctacanactgacaggcagctagtcggtgtgtcgtaagttcggggacggacgggaaccaagccgtaacggtacccgtacgttaacgggccaacggcccccgttaaagggtccccg

SEQ ID NO: 385818 - DNA, 601 bp, Homo sapiens
  misc_feature: GZ8MTXP02IELJ9.51.80.H03.1.454.CMB.2.raw
  modified_base (212)..(212): a, c, t, g, unknown or other
  modified_base (230)..(230): a, c, t, g, unknown or other
  modified_base (270)..(270): a, c, t, g, unknown or other
  modified_base (295)..(295): a, c, t, g, unknown or other
  modified_base (302)..(302): a, c, t, g, unknown or other
  modified_base (491)..(491): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacgagggtcctgggcccagtctgccctgactcagcctccctccgcgtccggtctcctggacagtcagtcaccntctcctgcactggaaccngcagtgacgtttggtgttaataactatgtctctgaccaangcaccagcaaacgccccaaatcatntatttangagtcagtacgcgcctgacgggtcctgactcgtccttctcgtcgctccaagtctggaccaacaccggtcctcccgtcgtaccgtctcgtcggcctaccgacggtgtcgaggacgtaggacggtacgttcgtaatttacttaaccgttctacggttgtccctactaccgaacgttgacggaggtaaccgngtacgtacgtcggttcgtgtacgttacggttacgggacgggtaacggaaccgtacgtcggtccggtaaccggttaccggtaacggtaccgaaccggaccgtacggacccg

SEQ ID NO: 385819 - DNA, 537 bp, Homo sapiens
  misc_feature: GZ8MTXP02JSKR0.51.80.H03.1.454.CMB.2.raw
  modified_base (232)..(232): a, c, t, g, unknown or other
  modified_base (251)..(251): a, c, t, g, unknown or other
  modified_base (255)..(255): a, c, t, g, unknown or other
  modified_base (269)..(269): a, c, t, g, unknown or other
  modified_base (300)..(300): a, c, t, g, unknown or other
  modified_base (370)..(370): a, c, t, g, unknown or other
  modified_base (393)..(393): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctcctcactcaggcacagggtcctgggcccagtctgccctgactcacgcctccctccgcgtccgggtctcctggaccagtcacgtcaccatctcctgcactggaaccngcagtgacgttggtgttanactntgtctctgtaccangcaccagcaaacgtccccaaatcatgatttngagtcagtagcgcctgacgggtccagctcgcctcgctacgctacacgttcgcgacaacgtccgctaccgngacctctcgtgggcctaaccggngtcgtgagtagcgtacgtcttagtattacgtcgtcgcgtcgaactacgacgcgcgacgacgacgacgtacgtacgtcgtcgtcgtacgtcggtacggacggacgacgacgacgtcgtacgtacgtacgtacgacgaccgacgcg

SEQ ID NO: 385820 - DNA, 655 bp, Homo sapiens
  misc_feature: GZ8MTXP02HOS3C.51.80.H03.1.454.CMB.2.raw
  modified_base (265)..(265): a, c, t, g, unknown or other
  modified_base (270)..(270): a, c, t, g, unknown or other
  modified_base (276)..(276): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcgagggccacgacgggtcctgggcccagtcctgccctgactcacgccctcctccgcgtccggtctccgtggacagtcagtcacatctcngcacngaaccngcagtgacgttggtagttaataactatgtcctccgtaggtaaccaactacgaccacccgagggaccaaaaccgaccccctaaaatccatagtaatttagaggtacgtacaaggtaccggccggtcccgtcgggacggggtccctagtaccgtcgtcttccgtcgtcggtccctaccgtaacgttcgtacggacccaaaccgtcccggtccccttcccgtacgtaccccgttccgtcggtccgggtccttaccgaggtccgtaggacggtagtggacggttctagttactttacgtcgtcgtacgtcgtacctacgacgtacgtccgacgtacgaacgtacgtacggttacggtcggttcggttacgttacggttacggg

SEQ ID NO: 385821 - DNA, 572 bp, Homo sapiens
  misc_feature: GZ8MTXP02JABBU.51.80.H03.1.454.CMB.2.raw
  modified_base (228)..(228): a, c, t, g, unknown or other
  modified_base (308)..(308): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactgaaccngcagtgacgttggtgttatactatgtctctgtaccaacagcacccaggcaaacgcccccaaaactcgactgacttttagngtaggtcaaggtaagccgccctcgaacggggtacctgatcgcttctctgctcaagtctggcaactacgcctccgtagacccgtctcgtggtcctcgacggcctgagagtggaggtcagtacttaatctggtcttgccttcaaactcgtcgacgacggacacgtacgtacggtcggttcgtagtccgtacggtacgggacggacggaccgtacggtaccgtaacgtacccgtacgtacggtacgtaccggacccgtaacgtcccg

SEQ ID NO: 385822 - DNA, 547 bp, Homo sapiens
  misc_feature: GZ8MTXP02I2FW6.51.80.H03.1.454.CMB.2.raw
  modified_base (228)..(228): a, c, t, g, unknown or other
  modified_base (310)..(310): a, c, t, g, unknown or other
  modified_base (467)..(467): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctctgcactggaaccngcagtgacgttggtagttaataactatgtctcctaggtaccaacagcaaccaggacaaacgacccccaaatcatgtatttangagtacagtaagccgtcctgacgggtcctgactcgccctcctgctacagtctgcaacgccgtccctcctacgtaccgtctcgtggcctccgagctagagatgagtctagtattattacgtgtcctgctacacatcgcaaggcagtcgaatcgggttntcgtacgtcggtacgggacggaacgactacgtccgtacggtaacccgtacgtacgcgaaccggacccgtacgccgtcccg

SEQ ID NO: 385823 - DNA, 525 bp, Homo sapiens
  misc_feature: GZ8MTXP02FMXD2.51.80.H03.1.454.CMB.2.raw
  modified_base (302)..(302): a, c, t, g, unknown or other
  modified_base (342)..(342): a, c, t, g, unknown or other
  modified_base (358)..(358): a, c, t, g, unknown or other
  modified_base (417)..(417): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtggttatactatgtctctgtacaacagcacccagcaaacgcccccaaatcatgatttangaggtcagtaagccgccctgacgggtccctgatcgcttcnctgctcagtctgacanacgccctcctgccgtctcgtcggcctcgagctgaggactgaggctagatttagttaccngctgtctcactgcgacgacgcagcgtagtcggtgtcgtcgtacggtcggacggacggaaccacggcgtaacgtacccggtacgtacggtcaacggacccgtagtcccg

SEQ ID NO: 385824 - DNA, 571 bp, Homo sapiens
  misc_feature: GZ8MTXP02I8Q9Q.51.80.H03.1.454.CMB.2.raw
  modified_base (322)..(322): a, c, t, g, unknown or other
  modified_base (366)..(366): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagccctccctccgcgtccggtctccgtggacagtcagtcacctatctcctgcactggaaccagcagtgacgttggtgttaataactatgtctccgtaggtaaccaacgngccaacccgaggaccaaacgacccccaaaatcaatgtactttangagtacagtaacgccgcctcgacggggtccctagactcgtcttctcgtgcctacgagtctgacaaccgccgtccctccgtacgaccgtctcgtgggccctcgaggctaggagtatggacggtctagtatttactacgtcgcttagcctacacgtagtaccgcgacggcgaacgcgtacgtccggtgtccgtacgtttaaccgggg

SEQ ID NO: 385825 - DNA, 550 bp, Homo sapiens
  misc_feature: GZ8MTXP02FWEZU.51.80.H03.1.454.CMB.2.raw
  modified_base (229)..(229): a, c, t, g, unknown or other
  modified_base (366)..(366): a, c, t, g, unknown or other
  modified_base (413)..(413): a, c, t, g, unknown or other
  modified_base (437)..(437): a, c, t, g, unknown or other
  modified_base (449)..(449): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgacgttggtggttataactatgtctcctggtaccaacagcacccaggcaaacgcccccaaactcatgatttatgaggtcagtaagccggccctcgacggggtccctgactcgccttctctgctccaagttcnggcaacgacggccctcctcgacctctcgtgggcctccgaggctgagntggagctgattatctgctgctcanacgtggcacggnagcgtacgtcggtcgtcgtacgttacggtcggggacgggaccgggaacacggtcgtaacggtacccgtacgtacggtaccgaacggacccgtacggtcccg

SEQ ID NO: 385826 - DNA, 533 bp, Homo sapiens
  misc_feature: GZ8MTXP02HSCH1.51.80.H03.1.454.CMB.2.raw
  modified_base (231)..(231): a, c, t, g, unknown or other
  modified_base (254)..(254): a, c, t, g, unknown or other
  modified_base (268)..(268): a, c, t, g, unknown or other
  modified_base (298)..(298): a, c, t, g, unknown or other
  modified_base (304)..(304): a, c, t, g, unknown or other
  modified_base (346)..(346): a, c, t, g, unknown or other
  modified_base (368)..(368): a, c, t, g, unknown or other
  modified_base (387)..(387): a, c, t, g, unknown or other
  modified_base (409)..(409): a, c, t, g, unknown or other
  modified_base (439)..(439): a, c, t, g, unknown or other
  modified_base (445)..(445): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacgttggtgtataactntgtctctgaccaangccaccaggacaaacgcccccaaaatcatnatttangagtcagtaacgcgccctgacggggtccctgactcgccttcnctggctacagtctggacaaacncgtccctcctgacccgtcncgtgggcctccgagctcgaggntcggagtctagatttagttactgtctgctnactagngcaggcaagctagtcggtgtcgtctacgtcgggacggacggacaacgtcgaacgtaccgtcgttacggcaccggacccgtaaggcccg

SEQ ID NO: 385827 - DNA, 590 bp, Homo sapiens
  misc_feature: GZ8MTXP02JGOHV.51.80.H03.1.454.CMB.2.raw
  modified_base (228)..(228): a, c, t, g, unknown or other
  modified_base (267)..(267): a, c, t, g, unknown or other
  modified_base (301)..(301): a, c, t, g, unknown or other
  modified_base (429)..(429): a, c, t, g, unknown or other
  modified_base (468)..(468): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactggaaccngcagtgacgttggtgttatactatgtctcgtgtaccaangcaccaggacaaacgccccaaatcatgtatttangagtcagtaagccggcctgacgggtccctgactcgtccttctcgtacggcctacgaagttcgtcgggaccaaacgaccgggtccctacctcgacccgttctccggtcggccctccgaggtctggaagngtaggacgtctagtatttaacgtcgtgcttcgactacanacgtgacgaggcgagacgtacgtcggtgtacgcgttaacggtccgggaacgggacggaaaccgtacggtaccgaaccggtacccgtacccgtacgggaccaaccggacccgaacggtccccg

SEQ ID NO: 385828 - DNA, 619 bp, Homo sapiens
  misc_feature: GZ8MTXP02H5EDY.51.80.H03.1.454.CMB.2.raw
  modified_base (270)..(270): a, c, t, g, unknown or other
  modified_base (272)..(272): a, c, t, g, unknown or other
  modified_base (285)..(285): a, c, t, g, unknown or other
  modified_base (293)..(293): a, c, t, g, unknown or other
  modified_base (303)..(303): a, c, t, g, unknown or other
tcagcgatcgtatacacgaccggtgctcgatttagctgtgcgtcgaaaggaaagggggctggggtctcaggaggcagcgctctcaggacgtcaccaccatggcctgggctctgctcctcctcaccctcctcactcagggcacagggtcctgggcccagtctgccctgactcagcctcccctccgcgtccgggtctcctggacagtcagtcaccatctcctgcactggaaccagcagtgacgttggtgttataactatgtctctgaccaanancaccagacaaacnccccaaancatgatttangagtcagtaacgccggccctcgacggggtccctgactcgtccttctcgtcggcctacctaagttctggaccaaaccgccggtccctcccgtcgacccgttctccgtcgggccctccgacggtccgtggaggtagttagggacggtcgttagtaatttaatttacgttcggtctttcgccttacacaacgtcgacgacggcaaggctagttccggtgttggtacgttacggttccggggacgggacggaaccgtaacggtcgtaaccggtcccgttacggttacgggacccgaaccggcccggaaaccggtcccccg

SEQ ID NO: 385829 - DNA, 518 bp, Homo sapiens
  misc_feature: GZ8MTXP02IDIZQ.51.80.H03.1.454.CMB.2.raw
  modified_base (246)..(246): a, c, t, g, unknown or other
  modified_base (252)..(252): a, c, t, g, unknown or other
  modified_base (265)..(265): a, c, t, g, unknown or other
  modified_base (273)..(273): a, c, t, g, unknown or other
  modified_base (304)..(304): a, c, t, g, unknown or other
  modified_base (340)..(340): a, c, t, g, unknown or other
  modified_base (343)..(343): a, c, t, g, unknown or other
  modified_base (390)..(390): a, c, t, g, unknown or other
  modified_base (396)..(396): a, c, t, g, unknown or other
  modified_base (399)..(399): a, c, t, g, unknown or other
  modified_base (405)..(405): a, c, t, g, unknown or other
  modified_base (409)..(409): a, c, t, g, unknown or other
  modified_base (419)..(419): a, c, t, g, unknown or other
  modified_base (421)..(421): a, c, t, g, unknown or other
  modified_base (432)..(432): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaaccagcagtgacgtttggngttaanaactatgtctccngtaccaanagcaccagcaaagccccaaatcatgatttancgaggtcagtaaagcggaccctgaggggtccctagntcnctctctgtccaagtctggcaaacacgcctcccctagccgtcttccgngcacgngcngagagngagntatatatatncntctacacatgnagacgacgacgagtcgtgtcgtgtagtcgacggacggacgacgtcgtacgtaaccgtacgtacgtacgacgaccgacgtacgtccg

SEQ ID NO: 385830 - DNA, 710 bp, Homo sapiens
  misc_feature: GZ8MTXP02JOD5F.51.80.H03.1.454.CMB.2.raw
  modified_base (277)..(277): a, c, t, g, unknown or other
  modified_base (310)..(310): a, c, t, g, unknown or other
  modified_base (316)..(316): a, c, t, g, unknown or other
tcagcgatcgtatacacgaccggtgctcgatttagctgtgcgtcgaagggaaagggggctggggtctcagggggcagcgctctcaggacgtcaccaccatggcctgggctctgctcctcctcaccctcctcactcagggcacagggtcctgggcccagtctgccctgactcaacctccctccgcgtccgggtctcctggacagtcagtcaccatctcctgcactggaaccagcagtgacgttggtggttaataactatgtctccgtggtaccaacancaaccaggacaacgccccaaactcatgatttangaggtnaagtagccggccctagacggggtcctgacgtcgtcttctccgtggtacctaccaacggttcgtacggaccacgtaccggtcccttacccgtcgacccgttcgtccgtcgggtccctacccgaagggtcccgttaggacggtaggtacggtacggtccgttaggttaaactttacgtttaaccttgggaacccttggtcccttaccgaacgtaacgttccggaaccggtacgggtaaccgaggtacccgtaaggttcggggttacgtcggttacgtttacgggttaccgggggaccggggttaacgggaacccgtaacggtcggtaccgtaaacccgggttcgtaacggtaaccgaccggtacccgaaacggtcccgtaacccggttccccccgg

SEQ ID NO: 385831 - DNA, 680 bp, Homo sapiens
  misc_feature: GZ8MTXP02GIVME.51.80.H03.1.454.CMB.2.raw
  modified_base (261)..(261): a, c, t, g, unknown or other
  modified_base (268)..(268): a, c, t, g, unknown or other
  modified_base (274)..(274): a, c, t, g, unknown or other
  modified_base (300)..(300): a, c, t, g, unknown or other
  modified_base (343)..(343): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttatactatgtctcngtacacngcaccngacaaacgccccaaatcatgatttangagtcaagtacgccggacctgacgggtcctagactcgccttcncgtcggcctacaagttcgtcgggctaaaccgccggtccctacccgtcggtacccgttcctcggtacgggtcccctcccgaggggtcctagggtaacggacttgggaacgggtcttaggtaaacttttacttaaccggtttgcccgttgcccttacgtaaaacccggtacggtacgaccggacggtactacgggtacgttacggtttcggggtacgttaccggttacggtttaccgggtacgggggaaccggtaacggggaacccgtaacggtaccgtaacccgggtaccccgtttaccggtacggggtaccacccggtaacccggtacggtcccccg

SEQ ID NO: 385832 - DNA, 560 bp, Homo sapiens
  misc_feature: GZ8MTXP02HFAA0.51.80.H03.1.454.CMB.2.raw
  modified_base (228)..(228): a, c, t, g, unknown or other
  modified_base (252)..(252): a, c, t, g, unknown or other
  modified_base (268)..(268): a, c, t, g, unknown or other
  modified_base (303)..(303): a, c, t, g, unknown or other
  modified_base (416)..(416): a, c, t, g, unknown or other
  modified_base (419)..(419): a, c, t, g, unknown or other
  modified_base (431)..(431): a, c, t, g, unknown or other
  modified_base (440)..(440): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctctcactcagggcacagggtcctgggcccagtctgccctgactcagcctccctccgcgtccggtctcctggacagtcagtcaccatctcctgcactggaaccngcagtgacgttggtgttataactntgtctctggtaccaangcacccaggaccaaacgccccaaatcatgatttangagtcagtagcgcctgacgggtccctgactcgccttctctcggcctacaagtctcgggaccaaacgaccggcccctcccgtcgacccttctcgtcggcctccgaggctgaggntgngctgatttatcngctagcctnaactagcgacgaggcacgctacgtcggttgtcgtcgttaacggtcgggaacgggacggtaacccaagtcccgtaacggtacccgttacgttacggtccgaaccgcccgaacggtcccccg

SEQ ID NO: 385833 - DNA, 512 bp, Homo sapiens
  misc_feature: GZ8MTXP02JJ8D0.51.80.H03.1.454.CMB.2.raw
  modified_base (302)..(302): a, c, t, g, unknown or other
  modified_base (321)..(321): a, c, t, g, unknown or other
  modified_base (341)..(341): a, c, t, g, unknown or other
  modified_base (408)..(408): a, c, t, g, unknown or other
  modified_base (420)..(420): a, c, t, g, unknown or other
  modified_base (429)..(429): a, c, t, g, unknown or other
tcagcgatcgtatacacgaccggtgctcgatttagctgtgcgtcgaaggaaaggggctggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcaccatctcctgcactggaaccagcagtgacgttggtggttataactatgtctctggtaccacagcacccaggcaaagcccccaaatcatgatttangaggtcagtaagcggcctnacgggtcctgatcgccttcnctggctccaagtctggcaacacggccctcctgacccgtctctgggactccaggctgaggatgaggcngattattactgntgctcacangcgagcagacgacgtcggtcgtcgtctcgtcggacggacggacgacgacgtcgaccgtaccgtacgtacgacgaccgacgtcg

SEQ ID NO: 385834 - DNA, 607 bp, Homo sapiens
  misc_feature: GZ8MTXP02HXIDH.51.80.H03.1.454.CMB.2.raw
  modified_base (199)..(199): a, c, t, g, unknown or other
  modified_base (229)..(229): a, c, t, g, unknown or other
  modified_base (242)..(242): a, c, t, g, unknown or other
  modified_base (251)..(251): a, c, t, g, unknown or other
  modified_base (265)..(265): a, c, t, g, unknown or other
  modified_base (297)..(297): a, c, t, g, unknown or other
tcagcgatcgtatacacgaccggtgctcgatttagctgtgcgtcgaagggaaaggggctggggtctcaggaggcagcgctctcaggacgtcaccaccatggcctgggctctgctcctcctcaccctctcactcagggcacagggtcctgggcccagtctgccctgactcagcctccctcgcgtccgggtctcctggacngtcagtcaccatcctcctgcactggaaccngcagtgacgttgngttatactntgtctctgacaacngcaccagacaaacgccccaaatcatgtattangagtcaagtacgcgcctgacgggtcctgacttcgcctttccgtcgtcggtcctaccgtaaagttctcggggaccaaaccgcccggtcccccttcccgtggaacccgttctccgtcgggaccttccgagggtcctggacggtagtgacgggtctaggtactttaagttccgtggtcttcgccttacacgtaacgttcgaccgaacgggtcctaagcgtaggttccggttgtacgtcgttacgtcggggacgtacgggaccaggcctcggtacccgtacgttagggaccctacggacccgtaacggtccccg

SEQ ID NO: 385835 - DNA, 602 bp, Homo sapiens
  misc_feature: GZ8MTXP02GM51G.51.80.H03.1.454.CMB.2.raw
  modified_base (203)..(203): a, c, t, g, unknown or other
  modified_base (213)..(213): a, c, t, g, unknown or other
  modified_base (230)..(230): a, c, t, g, unknown or other
  modified_base (273)..(273): a, c, t, g, unknown or other
  modified_base (304)..(304): a, c, t, g, unknown or other
  modified_base (473)..(473): a, c, t, g, unknown or other
  modified_base (495)..(495): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctctcactcagggcacgagggtcctgggcccagtctgccctgactcagccctccctccgcggtccggtctcctggacngtcagtcacntctctgcactggaaccngcagtgacgttggtagttaatactatgtctcgtaggtacaacncgccaccgaggaccaaaccgacccccaaaanctaagtcgtaatttagtaggacggtacaaggtaacgccggtcccgtacggtacggggtcctggactccggtccctttcgtccgtcggtcctacgaacgtcgtcgggaccaacgtccggtccctacccgtcgaccttcgtcgtcggcctcgagcgtggagacgtgaggtntacgtaattattacgtctcgtntctacgatacgcgagaacgcgacgcgtagtcggtcgtcgtacggtacggttacgggacggacgacgaacgtcgtcggaccgtacggtacgcgacgccgacggtcccg

SEQ ID NO: 385836 - DNA, 578 bp, Homo sapiens
  misc_feature: GZ8MTXP02INKVI.51.80.H03.1.454.CMB.2.raw
  modified_base (201)..(201): a, c, t, g, unknown or other
  modified_base (212)..(212): a, c, t, g, unknown or other
  modified_base (271)..(271): a, c, t, g, unknown or other
  modified_base (295)..(295): a, c, t, g, unknown or other
  modified_base (306)..(306): a, c, t, g, unknown or other
  modified_base (435)..(435): a, c, t, g, unknown or other
  modified_base (471)..(471): a, c, t, g, unknown or other
  modified_base (478)..(478): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacngtcagtcaccntcctcctgcactggaaccagcaggtgacgtttggtgttaatactatgtctctgtaccangcaccaggacaaacgccccaaatnatgtatttagngacggtcaggtaacgcggccctcgacggggtccctgactcgtccttcctcgtcggtactccgtacgtctggaccaaccgaccgtccctcccgtacgaccgtctcgtcgggacctcgaggcgtgaacggngtaggtacggctagtatttacttctgtcctgcctanacctgtncgaggctagactgtcggtgtcgtacgttacggtcggacgggacgaccaacgtccgtaacggtccgttacggtacgtccgaccggaccgacgggttccccg

SEQ ID NO: 385837 - DNA, 600 bp, Homo sapiens
  misc_feature: GZ8MTXP02GK296.51.80.H03.1.454.CMB.2.raw
  modified_base (229)..(229): a, c, t, g, unknown or other
  modified_base (269)..(269): a, c, t, g, unknown or other
  modified_base (294)..(294): a, c, t, g, unknown or other
  modified_base (297)..(297): a, c, t, g, unknown or other
  modified_base (303)..(303): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcaggcacagggtcctgggcccagtctgccctgactcagcctccctccgcgtccggtctcctggacagtcagtcaccatctcctgcactggaaccngcagtgtacgttggtgttaatactatgtctcgtgtacaanagcaccgagacaaacgccccaaatnatntattangagtcagtacgccgcctgacgggtcctgctcgtcctcgcgtggacctacgaacgttcgcggaaccaacggtacccgcccttccgtcggtacctcgtcgtcggtaccctcggacggtcgtggaagtgtaggacggtctacgttaatttacgtactggtacttcgacttacacgtagtgccgtaaggcaccgtagtcgttacgtagttcgtagttaccgggttacgggacgggtaaccggaacctacggtcgtaaccggtaccgttcgtacggaccgaccggacccgtacggtcccccg

SEQ ID NO: 385838 - DNA, 631 bp, Homo sapiens
  misc_feature: GZ8MTXP02JR4UC.51.80.H03.1.454.CMB.2.raw
  modified_base (254)..(254): a, c, t, g, unknown or other
  modified_base (261)..(261): a, c, t, g, unknown or other
  modified_base (269)..(270): a, c, t, g, unknown or other
  modified_base (302)..(302): a, c, t, g, unknown or other
  modified_base (343)..(343): a, c, t, g, unknown or other
tcagcgatcgtatacacgaccggtgctcgatttagctgtgcgtcgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtgttataactntgtctcngtaccaanncaccagcaaacgccccaaatcatgtatttagngtagtcagtacgccgtcctgcggtcctgtactcgcccttcncgtcgacctacgtacgtcgcggaccaacgtccgtccctccgtcgtacccgtcgtcgtcggtaccctcgacggtcgtaggacgtacgtggtacggtcgtacgttaagttaacgttacgttcgtcgtcgtaccgtactacgtacgtacgtacgacgacgtacgtacgtacgtcggttacggttacgtacgttacggttaccgggtacgggtaccgggtaaccggtaacggtaccgtaaccggtaccggtaccggtaccggtaccggaccggtacccggtaccggtacccg

SEQ ID NO: 385839 - DNA, 615 bp, Homo sapiens
  misc_feature: GZ8MTXP02JAXGN.51.80.H03.1.454.CMB.2.raw
  modified_base (253)..(253): a, c, t, g, unknown or other
  modified_base (256)..(256): a, c, t, g, unknown or other
  modified_base (259)..(259): a, c, t, g, unknown or other
  modified_base (262)..(262): a, c, t, g, unknown or other
  modified_base (271)..(271): a, c, t, g, unknown or other
  modified_base (282)..(282): a, c, t, g, unknown or other
  modified_base (286)..(286): a, c, t, g, unknown or other
  modified_base (299)..(299): a, c, t, g, unknown or other
  modified_base (326)..(326): a, c, t, g, unknown or other
  modified_base (332)..(332): a, c, t, g, unknown or other
  modified_base (351)..(351): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacgagggtcctgggcccagtctcgcctgactcacgcctcctccgcgtccggtctctggacagtcagtcacntcnctncangacagcagngacgtgtgtanactntgtctctgaccanagccacacgacaacgccccaaatcatnatttanagagtcaagtacgcgtccncgtacgggtcctagctcgtcttctcgtcggtactacgtaacgtccgtacggaccaaaccgaccgttccccgtacttaaccgaccgttccttccggaacggggtcccttccggtaacgggccgttaaacggggacggtagacggtacggtacgttagttacgtttaacgttacgttacgtacgtcgtaccgtaccgtaacgtacgtacgtacgacggtaacgacgtacggtacggttacggttacggttacggttacggttacgg

SEQ ID NO: 385840 - DNA, 541 bp, Homo sapiens
  misc_feature: GZ8MTXP02FPZMD.51.80.H03.1.454.CMB.2.raw
  modified_base (303)..(303): a, c, t, g, unknown or other
  modified_base (382)..(382): a, c, t, g, unknown or other
  modified_base (386)..(386): a, c, t, g, unknown or other
  modified_base (442)..(442): a, c, t, g, unknown or other
tcagcgatcgtatacacgaccggtgctcgatttagctgtgcgtcgaaggaaagggggctggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggaaaccagcagtgacgttggtggttaataactatgtctctgtaccaacagcaccaggcaaacgccccaaatcatgattangagtcagtaagccgcctcgacgggtcctgactcgcttctctgctccaagtctggcaaacacggcctcccctgacccgtntcgngggcctccgaggctagaggatgaggtctagtattaattcgtgtactgctacacgangacgagacgagacgtagtcggtcgtgtcgtacgtacggacgggacggaacgtaacgacgtaacgtaccgtaccgtacggtacgaccgaccgaacgtacg

SEQ ID NO: 385841 - DNA, 571 bp, Homo sapiens
  misc_feature: GZ8MTXP02ICWA8.51.80.H03.1.454.CMB.2.raw
  modified_base (251)..(251): a, c, t, g, unknown or other
  modified_base (253)..(253): a, c, t, g, unknown or other
  modified_base (258)..(258): a, c, t, g, unknown or other
  modified_base (263)..(263): a, c, t, g, unknown or other
  modified_base (294)..(294): a, c, t, g, unknown or other
  modified_base (299)..(299): a, c, t, g, unknown or other
tcagcgatcgtatacacgaccggtgctcgatttagctgtgcgtcgaaaggaaagggggctgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctctgcatggaaccagcagtgacgttggtgtatactntntctcngacangcaccagcaaacgccccaaatcatgtattangagtnagtaacgcgcctcgacgggtcctgactcgtcccttctcgtcggactaccgtagtctcggaccaaacgcccggtcccttccccgcgtacccgttcctccgtcggccctaccgacggtccgtaggaggtagtcggaacggcgttagtaactttaacttacgtgtcgttgcctctactacgtgcgacgcgagctacggtcgtgtcgtcgttacgtcgggacggacggacgaagtcgaacggtccgtacgtacgtacgaccgaccgaacggtcccg

SEQ ID NO: 385842 - DNA, 605 bp, Homo sapiens
  misc_feature: GZ8MTXP02HU262.51.80.H03.1.454.CMB.2.raw
  modified_base (328)..(328): a, c, t, g, unknown or other
  modified_base (380)..(380): a, c, t, g, unknown or other
  modified_base (494)..(494): a, c, t, g, unknown or other
tcagcgatcgtatacacgaccggtgctcgatttagctgtgcgtcgaagggaaagggcacgaccggtgctcgatttagctgtgcgtcgaagggaaagggggctggggtctcaggaggcagcgctctcaggacgtcaccaccatggcctgggctctgctcctcctcaccctcctcactcagggcacacgggtcctgggcccagtctcgccctgactcacgcctcccgtccgcgtccggtctccgtggacagtcagtcaccatctctgcacgtacgaacagacagtcgtacgttggtagttaataactatcgtctccgtaggtaaccaacngaccacccaacggaccaaaaccacccccgtaaaactccaatcgtaactttancggtaagtacctaagtaaccggcgcccgtgggaccggtcctagactcgcttctcgtacgctacgatcgtgtacaccgacgccctaccgcgtaccgtctccgtgggccttacggnggactggacgagttggagtcttagtaacttagtacgttcgacgtttcactaccgtactacgtacgacggtacggaacacggtacagttcggtacgtcggtaacgtttcggg

SEQ ID NO: 385843 - DNA, 370 bp, Homo sapiens
  misc_feature: GZ8MTXP01ELLQU.19.74.G08.1.454.CMB.2.raw
  modified_base (285)..(285): a, c, t, g, unknown or other
  modified_base (366)..(370): a, c, t, g, unknown or other
tcagtactctcgtgcacgaccggtgctcgatttagtagctctatcagggtcaggaaaaactggttcttcgactcgtcatatcaatggacaagtcgaagaaccagttttcctgaccctgacctctttgagcgccgcggacacggccgtctattactgtgcgagagcgtggggaagcagtggccctgacaatgacttctggggccagggaatcctggtcaccgtctcctcagcctccaccaaggcccatcggtcttccccctggccgccctgctcccaggagcaccnccgagagcacagcggccctgggctgcctggtcaaggactactcccacgagagtactgagcgggctggccaaggcgcatagnnnnn

SEQ ID NO: 385844 - DNA, 369 bp, Homo sapiens
  misc_feature: GZ8MTXP01BFYAD.19.74.G08.1.454.CMB.2.raw
  modified_base (285)..(285): a, c, t, g, unknown or other
  modified_base (365)..(369): a, c, t, g, unknown or other
tcagtactctcgtgcacgaccggtgctcgatttagtagctctatcagggtcaggaaaaactggttcttcgactcgtcatatcaatggacaagtcgaagaaccagtttttcctgaccctgacctctttgagcgccgcggacacggccgtctattactgtgcgagagcgtggggaagcagtggccctgacaatgacttctggggccagggaatcctggtcaccgtctcctcagcctccaccaagggcccatcggtcttcccctggccgccctgctccaggagcaccnccgagagcacagcggccctgggctgcctggtcaaggctacttcccagagagtactgagcgggctggccaaggcgcatagnnnnn

SEQ ID NO: 385845 - DNA, 370 bp, Homo sapiens
  misc_feature: GZ8MTXP01DTM9Y.19.74.G08.1.454.CMB.2.raw
  modified_base (267)..(267): a, c, t, g, unknown or other
  modified_base (287)..(287): a, c, t, g, unknown or other
  modified_base (342)..(342): a, c, t, g, unknown or other
  modified_base (364)..(370): a, c, t, g, unknown or other
tcagtactctcgtgcacgaccggtgctcgatttagtagctctatcagggtcaggaaaaactggttcttcgactcgtcatatcaatggacaagtcgaagaaccagtttttcctgaccctgacctctttgagcgccgcggacacggccgtctattactgtgcgagagcgtggggaagcagtggccctgacaatgacttcgtggggccagggatcctggtcaccgtctcctcagcctccaccaagggaccatcggtccttcccctggccnccctgctcccaggagcaccnccgagagcacagcggccctgggctgcctggtcaaggactactcccagagagtacngagcggctggcaggcgcatagnnnnnnn

SEQ ID NO: 385846 - DNA, 577 bp, Homo sapiens
  misc_feature: GZ8MTXP01B1GN7.19.74.G08.1.454.CMB.2.raw
  modified_base (456)..(456): a, c, t, g, unknown or other
  modified_base (489)..(489): a, c, t, g, unknown or other
  modified_base (569)..(569): a, c, t, g, unknown or other
tcagtactctcgtgcacgaccggtgctcgatttagtagctctatcagggtgctgctaatgctctgggcccctggatccagtggggatattgtgatgacccaggctccactctcctcacctgtcacccttggacagccggcctccatctcctgcacttctagccaaaaacctcgtgcacagtgatggaaacacctacttgagttggcttcagcagaggccaggccagcctacaagactcctaatctactaagtatttctaaccggttctcgtggggtcccagacagtattcagtggcgaggtggggcagggggcaggtatttcacgactgagatcgaggcgacggggtggaactggacggatggtcgcgtatttatactgcagtcgacaagtactactacttacttttaccgtacgtaaacgttttcggaccgacggggacctaggcgtagggacgngtacgaaggtacgaacgtggtgcgtagcacctnttcgtctccttctacttcccgttccgctacgtcttacgaccttaaccgggtaatacgttaacgcggacgggccggtccgngggaaccg

SEQ ID NO: 385847 - DNA, 363 bp, Homo sapiens
  misc_feature: GZ8MTXP02IWIVK.19.74.G08.1.454.CMB.2.raw
  modified_base (276)..(276): a, c, t, g, unknown or other
  modified_base (362)..(363): a, c, t, g, unknown or other
tcagtactctcgtgcacgaccggtgctcgatttagtagctctatcagggtcaggaaaaactggttcttcgactcgtcatatcaatggacaagtcgaagaaccagttttcctgaccctgacctctttgagcgccgcggacacggccgtctattactgtgcgagagcgtggggaagcagtggccctgacaatgacttctggggccagggaatcctggtcaccgtctcctcagcctccaccaaggcccatcggtcttcccctggcgccctgctccaggncacctccgagagcacagcggcccctgggctgcctggtcaaggactactcccacgagagtactgagcgggctggccaggcgcatagnn

SEQ ID NO: 385848 - DNA, 394 bp, Homo sapiens
  misc_feature: GZ8MTXP02JRA7G.19.74.G08.1.454.CMB.2.raw
  modified_base (389)..(394): a, c, t, g, unknown or other
tcagtactctcgtgcacgaccggtgctcgatttagtagctctatcagggtcaggaaaaactggttcttcgactcgtcatatcaatggacaagtcgaagaaccagtttttcctgaccctgacctctttgagcgccgcggacacggccgtctattactgtgcgagagcgtggggaagcagtggccctgacaatgacttcgtgggccagggaatccgtggtccaccgtctcctcacgccctccaccgaagggcccagtccggtccttcccccgtggcccgccctgcctcccgaggacgccaccctccgagacgcacaggccggcccgtgggctgcctggtcaaggtactacttcccagacgagtactgacgcggatggaccaggcgcatagnnnnnn

SEQ ID NO: 385849 - DNA, 516 bp, Homo sapiens
  misc_feature: GZ8MTXP01EDSHN.39.18.B07.1.454.CMB.2.raw
  modified_base (289)..(289): a, c, t, g, unknown or other
  modified_base (327)..(327): a, c, t, g, unknown or other
  modified_base (340)..(340): a, c, t, g, unknown or other
  modified_base (346)..(346): a, c, t, g, unknown or other
  modified_base (371)..(371): a, c, t, g, unknown or other
  modified_base (387)..(387): a, c, t, g, unknown or other
tcagtcgcactagtcacgaccggtgctcgatttagtcgctgcgtaagggggcagaagtctctctcagtcaggacacagcatggacatgagggtccctgctcagctcctgggactcctgctgctctggctcccagatgccagatgtgacatccagatggcccagtctccatcctccctgtctgcatctgttgggacagagtcaccatcacttgccgggcagtcaggacattagctagttatagcctggtatcaacacaagccaggcaagttccaagctctgatctattcngctatccaactttacaactcgaggtcccatctacgtcngtgcagtgatcgngggacngacttcgctctcacatcagccactncagccaggaatagttntacgtacttacttacttacgtactaactaaacgttctacttcgaacgtaccgaagtacgttaggaccgggtaacggttcccgggacccgaacgtaagtacgaacgtactacgaaacgtcgttggtaacg

SEQ ID NO: 385850 - DNA, 603 bp, Homo sapiens
  misc_feature: GZ8MTXP01A3VER.39.18.B07.1.454.CMB.2.raw
  modified_base (222)..(222): a, c, t, g, unknown or other
tcagtcgcactagtcacgaccggtgctcgatttagtcgctgcgtaagggggcagaagtctctctcagtcaggacacagcatggacatgagggtccctgctcagctcctgggactcctgctgctctggctcccagatgccagatgtgacatccagatggcccagtctccatccctccctgtctgcatctggttgggacagagtccacatcacgttggccgggngagtcaaggacattagctagttattagcctggtatcaacacaagccagggactaaagttcctaagctacctgattctattctgctactccatttacaactcgacgggtcccagtctacggttcaaggtgcgagtgactcgtagggacagtacttcgctctacacctactcaacgcccactcgacacgaccgtagggaaacgtacgttagttacgtacctttaactttaacttacttacggtaacttaaaacggttccttaaccgttcgtaacgtaaccggttaaagtacgttacgggaaacggggttaaccgtttcccggggaccccggttaacgtaacggttaccaaacgtacaacgttaacgtaacgttcggtaaccgg

SEQ ID NO: 385851 - DNA, 675 bp, Homo sapiens
  misc_feature: GZ8MTXP01D2YAV.39.18.B07.1.454.CMB.2.raw
tcagtcgcactagtcacgaccggtgctcgatttagtcgctgcgtaagggggcagaagtctctctcagtcaggacacagcatggacatgagggtccctgctcagctcctgggactcctgctgctctggctcccagatgccagatgtgacatccagatcggcccagtcctccactccctccctgtctgctatcgtggttgggacagacgtccaccatcacgttcgggccgggcgagtcgaggactagttagctaagttattacggcctagtactacaaaccacgaacgtaccgaagggactaacgtttaccctaagtcccttaccttagtattacctttactttactcgtacttaaccttaccctaaccttttaaccaacgttaccggaccggggttcccagttcccgtttaaccgggttctaagggtcgtacgtagggttcggtaacgtcggtacgggactacgtacttccggtcttccactacctactcacgtcccaacgtcacgacgtcctaaggggtaagtgttgttacgtactttaacttatttactacgttaaacttaaagttaccttactcgtaacgaaccgttaagtaggttacggaacgggtaaccggttcccgggacccggacgttaaggtacgaacgtaacgtaaccgaacgtaacgttggtaacg

SEQ ID NO: 385852 - DNA, 651 bp, Homo sapiens
  misc_feature: GZ8MTXP01DEZ0W.39.18.B07.1.454.CMB.2.raw
  modified_base (317)..(317): a, c, t, g, unknown or other
tcagtcgcactagtcacgaccggtgctcgatttagtcgctgcgtaagggggcagaagtctctctcagtcaggacacagcatggacatgagggtccctgctcagctcctgggactcctgctgctctggctcccagatgccagatgtgacatccagatcggcccagtctccactccctccctgtctgctatcgtggttgggacagacgtccaacctatccacgttcggccgggcagtcaaggacattagctaagttatagctgtactacaacacaacgcgaggactaacgttacctaagcctactgtattcgttattcngctactcctactttaacaacgtccgtacgggtccctagttccgttacgggttacaaggtcggacgtagggttcggtaacgttcggtaggggtacctaggttaccgtttaccggtcctacctcctaaccgtacttaccgaccgtacccaccgttcgacgtacgtcccgtaaggggtaacgttagtttcgttacgttacttacgtttattacgttaacgttaactaaacgttccttacgtctaaggaccgttaaggtacgttacgggtaacgggtaccggttacccgggacccggttacgtaacggtacaacgactacgaacgtaacgttgtaacg

SEQ ID NO: 385853 - DNA, 508 bp, Homo sapiens
  misc_feature: GZ8MTXP02F4X23.39.18.B07.1.454.CMB.2.raw
  modified_base (327)..(327): a, c, t, g, unknown or other
tcagtcgcactagtcacgaccggtgctcgatttagtcgctgcgtaagggggcagaagtctctctcagtcaggacacagcatggacatgagggtccctgctcagctcctgggactcctgctgctctggctcccagatgccagatgtgacatccagatggcccagtctccatcctccctgtctgcatctgttggggacagagtcaccatcacttgccgggcgagtcaggacattagcagttattagcctggtatcaacacaagccagggcaagttcctaagctcctgatctattctgcatccacttacactcagggtccatctcgttcngtgcagtgatcgtggacagacttcgctctcacatcagccacctgcagcctgaacgtatgttgcttacttattactgttacaaaagtcttaactctcgaccgtaagacgtaggaacgggacgtttaccgggaccccgggtaaccgtaagggttccaaggactacgaaacgaacgtagtacgg

SEQ ID NO: 385854 - DNA, 515 bp, Homo sapiens
  misc_feature: GZ8MTXP02GPERF.39.18.B07.1.454.CMB.2.raw
  modified_base (328)..(328): a, c, t, g, unknown or other
  modified_base (357)..(357): a, c, t, g, unknown or other
tcagtcgcactagtcacgaccggtgctcgatttagtcgctgcgtaaggggcagaagtctctctcagtcaggacacagcatggacatgagggtccctgctcagctcctgggactcctgctgctctggctcccagatgccagatgtgacatccagatggcccagtctccatcctccctgtctgcatctgttgggacagagtcaccatcacttgccgggcgagtcaggacattagctagttattagcctggtatcaacacaagccagggcaagttcctaagctcctgatctattctgcatccactttacaatcgagggtccatctcgttcngtgcagtgatcgtggacagacttcgctcncacatcagccactgcagcctagaagtatgttagcttacttattactgtactaaagtcttactctacgaccgaaagagttaggaacggggtaccgttaccgggaccccgggtaccgaaacggttacaacgtacgtaccgaaaacggtaacgtcgtacgg

SEQ ID NO: 385855 - DNA, 548 bp, Homo sapiens
  misc_feature: GZ8MTXP02IJHAY.39.18.B07.1.454.CMB.2.raw
  modified_base (329)..(329): a, c, t, g, unknown or other
  modified_base (376)..(376): a, c, t, g, unknown or other
tcagtcgcactagtcacgaccggtgctcgatttagtcgctgcgtaagggggcagaagtctctctcagtcaggacacagcatggacatgagggtccctgctcagctcctgggactcctgctgctctggctcccagatgccagatgtgacatccagatggcccagtctccatcctccctgtctgcatctgttggggacagagtcaccatcacttgccgggcgagtcaggacattagcagttattagcctggtatcaacacaagccaagggcaagttcctaagctcctgatctattctgcatccattacaatcagggtcccatctcggttcngtgcagtgatcgtgggacagtactcgctctcaccatcagcccacctnacagcctagaacgtatgttgacttacttattactagtactaaaagttcttaactcttcgaccgtaagtaacgtacggtaaacgggtaaccggttacccgggacccccgggtaaccgtaaacgggtttacaacggtaacgtaaccgtaaaaccgtaacgttacggtaaccggg

SEQ ID NO: 385856 - DNA, 551 bp, Homo sapiens
  misc_feature: GZ8MTXP02GKR3L.39.18.B07.1.454.CMB.2.raw
  modified_base (334)..(334): a, c, t, g, unknown or other
  modified_base (372)..(372): a, c, t, g, unknown or other
tcagtcgcactagtcacgaccggtgctcgatttagtcgctgcgtaagggggcagaagtctctctcagtcaggacacagcatggacatgagggtccctgctcagctcctgggactcctgctgctctggctcccagatgccagatgtgacatccagatggcccagtctccatcctccctgtctgcatctgttggggacagagtcaccatcacttgccgggcagtcaggacattagcagttatttagcctggtatcaacacaagccagggcaaagtttccaagctcctgatctattctgcatcctaatttacaattcaggggtcccatctcggttcnggtgcagtgatctgggacgagacttcgctctcaccacncacaccacctcgcacgtcgtagagtagtgttacgtacttactttaactttaacttacgtaactaaacttacttactacgtacgtacgaacgtaacgtacggtaacgggtaccggttacccggtacccgggtaaccgtaacggtacgtaacgtaacgtaacgaaacgtaacgtacgtacg

SEQ ID NO: 385857 - DNA, 542 bp, Homo sapiens
  misc_feature: GZ8MTXP02HJL1Q.39.18.B07.1.454.CMB.2.raw
  modified_base (328)..(328): a, c, t, g, unknown or other
  modified_base (375)..(375): a, c, t, g, unknown or other
tcagtcgcactagtcacgaccggtgctcgatttagtcgctgcgtaagggggcagaagtctctctcagtcaggacacagcatggacatgagggtccctgctcagctcctgggactcctgctgctctggctcccagatgccagatgtgacatccagatggcccagtctccatcctccctgtctgcatctgttgggacagagtcacatcacttgccgggcgagtcaggacattagcagttatttagcctggtatcaacacaagccagggcaaagttcctaagctcctgatctattctgcatccactttacaactcagggtccatctcgttngtgcagtgatcgtgggacagacttcgctctcaccatcagcccacctnccacgccctagaagtattgttcgtacttactttattactagttaactaaaagttcttactcttacgaccgaagtacgtaggaacggggtaaccggttacccgggaccccgggtaaccgtaacggttacgaacgtacgtaaccgaaaacggtaacgttggtaaccggg

SEQ ID NO: 385858 - DNA, 498 bp, Homo sapiens
  misc_feature: GZ8MTXP02JJRTM.39.18.B07.1.454.CMB.2.raw
  modified_base (327)..(327): a, c, t, g, unknown or other
  modified_base (382)..(382): a, c, t, g, unknown or other
tcagtcgcactagtcacgaccggtgctcgatttagtcgctgcgtaagggggcagaagtctctctcagtcaggacacagcatggacatgagggtccctgctcagctcctgggactcctgctgctctggctcccagatgccagatgtgacatccagatggcccagtctccatcctccctgtctgcatctgttggggacagagtcaccatcacttgccgggcagtcaggacattagcagttattagcctggtatcaacacaagccagggcaagttcctaagctcctgatctattctgcatccactttacaactcagggtcccatctgtcngtgcagtgatcgtggacagacttcgctctcaccatcacgccactgcagcctaganatgtgctacttattactgtacaaaagtcttactctacgaccgagacgtggacgggtaccgttaccggaccccgggaactaacggttacaacgactaccgaaaacgactacgtacgg

SEQ ID NO: 385859 - DNA, 658 bp, Homo sapiens
  misc_feature: GZ8MTXP02JMYWO.39.18.B07.1.454.CMB.2.raw
  modified_base (218)..(218): a, c, t, g, unknown or other
tcagtcgcactagtcacgaccggtgctcgatttagtcgctgcgtaagggggcagaagtctctctcagtcaggacacagcatggacatgagggtccctgctcagctcctgggactcctgctgctctggctcccagatgccagatgtgacatccagatggcccagtctccatccctccctgtctgcatctggttgggacagagtcacatcacttgccggngagtcaggacatagcagttattagcatggtatcaaacacaagccgaagggcaaacgtttaccaagcctacctgaacttcttattctgactactacctaacttttaccaaactcgaacggggttacccctattccgttcggttcgtaagtcggcgaggtggattcgtggggaacagtactcgctctcaccatcacgacccacctcgaccgacgtaccttaggaagtacgttgggtttacgacctttaactttaacgtttaccttacgttaaccgttaaaaacgttcctttaaacttaccgttacggtacccgaaaaggtaccgttaaggggtaaccggggttaaacccgggtttacccggggacccccggggtaaaccgtaaacgggtttacccgaaacgggtaaaccgtaccggtaaaaacccggtacgtttaaccgggg

SEQ ID NO: 385860 - DNA, 606 bp, Homo sapiens
  misc_feature: GZ8MTXP02H5ZAQ.39.18.B07.1.454.CMB.2.raw
  modified_base (292)..(292): a, c, t, g, unknown or other
  modified_base (367)..(367): a, c, t, g, unknown or other
tcagtcgcactagtcacgaccggtgctcgatttagtcgctgcgtaagggggcagaagtctctctcagtcaggacacagcatggacatgagggtccctgctcagctcctgggactcctgctgctctggctcccagatgccagatgtgacatccagatggcccagtctccatcctcctgtctgcatctgttgggacagagtcaccatcacttggcgggcagtcaggacatagcagttattagcatggtatacaacacaagccgagggctaagttcctaagctctgatctattcngactatacctactttacaacgtccgacgggtccctatccgtcggttcagttggacgtagtgagtcgtagggaccnggtactttcgcttacctcacctatcaaccgccctacgtcgcaacgtccgtagaagtattggttactacttaaccttaatttacgtagttaaacctaaagtttaccttaccttacgtacggaccgtaaagtacggtacgggtaaacggggtacccggtttacccggggaaccccgggtaaacgttaaacggggtaacctaaacggtacgttaaaacccggaaaaccgtttaacggtcggg

SEQ ID NO: 385861 - DNA, 592 bp, Homo sapiens
  misc_feature: GZ8MTXP02GOHAU.39.18.B07.1.454.CMB.2.raw
  modified_base (564)..(564): a, c, t, g, unknown or other
  modified_base (580)..(580): a, c, t, g, unknown or other
tcagtcgcactagtcacgaccggtgctcgatttagtcgctgcgtaagggggcagaagtctctctcagtcaggacacagcatggacatgaggctccctgctcagctcctggggctgctaatgctctgggtcccaggatccagtggggatgttgtgatgactcagtctccagtctccctgcccgtcacccttggacagccggcctccatctcctgcaggtctagacaagcctgtatacattgatagaaactcctatgaattggttacagcagagccaggccaatcctacgaacggctaccttaaaatttacgtaacggtttacctaaacccggggtattccggtacggggtacccaggaaccaggtacttcgaggcggtcagggtcgggtacagggcccagtagtaaacttccaactaactaagaaaactccgaaggacgtaagggtgggaaggcgttaggaaggtagttagggtttggggtttattacgtgactagtgaccgagaacgactaacgtcgaccgtaccgtactacgtttcggacgtacggacaacgcgtaggacaanaacgaaacgacgtagngactgactaacg

SEQ ID NO: 385862 - DNA, 726 bp, Homo sapiens
  misc_feature: GZ8MTXP02GXXC3.39.18.B07.1.454.CMB.2.raw
  modified_base (227)..(227): a, c, t, g, unknown or other
  modified_base (543)..(543): a, c, t, g, unknown or other
tcagtcgcactagtcacgaccggtgctcgatttagtcgctgcgtaagggggcagaagtctctctcagtcaggacacagcatggacatgagggtccctgctcagctcctgggacctcctgctgctctggctcccagatgccagatgtgacatccagatcggcccagtctccactcctccctgtctgcatcgtggttgggacaggatccaccatcacgttcggccgggngagtcgaggactattacgctagtttatttcgccgttaggtactacaaaccacgaacggaccccgaaggggtacctaaacggttttccctaaacggtccttaccccgtagtactttaccttaacgtttccgtacgtaccctaacctttacccctaaacctttttaacaacccgttacccgggtaacggggttaccccctaagtttcccggttaccgggtttacgaggggttccggacgttaaggggtcgtacgtcggtacggggaacttacgtaccgtttccgaccttctacccacctactccaaccgaccctaccnggacctacgtcctaaggaacgttgttacgttcgtaccttaacctttagtacgttaacgtaaacctaaagtttcccttactaccgttacggaacaggtacgtacgggtaaaccgggtaccggttaccccgggaccccgttaagaacgttcaaacggttacaaccggaaacgtacgtcggtaccg

SEQ ID NO: 385863 - DNA, 611 bp, Homo sapiens
  misc_feature: GZ8MTXP02GP1MN.39.18.B07.1.454.CMB.2.raw
  modified_base (220)..(220): a, c, t, g, unknown or other
  modified_base (287)..(287): a, c, t, g, unknown or other
  modified_base (298)..(298): a, c, t, g, unknown or other
  modified_base (332)..(332): a, c, t, g, unknown or other
  modified_base (364)..(364): a, c, t, g, unknown or other
tcagtcgcactagtcacgaccggtgctcgatttagtcgctgcgtaagggggcagaagtctctctcagtcaggacacagcatggacatgagggtccctgctcagctcctgggactcctgctgctctggctcccagatgccagatgtgacatccagatggcccagtcctccatcctccctgtctgcatctggttggggacagagtcacatcacttgccgggnagtcaggacattagcagttattagcctggtatacaacacaagccgagggctaaagttccaagctccngtatctattcngcactacctagttacactcgacggtcatctcgtngtcgacgtagtgatcgtaggacagttacgtcncttcacactacgtacgaccacccctacgtcgaccgtaccgtaccgtaaggtaaacgtgtttcggttacgtactttaaactttaacgtttactaccggttaaaacttaaacgtttcctttaacgtaccgtacgtaaaccgtaaagtagtaaacggggtaacccgggttaacccggttaccccggggaacccccggtaaaagtaacggttaacaacggtaactaaaccgaaaaccgtaggtcgtaacgg

SEQ ID NO: 385864 - DNA, 776 bp, Homo sapiens
  misc_feature: GZ8MTXP01DVVTA.52.10.A10.1.454.CMB.2.raw
  modified_base (206)..(206): a, c, t, g, unknown or other
  modified_base (235)..(235): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctntcctgcagggccagtcagaatattacctntactggcctgtaccaacaaaactgcccagctccacgctctcatctatgatagcatcaactcggccgactaggcgactcccacgaccgacggttacgtagtaggtcgaacgttgggggtcgttcggggacgaacggtaacgttaccctaaccgtacctttccaacccaacttaccaacggaccgaaacccttaacggtaacgacccgttacggtaaacggtaacccttttagggtaccttaacggttttaagtttaaacccttggttacctagaccgtaagacccgggggtttaagttaaacggggtttaaggccgggtaaccgtttccggggtacccggtaaaacgggggtaaaccggtaaaccggaaacccggttacggggtaaaggggttaaaaacccgggtaaaaccgttaacgggtttggggaccgtttacgggtaaccgaacccccttaaagggtttaaccttaccgggtttaacctttccgtaaacgttacccctttccccgggttaccccctaacttttaacccgggtttaacg

SEQ ID NO: 385865 - DNA, 519 bp, Homo sapiens
  misc_feature: GZ8MTXP01B86DD.52.10.A10.1.454.CMB.2.raw
  modified_base (253)..(254): a, c, t, g, unknown or other
  modified_base (345)..(345): a, c, t, g, unknown or other
  modified_base (419)..(419): a, c, t, g, unknown or other
  modified_base (472)..(472): a, c, t, g, unknown or other
tcagcgcagtacgacacgaccggtgctcgatttagcgtcgatctcaggggaggaactgctcagttaggacccagagggaaccatggaagccccagctcagcttctcttcctcctgctactctggctcccagatggtaccgagaaagtgtattgacacagtctccaggcaccctgtctttgtctccatgagagagggccaccctctcctgcagggccagtcagaatattacctctactgctgtacaacaaaacnnccagctccagctcctcatctatgatgcatccaatcgggccactggcactcccagccaggttcagtggcagtgggtctgggacagaacttcnctctcacccatcagacaacctagagcctgaagtactttgactagtttatactgtcagcagcgtagtaagtggcnccgttcggaccaagggacacgtactaggaacggttaaaacgaactggttcggnttcgacacttagttcttgttctactctcccttcccgactaacttctg

SEQ ID NO: 385866 - DNA, 490 bp, Homo sapiens
  misc_feature: GZ8MTXP01DPIRI.52.10.A10.1.454.CMB.2.raw
  modified_base (275)..(275): a, c, t, g, unknown or other
  modified_base (445)..(445): a, c, t, g, unknown or other
  modified_base (449)..(449): a, c, t, g, unknown or other
  modified_base (459)..(459): a, c, t, g, unknown or other
  modified_base (466)..(466): a, c, t, g, unknown or other
  modified_base (471)..(472): a, c, t, g, unknown or other
  modified_base (479)..(479): a, c, t, g, unknown or other
  modified_base (490)..(490): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccacctctcctgcagggccagtcagaatattacctcttacctggcctggtaccaaacaaaacctgccagctccagcnctcatctatgatgcatccaatcggcactggcatcccagccagttcagtgcagtggtctgggacagacttcactctcaccatcagcaactagagctagaagtctttgctagtttatactgtcagcagcgtagtagtggctctcggccaagggcacgactggagttaaacgngtgnggctgcactnttcgttnttctnntcctccnttatcgttgtn

SEQ ID NO: 385867 - DNA, 538 bp, Homo sapiens
  misc_feature: GZ8MTXP01ADA3G.52.10.A10.1.454.CMB.2.raw
  modified_base (276)..(276): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagaggccacctctcctgcaggccagtcagaatattacctcttacctggcctggtaccaacaaaacctgcccaggctcccaggcncctcatctatgatgcatccaatcggccactggcatccagccaggttcagtgcagtcggtctgggacagacttcactctcaccatcagcaacctagacgcctagaagtactttgactagtttatactgtcagcagtcgtagggtaagtggactcgttacggccaaggggaccaccggactacggggaaggttaaacgaacgtggtagggctggaccgtacctattccgttgttcttcgattccttccccgcttatccttgtaa

SEQ ID NO: 385868 - DNA, 532 bp, Homo sapiens
  misc_feature: GZ8MTXP01D6DOY.52.10.A10.1.454.CMB.2.raw
  modified_base (280)..(280): a, c, t, g, unknown or other
  modified_base (528)..(528): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaaacaaaacctgcccaggctcccaggcncctcatctatgatgcatccaatcggcactggcatcccagccaggttcagtggcaggtggtctgggacagacttcactctcacccatcagcaaacctagacgcctagaagtctttgactagttttattactgtcagcagcgtaggtaagtggcgcgttcggcaaggggacaacgacgtagggaacggttaaacgaacgtggtagctcgcaccgtattcttgttcttcacttccttccccgcttacttcngtaa

SEQ ID NO: 385869 - DNA, 540 bp, Homo sapiens
  misc_feature: GZ8MTXP01AMHWQ.52.10.A10.1.454.CMB.2.raw
  modified_base (494)..(494): a, c, t, g, unknown or other
  modified_base (535)..(535): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaaacaaaacctgcccaggctcccaggcctcctcatctatgatgcatccaagtccggccactggcactcccagccctaggttcagtggcaggtcggtctggggacagcttcactctcaccatcagacaaacctagacgtcctaggaagtactttgacttaagttttatactgtcagacagtcgtaaggtagtggcgtcgttcggaccgaagggcaacggcgtagggtaagttaaaccgagtgnggctgctacattcgttcttctcacttcccttccgcacttcncgtaa

SEQ ID NO: 385870 - DNA, 544 bp, Homo sapiens
  misc_feature: GZ8MTXP01A9ZFR.52.10.A10.1.454.CMB.2.raw
  modified_base (346)..(346): a, c, t, g, unknown or other
  modified_base (354)..(354): a, c, t, g, unknown or other
  modified_base (358)..(358): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagacggccaccctctcctgcagggccagtcagaatattacctcttacctggcctaggtaaccaaacaaaacctgcccaggctcccagctcctcatctatgatgcatccaatcggccactgcatcccagccagttcagtgcagtgggtctggacngaacttcnctcncacagtacagactaaaccgtagagtaccgtagaaacgtctttagacttaaggttttactacgtgtcaagcgtaaggtacggtagtaaggtcgcgtcgtcggaccaagggacacgtacgtagggaaacgttaaacaagtgttggcttggacacattcttagtctcaattccctccgctaattcgtaa

SEQ ID NO: 385871 - DNA, 528 bp, Homo sapiens
  misc_feature: GZ8MTXP01AXI9I.52.10.A10.1.454.CMB.2.raw
  modified_base (279)..(279): a, c, t, g, unknown or other
  modified_base (432)..(432): a, c, t, g, unknown or other
  modified_base (487)..(487): a, c, t, g, unknown or other
  modified_base (515)..(515): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccaggcncctcatctatgatgcatccaatcggccactggcatcccagcaggttcagtgcaggtcggtctgggacagacttcactctcaccatcagcaacctagcgcctaggaagtactttgctaagtttacttactgtcagcagtcgtaggtaagtggcncgttacggcaaaggggacaaggactgggaacggttaaacgactggtaggctgacnccagttcttgttcttcactcccgttccnccttatcttgtaa

SEQ ID NO: 385872 - DNA, 523 bp, Homo sapiens
  misc_feature: GZ8MTXP01EIRCA.52.10.A10.1.454.CMB.2.raw
  modified_base (274)..(274): a, c, t, g, unknown or other
  modified_base (496)..(496): a, c, t, g, unknown or other
  modified_base (501)..(501): a, c, t, g, unknown or other
  modified_base (510)..(510): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctctactggcctggtaccaacaaaacctgcccagctccagcnctcatctatgatgcatccaatcggccactggcactcccagccaggttcagtggcagtgggtctgggacagacttcactctcaccatcagcaacctagacgctagaagtactttgactagtttattactgtcagcagcgttaggtaagttggacgtcgttcggaccaaggggacaacggacgtaggaaggttaaacgacgtgtgggactgcaccgattcgttnttctnctcctcccncttactcttgtaa

SEQ ID NO: 385873 - DNA, 541 bp, Homo sapiens
  misc_feature: GZ8MTXP01DBJKS.52.10.A10.1.454.CMB.2.raw
tcagcgcagtacgacacgaccggtgctcgatttagcgtcgatctctgggggaggaactgctcagttaggacccagagggaaccatggaagccccagctcagcttctcttcctcctgctactctggctcccagatggtaccggagaaagtgtattgacacagtctccaggcaccctgtctttgtctccatgagagaggccaccctctcctgcagggccagtcagaatattacctcttacctggcctggtaaccaacaaaaacctgcccaggctcccaggctcctcatctatgatgcatccaatcgggccactggcatcccagccaggtccagtggcaggtgggtctggggacagaacttcaactctcaccatcagcaaacctagagcctagaagtactttagactagtttattactgtacagacagcggtagtaagtggcgcgttccggactaaggggaccagacgtagggaacggttaaaacgaacgtggttggacttgactaccagttcttgtcttcaatccttcccgctaagttctaag

SEQ ID NO: 385874 - DNA, 544 bp, Homo sapiens
  misc_feature: GZ8MTXP01EKO7K.52.10.A10.1.454.CMB.2.raw
  modified_base (235)..(235): a, c, t, g, unknown or other
  modified_base (356)..(356): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctnttacctggcctggtaaccaacaaaaacctgcccaggctcccaggctctcatctatgatgcatccaatcgggcactggcatcccagccaggttcagtgcagtgggtctgggacagaacttcnctctcaccatcacgacaaacctagacgcctagaagtactttgactagtttatactgacagtcagtcggtagtaagtgcgtcgttcggccaagggaccagtacgtagggtaacggttaaacgaacgttggttggacttgcctaaccagttcttgtaaccttcaacttcctcccgactaacgttcttaag

SEQ ID NO: 385875 - DNA, 568 bp, Homo sapiens
  misc_feature: GZ8MTXP01CGGNX.52.10.A10.1.454.CMB.2.raw
  modified_base (366)..(366): a, c, t, g, unknown or other
  modified_base (512)..(512): a, c, t, g, unknown or other
  modified_base (555)..(555): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagaggccaccctctcctgcagggccagtcagaatattacctcttacctggcctaggtaaccaaacaaaacctgcccaggctcccaggctcctcatctatgatgcatccaatcgggccactggcactcccagccaggttcagtggctaggtggggtctggggacagtaaccttcnctctcacatcagcaacctagacacctagaactactttgacttaagttttatactgtcaagctaagtcgggttaaggtaagtcggacgtcgttaccggaccgaaaggggaccacggtacgtagggtaaacgttaaacgaacgttggnggacttgacctacttagttcttgtccttcaacttcccgtcccncctaattcgtaag

SEQ ID NO: 385876 - DNA, 539 bp, Homo sapiens
  misc_feature: GZ8MTXP01BQX60.52.10.A10.1.454.CMB.2.raw
  modified_base (360)..(360): a, c, t, g, unknown or other
tcagcgcagtacgacacgaccggtgctcgatttagcgtcgatctcagggggaggaactgctcagttaggacccagagggaacaatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttacctggcctggtaccaacaaaacctgcccaggctcccaggctcctcatctatgatgcatccaatcgggccactggcatccccagccaggttcagtggcaggtgggtctggggacagaaccttnctctcaccatcagcaacctgagcctgaagactttgactagtttatctgtcagcagcggtagtaagtggcgcgttcggccgaagggacacgtacgtgggaacggttaaacgaacgttggttcggacttcgcaacccttattcgttcgttccttcaacttccttccgttgcccttaagttc

SEQ ID NO: 385877 - DNA, 520 bp, Homo sapiens
  misc_feature: GZ8MTXP01EZ3D0.52.10.A10.1.454.CMB.2.raw
  modified_base (486)..(486): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagaggccaccctctcctgcagggccagtcagaatattacctctactggcctgtaccaacaaaactgcccagctccaggctcctcatctatgatgcatccaatccgggccactggcactcccagccaggttcagtggcagtgggtctgggacagaacttcaactctcaccatcagacaaacctagacgcctagaacgtactttgactagtttatactgtcagcagcggtagtaagtggcgcttcggcgaagggacacgtagtaggacggttaaacgaacgtgttggcttgcacgnttcttgtctcaacttcctcccgctaattcgtaag

SEQ ID NO: 385878 - DNA, 559 bp, Homo sapiens
  misc_feature: GZ8MTXP01DF7LP.52.10.A10.1.454.CMB.2.raw
  modified_base (534)..(534): a, c, t, g, unknown or other
tcagcgcagtacgacacgaccggtgctcgatttagcgtcgatctcaggggggaggaactgctcagttaggacccagagggaaccatggaagccccagctcagcttctcttcctcctgctactctggctcccagatggtaccggagaaagtgtattgacacagtctccaggcaccctgtctttgtctcatgagagacgggccaccctctcctgcagggccagtcagaatattacctcttacctggcctggtaaccaacaaaaacctgcccaggcctcccaggcctcctcatctatgatgcatccaatcgggccatggcactcccagcctaggttcagtggctaggtgggtactggggacagtaccttcaactctacaccatcagacaaacctagacgtcctagaagtactttgacttagtttaattactgtcagcagtcggtagtaagtggcgtcgttccggacgaaggggacacggtacgtagggaacgtttaaacgaacgtggttcggcttggaccacttattcgttactctntaacttcctccgcctaagttctaag

SEQ ID NO: 385879 - DNA, 606 bp, Homo sapiens
  misc_feature: GZ8MTXP01DE42J.52.10.A10.1.454.CMB.2.raw
  modified_base (554)..(554): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggcccaccctctcctgcagggccagtcagaatattacctcttactggcctggtaccaacaaaacctgcccaggctcccaggctcctcatctatgatgcatccaagtccggccacgtggcactccccagccaggtttcaggtggcaggtcgggtcgtgggacagacttcactctcaccatcacgcaaactagacgtcctagaacgtctttggacttaagttttactctggtcagtctagtaccgtaaggtacgtgggcctacgttacggaccaaagggggtaccaacgacgtaagggggtaaacggttaaaaccgacgttaagggtcgttacgtacggaccctaacgactttccggttntttccctttcaacctttccccgtttcccccgccttatttccgttcggtaaac

SEQ ID NO: 385880 - DNA, 534 bp, Homo sapiens
  misc_feature: GZ8MTXP01AP8QR.52.10.A10.1.454.CMB.2.raw
  modified_base (349)..(349): a, c, t, g, unknown or other
  modified_base (364)..(364): a, c, t, g, unknown or other
  modified_base (385)..(385): a, c, t, g, unknown or other
  modified_base (422)..(422): a, c, t, g, unknown or other
  modified_base (490)..(490): a, c, t, g, unknown or other
  modified_base (494)..(494): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagaggccaccctctcctgcagggccagtcagaatattacctctacctggcctggtaccaacaaaacctgcccaggctcccaggcctcctcatctatgatgcatcccaagtccgggaccacgtcggcactcccagccaggttcagtggcaggtgggtntggggacagacttcnctctcaccatcagcaaacctnagcctagaacgtctttgacttagtttactactgacancagacgggtagtaagtggcgtcgttaccggccgaaggaccagtacgtaggaacgttaaacgaattggngtcngtcacttgttcttcgtctctaactcctccttctgttcgtg

SEQ ID NO: 385881 - DNA, 578 bp, Homo sapiens
  misc_feature: GZ8MTXP01EBCWI.52.10.A10.1.454.CMB.2.raw
  modified_base (284)..(284): a, c, t, g, unknown or other
  modified_base (467)..(467): a, c, t, g, unknown or other
  modified_base (564)..(564): a, c, t, g, unknown or other
  modified_base (573)..(573): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagacgggccaccctctcctgcagggccagtcagaatattacctcttacctggcctaggtaaccaaacaaaacctgcccaggctccagctccnatcatgatgcatccaagtccggaccacgtggacactcccgagtcccaggttcagtggcgtaggtcgggtctggggactacgtacttccaacttctacaacctatcaacgtaccaaaccgtagacgtcctagaacgtactttgacttaagttttatactgtcagctagtcggtaaggtaacggnggcgtcgttcggaccgaagggaccaacggtacgtaagggtaacggttaaacgacgtggtgctgacacctattccgttgttcctcgacttccgtcccncttattcgngtaac

SEQ ID NO: 385882 - DNA, 537 bp, Homo sapiens
  misc_feature: GZ8MTXP01AQS0E.52.10.A10.1.454.CMB.2.raw
  modified_base (282)..(282): a, c, t, g, unknown or other
  modified_base (340)..(340): a, c, t, g, unknown or other
  modified_base (347)..(347): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagaggccacctctcctgcagggccagtcagaatattacctcttacctggcctggtaaccaacaaaacctgcccaggctcccaggctcctnatctatgatgcatccaatcgggccactggcatcccagccaggttcagtgcaggtggtntgggacngaacttcaactctcacatcacgcaaccgtgacgcctagagtactttgactagtttatactgtcagcagtcggttaagtaagtggccgtcgtcggccaagggacacgtaaccgtgggtaacggtaaaccgaagtgttaggcttggacaccgttattcttcgtcttcaacttctcccgactaattccgtaag

SEQ ID NO: 385883 - DNA, 587 bp, Homo sapiens
  misc_feature: GZ8MTXP01CLJAI.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagacggccaccctctcctgcagggccagtcagaatattacctcttacctggcctaggtaaccaaacaaaacctgcccaggcctcccaggcctctcatctatgatgcatccaatccggccacgtggcactcccagcctaggttcaggtggctaggtgggtctgggacagaacttcaactctacacctatcaacgacaaacctagacgcctagaacgtacctttgacttaagtttactacttgacagactaggtacggtaagttaaggtcggcgtccgttcggaccaaggggaccacggtaacgtagggtaaacggttaaaccgaagttggcggtcttcggacctaccgttattccttacgttcctactaacttcccttcccgactaacgttctaag

SEQ ID NO: 385884 - DNA, 577 bp, Homo sapiens
  misc_feature: GZ8MTXP01BT12K.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttactggcctgtaaccaaacaaaacctgccaggctcccaggctcctcatctatgatgcatccaagtccggccactggcatccccagccaggttcaggtggacgaggtgggtcgtggggaacaggtaaccttcaactctacacccatcacgacaaacctagacgcctagaaagtactttgacttagttttaatcgtgtcaggtacaggtcggtaagtaaggtcggacgtctcggaccgaagggaccacgtacgtaggaaacggttaaacgaacgttaggttcgggcttaggacctaccttagttccttagtccttactaacttcttcccgctaacttcgtaag

SEQ ID NO: 385885 - DNA, 518 bp, Homo sapiens
  misc_feature: GZ8MTXP01BSI1E.52.10.A10.1.454.CMB.2.raw
  modified_base (282)..(282): a, c, t, g, unknown or other
  modified_base (477)..(477): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccaggctccncatctatgatgcatccaatcggccactggcatcccagccaggttcagtgcagtcggtctgggacagactcactctcaccatcagcaaacctagacgtcctagaacgtactttgactagtttacttactgtcagcagcgtagggtaagtggcgcgttcggccgaagggcacgacgtaggagttaaacgactgtggntgcgcattcgttgttctcatccttcccgcttatcttgtaac

SEQ ID NO: 385886 - DNA, 619 bp, Homo sapiens
  misc_feature: GZ8MTXP01C0XTW.52.10.A10.1.454.CMB.2.raw
  modified_base (600)..(600): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggcccaccctctcctgcagggccagtcagaatattacctcttacctggcctggtaaccaaacaaaacctgacccaggcctccgtaggcctcctcattctatgaatcgctatacccaaagtccggggacccacgtggaccactccccagcctaggttcaggtggcgtaggtcgggtctggggacaggtaccttcacttctcaacccatcagacaaacctagagacctagaagtacctttgacttagtttaacttactgtacagtcgagtacgttaagggttaacggtgggccgtacggttccggaccgaaagggtaccgaacggtacgtagggaaacggttaaacgagttgggtagctcggactaaccgtagttccttgttaccttcctacttcccgttccccgnttacttcgttaacgtaacg

SEQ ID NO: 385887 - DNA, 682 bp, Homo sapiens
  misc_feature: GZ8MTXP01DA74X.52.10.A10.1.454.CMB.2.raw
  modified_base (280)..(280): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaaacaaaacctgcccaggctcccaggcncctcatctatgattcatcaactcggccgactacgcgactacccacgcccgacgtcgtagtacggtcgacgtggggttccggtcgggacgacgtaaccgttcctaacctaccttccacctaactaccgtacgaccgaaaccctaacggaacgacccgttagtaaacgtaacgtttagttaccgttaaggttttaattttaacgtttacgttacgacgtacgacggtaacggttacggttaaaggggttacgggtcggtaccgttcgggtaccgaacgggtaacgaccggtaacgtagggtaaacgggttaaacgtaaaccgtagtggtacgttgtccaaccgtatcttacgttctttcctaacttccctttccccgacccctattaccgttgttaacgttaac

SEQ ID NO: 385888 - DNA, 527 bp, Homo sapiens
  misc_feature: GZ8MTXP01DNKWP.52.10.A10.1.454.CMB.2.raw
  modified_base (234)..(234): a, c, t, g, unknown or other
  modified_base (239)..(239): a, c, t, g, unknown or other
  modified_base (335)..(335): a, c, t, g, unknown or other
  modified_base (431)..(431): a, c, t, g, unknown or other
  modified_base (444)..(444): a, c, t, g, unknown or other
  modified_base (514)..(514): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatatacctnttacnggcctggtaccaacaaaactgcccaggctccagctcctcatctatgatgcatccaatcgggccactggcatcccagccagttcagtgcagtgggtntggggacagaacttcaactctcaccatcagcaaacctagagcctaggaatactttgactagttttatactgtacagctagcggtagtaagtgcgtntcggctaaggacncgtactggaacggttaaacgaacttggttaggcttgcaccattcttacgtcttacaacttcttccccggntaacgttcgttaa

SEQ ID NO: 385889 - DNA, 543 bp, Homo sapiens
  misc_feature: GZ8MTXP01BIBY9.52.10.A10.1.454.CMB.2.raw
  modified_base (241)..(241): a, c, t, g, unknown or other
  modified_base (278)..(278): a, c, t, g, unknown or other
  modified_base (344)..(344): a, c, t, g, unknown or other
  modified_base (374)..(374): a, c, t, g, unknown or other
  modified_base (477)..(477): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttaccnggcctggtaccaacaaaacctgccaggctcccaggcnctcatctatgatgcatccaatcggcactggcatcccagccaggttcagtgcagtcgggctggggangacttcactctcacatcagcaaactagacncctagaagtctttgactaagttttattacgtgtacagcagcgttagggtaagtggtcgacgttcggaccgaagggacaacggtagtagggaaagtttaaacgngtgtaggctacggctacccgattccttggttccttctacgttccttcccgccttagtccttgtaac

SEQ ID NO: 385890 - DNA, 560 bp, Homo sapiens
  misc_feature: GZ8MTXP01A7T0E.52.10.A10.1.454.CMB.2.raw
  modified_base (278)..(278): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccacctctcctgcagggccagtcagaatattacctcttacctggcctggtaccaacaaaacctgcccaggctcccaggcncctcatctatgatgcatccaaatcggccacgtggcatcccagccaggttcagtggcaggtcggctgggacagacttcactctcaccatcagcaaacctagacgcctagaagtacctttggacttaagtttacttactgtacagtcaagtcgtaagggtaagtggacgtacgttcggacccgaaggggtacaacggacgtgggaaacggttaaacgaacgtggtggctgcctaaccgtattcgttcgttcttcattccttacccgccttatccgttaagtaag

SEQ ID NO: 385891 - DNA, 679 bp, Homo sapiens
  misc_feature: GZ8MTXP01DESTV.52.10.A10.1.454.CMB.2.raw
  modified_base (276)..(276): a, c, t, g, unknown or other
  modified_base (279)..(279): a, c, t, g, unknown or other
  modified_base (285)..(285): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggcccacctctcctgcagggccagtcagaatactacctcttactggcctaggtaccaaacaaacctgccaggctccagcnctnatctangatgcatccaagtccggccacgtggacactcccagtccagggttccaggtggcgtaggtcgggtctaggggactacgtacctttccactctaccaccaatccaacgacctaaaccgtagacgtacctaaggtaacgtacttttgaaccgttaaggttttactaacgtggtaccaagggtcctaaggtccgggttaaaggggttaacggtcggggtaccgttacggttaaccgggacccgtaaagggggtacctaaacgggtacgttaagggggtaaacggttaaaccgtaaggttcgggtacggttacgttacggacctaaacgtcgtttacgttcggtttaaaccttccgtaaactttccccggtttaccccgacttacgttcgttaagtaac

SEQ ID NO: 385892 - DNA, 624 bp, Homo sapiens
  misc_feature: GZ8MTXP01CVOXP.52.10.A10.1.454.CMB.2.raw
  modified_base (388)..(388): a, c, t, g, unknown or other
  modified_base (402)..(402): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagacgggccaccctctcctgcagggccagtcagaatattacctcttacctgcctgtaaccaaacaaaacctgcccaggcctcccaggcctcctcatctatgatgcatccaatccggggccacgtggccactccccagcctaggttcagtggcagggtgggtctggggacagtaaccttcaactctccaccatccanaccaaacctagacncctagactactttgacttagtttatacgtgtacagtcagtacggttaaggtaggtcggaccgtcgttaccggaccgtaaaggggaccaacggtacgtaaggggtaaacggttaaaaccgggcttaggggttcggtaccgacggtacctaaccccgttgtttccgttcgtttcccttaccttaaccgttccccgttccccggacccttaaggttcctttaagg

SEQ ID NO: 385893 - DNA, 711 bp, Homo sapiens
  misc_feature: GZ8MTXP01BJ8O0.52.10.A10.1.454.CMB.2.raw
  modified_base (277)..(277): a, c, t, g, unknown or other
tcagcgcagtacgacacgaccggtgctcgatttagcgtcgatctcaggggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttactggcctggtaccaacaaaacctgccaggctccaggcncctcatctatgattcgactcaactcggcccgactcggcgactccacgaccgacggttacgtaggtggcgagtacggggtcgtgggacgacgacgttcctaactctccacctactacacgaccaacctaacgacgaccgtacgtaacggtaacgtttcgttacgtaacgttttaagtttacttcgttacgtacgacgtaacggtacgttaaccggtaagggggttacgggtccgggtaccgtttacccgggaccggtaaaccgggaaccggaaccggtaacggtacgggtaaacgggttaaaacgggtaaacgtcgggttcgggtacgttcgggtaccgttaccctaacgttaaccgtttcggtttacctttcccgtaacctttccccgttaaccccgtccccgtaaactttccgttaaggttaactttaaaccg

SEQ ID NO: 385894 - DNA, 580 bp, Homo sapiens
  misc_feature: GZ8MTXP01EQ5Y7.52.10.A10.1.454.CMB.2.raw
  modified_base (233)..(233): a, c, t, g, unknown or other
  modified_base (511)..(511): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagatatacctntactgctgtaccaacaaactgccagctccagctctcatctatgatgacatccaatccgggccacgtggcatcccagccaggttcagtgcaggtggtatgggactagaaccttcgaacttctaccaccagtccaacgcctaaacctagacgtcccgtagaaaggttcctttaggaccttaagttttactacgtgttacagacagtacggtaagtaagtggcgcgttcggaccgaagggtaccacggtaaccgtgggtaaacggttaaacgaacgttggnggaccgttgactaccgttagttcgttagtccttactaacgtttccctaccccgactaagttccgttaag

SEQ ID NO: 385895 - DNA, 574 bp, Homo sapiens
  misc_feature: GZ8MTXP01AGBBU.52.10.A10.1.454.CMB.2.raw
  modified_base (276)..(276): a, c, t, g, unknown or other
  modified_base (356)..(356): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagaggccaccctctcctgcagggccagtcagaatattacctctactggcctggtaccaacaaaacctgcccaggctccagctcncatctatgatgcatccaagtcgggccacgtggcactcccagccaggttcagtggcaggtgggtcgtgggacagtacttcnctctccaccatcagacaaacctagacgcctaggaacgtactttgacttagttttaacttacgtggtacagctaggtacgggtagtaagggtcgcgtcgttcggaccgaaaggggtccacggtacgtagggtaaacggttaaacggaacgtggttacggcttggacctaaccttgttcttgttcctctaacttccccgttcccgactaacttccgtaag

SEQ ID NO: 385896 - DNA, 499 bp, Homo sapiens
  misc_feature: GZ8MTXP01B4NHK.52.10.A10.1.454.CMB.2.raw
  modified_base (268)..(268): a, c, t, g, unknown or other
  modified_base (271)..(271): a, c, t, g, unknown or other
  modified_base (366)..(366): a, c, t, g, unknown or other
  modified_base (455)..(455): a, c, t, g, unknown or other
  modified_base (462)..(462): a, c, t, g, unknown or other
  modified_base (475)..(475): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagaggccaccctctcctgcagggccagtcagaatattacctctactgcctgtacaacaaacctgccagctccagcnctnatcatgatgcatccaatcggccactggcatcccagccaggttcagtggcagtcggtctgggacagacttcactctcaccatcagcaaacctagancctagaagtactttgctaagtttattactgtcagcagtcgtagtagtggcgtcttcggcaagggcacgacgtggagttaacgatgtggntgcactnttcgttgttctcnctcccttcccgcttatcgttgtaa

SEQ ID NO: 385897 - DNA, 601 bp, Homo sapiens
  misc_feature: GZ8MTXP01B6OJN.52.10.A10.1.454.CMB.2.raw
  modified_base (208)..(208): a, c, t, g, unknown or other
  modified_base (240)..(240): a, c, t, g, unknown or other
  modified_base (260)..(260): a, c, t, g, unknown or other
  modified_base (267)..(267): a, c, t, g, unknown or other
  modified_base (273)..(273): a, c, t, g, unknown or other
  modified_base (275)..(275): a, c, t, g, unknown or other
  modified_base (300)..(300): a, c, t, g, unknown or other
  modified_base (329)..(329): a, c, t, g, unknown or other
  modified_base (345)..(345): a, c, t, g, unknown or other
  modified_base (372)..(372): a, c, t, g, unknown or other
tcagcgcagtacgacacgaccggtgctcgatttagcgtcgatctcaggggggaggaactgctcagttaggacccagagggaaccatggaagccccagctcagcttctcttcctcctgctactctggctccagatggtaccggagaaagtgtattgacacagtctccaggcacctgtctttgtctcatgagagacggcccacctctccngcagggcagtcaagaatacttacctcttaccnggcctagaaccaaacaaacngccagcnccagcncnatcatgatgcatccaatccggcacngcactccagccagttcagtggcaggtggntgggacagtaacttcnctctacaccatcacgacaacctagacncgtagtaacgtacctttgactttagtttactactagtcagacgtaaggtacgggttaaggttaacggcgggtccgtaccggtttaccgggaaaccccggtaaaggggaacccgtaaacggaccggttaaaggggtaaacggttaaaacgaacggttggttacggcgttcggacctacttacgttccttacgtttcttactaacgtttccctcccgactaactttcgaag

SEQ ID NO: 385898 - DNA, 585 bp, Homo sapiens
  misc_feature: GZ8MTXP01AU8DM.52.10.A10.1.454.CMB.2.raw
  modified_base (280)..(280): a, c, t, g, unknown or other
  modified_base (284)..(284): a, c, t, g, unknown or other
  modified_base (527)..(527): a, c, t, g, unknown or other
  modified_base (548)..(548): a, c, t, g, unknown or other
  modified_base (555)..(555): a, c, t, g, unknown or other
  modified_base (569)..(569): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagacggcccaccctctcctgcagggccagtcagaatattacctcttacctggcctggtaaccaacaaaacctgcccaggcctccagcncctnatctatgatgcatccaatccgggaccacgtcggacactcccagccctaggttcagtggcaggtcgggctggggacagtacttcactctacaccatccagtaccaaactagactactagaacgtactttagacgttaagtttacttatgtaccgagtacgacgtacgttaaggggtaacggttcggggacgtccgttacggggaccgaaagggaccgacggacgtaaggggaacggttaaacgngttggtggctagccaaccgtnttcgttnttctcactcctccncttactcgttaagtaa

SEQ ID NO: 385899 - DNA, 686 bp, Homo sapiens
  misc_feature: GZ8MTXP01DYSCN.52.10.A10.1.454.CMB.2.raw
  modified_base (627)..(627): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggccaccctgtctttgtctccgaggagaggacgggcccaccctctcctgcagggccagtcagaatattacctcttactggcctaggtaaccaaacaaacctcgaccacggcctacccgaggcctcctacactctatgactgcactccaacgtccggacctacgtcggacactcccgagtccgaggtttcaggtggcgtagggttcgggtacgtagggacctagtaccctttaccaacttcctacaacccctatccaacgacctaaaccgtagacgtacctagaacgttactttggacttaaggtttttactacgtcgtacgacgtacgtagtacggttaaggggtaaacggggtcgggtaccggttacccggttacgggaaccgaaacgggggtactaaacgggtacgtaaggggtaaacggttaaacggacgttcgggtgccgtacgactaaaccgttnttccgttcttaacccttctaccttcccggtttccccgaacttcttccgttggttaaacc

SEQ ID NO: 385900 - DNA, 611 bp, Homo sapiens
  misc_feature: GZ8MTXP01DPQT0.52.10.A10.1.454.CMB.2.raw
  modified_base (353)..(353): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagaggccaccctctcctgcagggccagtcagaatattacctcttacctggcctgtaccaacaaaacctgcccagctcccagctcctcatctatgatgcatccaatccggcactgcactcccagccaggttcagtggcaggtgggtctgggacagaacttcnctctcaccatcagtacaaacctagacgcctagaagtactttgacttagtttaattacgtgtacagacagtacgggttaagttaaggtggtaccgtacgttaccgggaccgaaagggggaacccacgggtaaccgtagggtaaacgggttaaaacgaacgttaggttacgggtcttacgggaccaacccgttattccgttggtttaacccttacctaaccgtttccccttaccccggttacctaacgtttcccgttaag

SEQ ID NO: 385901 - DNA, 693 bp, Homo sapiens
  misc_feature: GZ8MTXP01BU0YI.52.10.A10.1.454.CMB.2.raw
  modified_base (238)..(238): a, c, t, g, unknown or other
  modified_base (680)..(680): a, c, t, g, unknown or other
tcagcgcagtacgacacgaccggtgctcgatttagcgtcgatctcaggggggaggaactgctcagttaggacccagagggaaccatggaagccccagctcagcttctcttcctcctgctactctggctcccagatggtaccggagaaagtgtattgacacagtctccaggcaccctgtctttgtctccatgagagacggccaccctctcctgcgagggccagtcagaatacttacctnttacctggcctggtaaccaaacaaaacctgacccaggctcccaggcctcctcatctaatgatgcaactccaagtccgggacccacgtcggcactccccagccgtaggttcaggtcggcgtacggtcggggtcgtgggggaactacggtaaacccttccaaccttcctaccaaccctactaccgaacggacccaaaacccgttagacgtacccgttagggtaaacttaccgttttaggtaacctttaaggttttttacttaacgtcgttaccgaaggtaccgtaagggtcggggttaaaggttaacggggtcggtacccggtaccgttaccgggacccgaaagggggaaccctacggtaacggttagggtaaacggttaaaccgtaagtacggttggtacttcggacacgttattcttcgttcttccgaatttccccgtaccncctaagttctaag

SEQ ID NO: 385902 - DNA, 776 bp, Homo sapiens
  misc_feature: GZ8MTXP01B0Q47.52.10.A10.1.454.CMB.2.raw
  modified_base (286)..(286): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagacggtaccggagaaagtgtattgacacagtctccaggcaccctgtctttgtctccaggagagagggccaccctctcctgcagggccagtcagaatattacctcttacctggcctggtaccaaacaaaacctgacccaggcctcccaggcctccncatctatgatgcatcccaatccgggccacgtcggcactccccagcccgtaggttccaggttcggcgtaggtcggggtccgtaggggactaggtaccctttaccaacccttccctaacccaaccctacgttaccaacgaccctaaaacccgttagaaccgtaccctaggtaaacggttaacctttgggtaccttaagtttttaacttacgttcgttacgacggaccgtaaggtacggttaaggttaaacgggggttcggggacccggttaccggtttaacccggggaacccggtaaacgggggtaacccgaaaccgggtaacggttaacgggggtaaacggggttttaaaaaccggaaccggtttgggtaacgggtaccgttacgggacccgttaaccgttaactttcgggttcgtttacccttaccgttaacccgtttccccttaacccccggtacccttaacgttcccttaaggttaactttaaccggg

SEQ ID NO: 385903 - DNA, 581 bp, Homo sapiens
  misc_feature: GZ8MTXP01EMCYZ.52.10.A10.1.454.CMB.2.raw
  modified_base (278)..(278): a, c, t, g, unknown or other
  modified_base (282)..(282): a, c, t, g, unknown or other
  modified_base (506)..(506): a, c, t, g, unknown or other
tcagcgcagtacgacacgaccggtgctcgatttagcgtcgatctcaggggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggcccaccctctcctgcagggccagtcagaatattacctcttactggcctgtaaccaaacaaaactgaccagctccaggcncctnatctatgatgcatccgaatccggcactggcactcccagcctaggttcagtggcaggtgggctaggggacagtaccttcactctacaccatcacgacaactagacgcctagagtactttgactttaagtttattactgtcaagtcagtacgtaggggtaagtgggctcgttacggaccgaagggaccgaacggtacgtaggggtaaacgttaaacgaacgttggnggttcgtcgaccgaccgtacgttcgttcgttacttctaccttcccgttacccgtacttacgttcgttaagtaacg

SEQ ID NO: 385904 - DNA, 563 bp, Homo sapiens
  misc_feature: GZ8MTXP01DH36G.52.10.A10.1.454.CMB.2.raw
  modified_base (280)..(280): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaaacaaaacctgacccaggctcccagcncctcatctatgatgcatccaaatcggccacgtgcatcccagccaggttcagtgcaggtcgggctagggacagacttacactctacaccatcacgacaaacctagacgcctagaacgtctttgactaagttttattactgtacagtcagtacgtaagggtaaggtcggtacgtcgttacggacccgaaaggggacctaacgtacgtagggtaaagttaaaccgaagtgtggctcgacactattcttgttcctttcaccttcccttcccgcttattccttgtaac

SEQ ID NO: 385905 - DNA, 569 bp, Homo sapiens
  misc_feature: GZ8MTXP01CAKPA.52.10.A10.1.454.CMB.2.raw
  modified_base (270)..(270): a, c, t, g, unknown or other
  modified_base (273)..(273): a, c, t, g, unknown or other
  modified_base (279)..(279): a, c, t, g, unknown or other
  modified_base (355)..(355): a, c, t, g, unknown or other
  modified_base (375)..(375): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggcccaccctctcctgcagggccagtcagaatatacctctactgcctgtacaacaaacctgccaggctccagcnctnatctangatgcatccaagtcggccacgtgacactcccagcctaggttcagtggcaggtcgggtctgggacagacttcactcncaccatcagtacaactgacncctagaactctttgacttagttttactactgtacagtacagtacgttaagggtagtcggccgtacgtacggaccaaggggcaaccgggtataggggtaaacgttaaacgaacgtggtacggctacgccgtaacctattcccgttgttaccctctaacttcccgttaccccgaccttagttcccttaaggtaacc

SEQ ID NO: 385906 - DNA, 660 bp, Homo sapiens
  misc_feature: GZ8MTXP01B4050.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgctccatgagagaggccaccctctcctgcagggccagtcagaatattacctcttacctggcctaggtaaccaacaaaacctgcccaggctcccagctcctcatctatgatgacatccaatcgggccaacgtggcactcccagcctaggttcagtggctaggtcgggtctggggacaggtaacttcaactctcaccatcacgcaaacctgagcctagaagtctttgacttaagttttatacgtgttacacgtacgtacgtacgggttaaggttaacggtcggccggttaccgtttccgggaacccggtaaaggggtaacccgaacggtaaccgggttaaggggtaaaaccggggttttaaaacccgaaaggttcgggttacgggtaccttacggaccgtaaacccttagtttccgttaacggtttcctttacccgtaactttccccgttaccccggttaccttaacgtttcccgttaagg

SEQ ID NO: 385907 - DNA, 559 bp, Homo sapiens
  misc_feature: GZ8MTXP01D2A5F.52.10.A10.1.454.CMB.2.raw
  modified_base (271)..(271): a, c, t, g, unknown or other
  modified_base (274)..(274): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctctactgcctggtaccaacaaacctgccagctccagcnctnatctatgatgcatccaagtcggccactggcactcccagccaggttcaggtgcagtcggtctggggacagccttacactctacaccatccagacaaacgtagacgcctaggaagtacttgacttagtttatactgtcagcagacgttaggtaagtggctacgttcggaccagggacacgtacgtagggtaaggttaaaccgaagtggtaggcttacgaccgtaacctattcccgtttcgttccttaactaccgttcccgttccccgtacttacttcgttaacgtaa

SEQ ID NO: 385908 - DNA, 600 bp, Homo sapiens
  misc_feature: GZ8MTXP01CJ2PT.52.10.A10.1.454.CMB.2.raw
tcagcgcagtacgacacgaccggtgctcgatttagcgtcgatctcaggggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggcccaccctctcctgcagggccagtcagaatattacctcttacctggcctaggtaaccaaacaaaacctgacccaggcctcccaggcctcctcatctatgatgcatccaatcgggccactgcactcccagccaggttcaggtgcgaggtcgggtctggggacacggacttccgactcctacaaccatacacgtaccaaaccgtagcgtaccctaggaacgtactttagacttagttttactactgtacagtcagtacgttaggggtaacggtggaccgtcgttaccggacgaaggggacctaacggaacgtgggaaacggttaaaccgagtaacgtgggctgccgaaacctgttccttcgttaccttctacgttcccttcccgacttacgttccttggtaac

SEQ ID NO: 385909 - DNA, 559 bp, Homo sapiens
  misc_feature: GZ8MTXP01CAWWA.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatatacctcttacctggcctggtaccaacaaaacctgcccaggctcctaggctcctcatctatgatgcatccaaatccgggccacgtggcactccccagccaggttcagtggcaggtcgggtctgggacagacttcactctcacatcagcaaactgacgcctagaagtctttgactagtttatactgtcagcagtcgttagggtaagtggactcgttacgggaccaaaggggacaaccggtacgtaggggaaacggttaaaccgacgttggtggctggaccctaacgtattccgttgttccttcacttcccttccccgccttatccgttgtaac

SEQ ID NO: 385910 - DNA, 666 bp, Homo sapiens
  misc_feature: GZ8MTXP01BFYGH.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagaggccacctctcctgcagggccagtcagaatacttacctcttacctggcctggtaaccaaacaaaacctgcccagctcccagctcctcatctatgatgcatccaagtccgggccacgtcggccactccccagcctaggttccagtcggctagggtcggggtctgggggaacacggtaaccttcaaccttctaccacccatccgaacgaccaaaaccctagacgtaccctaggaacgttacctttggacttaagtttttacttactaggttccaagccgtaaggtacgggttaaggttaagggtcgggtccgtcgtttaccgggaccgtaaaggggacctaacggtacggtaagggtaaacgggttaaaaccgaacgttgggttcggcgttacggacccgtaaaccttcgttccgttcggtttaacccttctaaccgttccccgttaccccgaccttaagttcctttaaacgg

SEQ ID NO: 385911 - DNA, 559 bp, Homo sapiens
  misc_feature: GZ8MTXP01BJXXC.52.10.A10.1.454.CMB.2.raw
  modified_base (234)..(234): a, c, t, g, unknown or other
  modified_base (280)..(280): a, c, t, g, unknown or other
  modified_base (355)..(355): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagaggccaccctctcctgcagggccagtcagaatattacctnttacctggcctaggtaccaacaaaacctgcccaggctccagctccncatctatgatgcatccaatcggccactggcactcccagccaggttcagtggcaggtggtctgggacagaacttcnctctcaccatcacgcaacctagacgtcctagaactacttgactagtttatactgtacagctagcggttagtaaggtcgacgcgttccggaccgtaaaggggaccacggtaccgtagggtaaacgttaaaacggaactgggttcggaccttggacctaccgttattcgttacttctctaacttcccttcccgctaacgttctaag

SEQ ID NO: 385912 - DNA, 644 bp, Homo sapiens
  misc_feature: GZ8MTXP01AC633.52.10.A10.1.454.CMB.2.raw
  modified_base (277)..(277): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagaggccacctctcctgcagggccagtcagaatattacctctactggcctgtaccaacaaaacctgcccaggctcccagctcctnatctatgatgcatccaatcgggccacgtgcatcccagccaggttcagtgcagtggtctgggacagacttcaactctacacacgtcacgcaaaccctagacgtcctagaacgtacctttgacttagttttacttacgtagttaccagtacctaaggtccggggttaaaggtaagggttcgggccggtaccgtttaccgggggaccctaaagggggaacccaacggtaacccggttagggaaacgggtttaaaacccgtaaacggttgggttacggggaaccttgggaccctaaaaccccgttcgttccgttacgttcccttaccgtaaccgtttccccttaccccgttaccttaacgttaaccgtaag

SEQ ID NO: 385913 - DNA, 726 bp, Homo sapiens
  misc_feature: GZ8MTXP01B0PM3.52.10.A10.1.454.CMB.2.raw
tcagcgcagtacgacacgaccggtgctcgatttagcgtcgatctcaggggggaggaactgctcagttaggacccagagggaaccatggaagccccagctcagcttctcttcctcctgctactctggctccagatggtaccggagaaagtgtattgacacagtctccaggcaccctgtctttgtctccgaggagagacggcccacctctcctgcgagggccagtcaagtaattacttacctcttaccgtggtacctaggtaaccaaacaaaacctcgacccaggcctacccgacggcctcctcacttctaatgactcgactactaccaacgtccggaccacgtcggacacctcccgagccgtaggttcaggtgcgtagggtcggtcgtaggggactacggtaccttacaccttcctacaaaccactaccgaacgaccaaactagaccgtacgtaagtaacggttacctttagaccgtttaaggttttacttacgtcgtacgaacggtacgaagggttaccggttaaaggggtaacggttcgggaccgttaccggttaccggaaccggtaaacggggacctaaacggtacggttaaggggtaaaacggtttaaccggaagttgggtcggttacgtcggttaacctaaccggttacttccggtttcgttccgtttaaccctccggtttcccctttaccccggacttactttcccggttaagtttaaccg

SEQ ID NO: 385914 - DNA, 607 bp, Homo sapiens
  misc_feature: GZ8MTXP01EMF8V.52.10.A10.1.454.CMB.2.raw
  modified_base (469)..(469): a, c, t, g, unknown or other
  modified_base (553)..(553): a, c, t, g, unknown or other
  modified_base (601)..(601): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccagctcctcatctatgatcatcacacggccgactgcgactccctaccgccgtacggttcgtagtaggtcggaggtcggggttccggtcggggacggagtaccgttacctaaccctcctcctaccactacacgactaaaccacgtacgaccctgtaaacggtaatttcggtactagttttaatttacttagtcgtanacgagtacgtagtaggggtcggtcggtcttacggacgaacggacgacgaacgtggtaaggttaaacggaaacgtcggtggtcgntaccgaccgtatcttcgttcttctaactcttcccgtccattcctgttnttaacg

SEQ ID NO: 385915 - DNA, 535 bp, Homo sapiens
  misc_feature: GZ8MTXP01CQH7R.52.10.A10.1.454.CMB.2.raw
  modified_base (287)..(287): a, c, t, g, unknown or other
  modified_base (334)..(334): a, c, t, g, unknown or other
  modified_base (348)..(348): a, c, t, g, unknown or other
  modified_base (475)..(475): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagaggccaccctctcctgcagggccagtcagaatattacctcttacctggcctggtaccaaacaaaacctgcccaggctcccagctctcatcatnatgcatccatcggcactgcatcccagccaggttcagtgcaggtggtntgggacagacttcnctctcacatcagcaactagagcctagaatacttgacttagtttatactgtcagcaagtcggtagtaaggtcggcgtcgttcggacgtaagggacacggtacgtaggtaaacggttaaacgaagtggnggcttcgacctaccttagttccgcgttaaccttcaacttcccgttcccactaattcgtaa

SEQ ID NO: 385916 - DNA, 684 bp, Homo sapiens
  misc_feature: GZ8MTXP01DOL6C.52.10.A10.1.454.CMB.2.raw
  modified_base (303)..(303): a, c, t, g, unknown or other
tcagcgcagtacgacacgaccggtgctcgatttagcgtcgatctcaggggggaggaactgctcagttaggacccagagggaaccatggaagccccagctcagcttctcttcctcctgctactctggctcccagatggtaccggagaaagtgtattgacacagtctccaggcaccctgtctttgtctccatgagaggacggccaccctctcctgcagggccagtcagtaattacttacctcttacctggtcctaggtaacccaaacaaaacctcgaccccaggcctcccaggctcctcatctangatgcatccaatccgggccacgtgccatcccagccaggttcagtcggcgtaggtcggggtcgtgggactacggtaaccttcaacttcctacccaaactactaccaacgaccctaaaccgtaggaactcccgtaaggtaaagttaccttttagggaacttttaaacgggttttaacttaaccgtggttacccaaggtacctaacgggttaacgggggtttaaggttaaacggggttcggaccggttaccggttcggggacccgaaaggggtaacacgggtacgtaaggggtaaacgttaaacgaacgttgggcgggacttagaccgtacttaacttcgttacgttccttactaactttccctccccgacttcttcgttaacg

SEQ ID NO: 385917 - DNA, 667 bp, Homo sapiens
  misc_feature: GZ8MTXP01BSFVO.52.10.A10.1.454.CMB.2.raw
  modified_base (381)..(381): a, c, t, g, unknown or other
tcagcgcagtacgacacgaccggtgctcgatttagcgtcgatctcaggggggaggaactgctcagttaggacccagagggaaccatggaagccccagctcagcttctcttcctcctgctactctggctcccagatggtaccggagaaagtgtattgacacagtctccaggcaccctgtctttgtctccatgagagacgggccaccctctcctgcagggccagtcagaatattacctcttacctggcctggtaaccaaaccaaaacctgcccaggcctccgagctctcatctatgatgcataccaagtccggccacgtgcactccccagccgtaggttcaggtcggcgtacgggtggggtcgtaggggacaggtaaccttcncctcctcaccatacacgactaaaccctagacgtccgtaggaacgttactttgtacttagttttacttacgtagttacgagtacgtagtcggggttaaaggttaacgggtcgggtacccggtaccgttaccgggaccgtaaacggggaaccacggtaacggttacggggtaaacggttaaacccggaagttcgggttacggtccgttacggaccctaaccgttacgttccgttacggtttcctaccgtaacctttccccgtccccgttaccttaagttcccgttaag

SEQ ID NO: 385918 - DNA, 577 bp, Homo sapiens
  misc_feature: GZ8MTXP01CZ0JX.52.10.A10.1.454.CMB.2.raw
  modified_base (243)..(243): a, c, t, g, unknown or other
  modified_base (311)..(311): a, c, t, g, unknown or other
  modified_base (371)..(371): a, c, t, g, unknown or other
  modified_base (564)..(564): a, c, t, g, unknown or other
tcagcgcagtacgacacgaccggtgctcgatttagcgtcgatctctgggggaggaactgctcagttaggacccagagggaaccatggaagccccagctcagcttctcttcctcctgctactctggctcccagatggtaccggagaaagtgtattgacacagtctccaggcaccctgtctttgtctccatgagagacggcccaccctctcctgcagggccagtcaagaatattacctcttaccngcctggtaaccaaacaaaacctgacccaggcctccagctcctcatctatgatgcatccaatcggcacngcactccagccagtccagtgctaggtcggtcgtggacagtaaccttcaactctcaacctntacacgacaaccgtagtacgacctagaacgtctttagacgttatttactactgacagtactaggtacggttaagtaaggcggtaccgtcggttaccgacgaagggaccacgtaccggtaggtaacgtttaaacgaactgggttacgcgttacgacacccgttagttccttgttctaacctcttcccacccttntaacgttcgtaag

SEQ ID NO: 385919 - DNA, 659 bp, Homo sapiens
  misc_feature: GZ8MTXP01EE2WQ.52.10.A10.1.454.CMB.2.raw
  modified_base (243)..(243): a, c, t, g, unknown or other
  modified_base (444)..(444): a, c, t, g, unknown or other
  modified_base (607)..(607): a, c, t, g, unknown or other
  modified_base (619)..(619): a, c, t, g, unknown or other
  modified_base (632)..(632): a, c, t, g, unknown or other
  modified_base (642)..(642): a, c, t, g, unknown or other
  modified_base (646)..(646): a, c, t, g, unknown or other
  modified_base (649)..(649): a, c, t, g, unknown or other
  modified_base (656)..(656): a, c, t, g, unknown or other
tcagcgcagtacgacacgaccggtgctcgatttagcgtcgatctcaggggggagggactgctcagttaggacccagagggaaccatggaagccccagctcagcttctcttcctcctgctactctggctcccagatggtaccggagaaagtgtattgacacagtctccaggcaccctgtctttgtctccatgagagacgggccaccctctcctgcgagggccagtcaagtaattacttaccctnttaccgtggtacctaggtaaacccaaaccaaaaacctcgaccccaagggccctaccccgaggcctcctactacttccgtatgaatcgacaactcccgaaagtccggggacccacgtcgggacctactcccccgaaggtcccgtaggggtttccaggttcggacgtagggtcggggtactagggggactacggtcctttacncttcctaccacctactccaagtaccaaacgtagacgtaccgtagaacgttactttggactttaagttttactacgtgtacagacgtaggtacggggtaagttagcggtcggttacgtaccgggacgtaacgggaccacggtacggtaagggtaaacggttaanaacgtgttcggnttcgactacgttnttcttgtctnctcnccntaagttntaa

SEQ ID NO: 385920 - DNA, 576 bp, Homo sapiens
  misc_feature: GZ8MTXP01EJQFU.52.10.A10.1.454.CMB.2.raw
  modified_base (506)..(506): a, c, t, g, unknown or other
tcagcgcagtacgacacgaccggtgctcgatttagcgtcgatctcaggggggaggaactgctcagttaggacccagagggaaccatggaagccccagctcagcttctcttcctcctgctactctggctcccagatggtaccggagaaagtgtattgacacagtctccaggcaccctgtctttgtctccatgagagaggccaccctctcctgcgagggccagtcagaatacttacctcttacctggcctaggtaaccaaacaaaacctgacccaggcctcccaggcctcctcatctatgattcatccaagtccggcacgtgcactcccagcctaggttcaggtggcaggtcgggtctagggacagtaccttcactctacaccatcagacaactgacgcctagaacgtactttggacttaagtttacttacgtgtacagctaagtcggttaaggtaaggtcggcgtcgtcggaccgaagggacaacggtgtaggtaaaggttaaacgngtggtacggcgtacgcgaacctgttcttcgttccttcctacttcccttcccgcttattccgttaagtaac

SEQ ID NO: 385921 - DNA, 756 bp, Homo sapiens
  misc_feature: GZ8MTXP01A7KEV.52.10.A10.1.454.CMB.2.raw
  modified_base (283)..(283): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccgaggagagagggccaccctctcctgcagggccagtcagtaatattacctcttacctggcctaggtaccaaacaaaacctcgaccaggctcccagcncctcatctatgatgcatacccaagtccgggccaactcggaccactccccagccgtaggttccaggtcggcgtaggtcggggtccgtaggggactacggtaccctttacccgaaccttccttaccaacccgtaactccgaacggtacccaaaccgtagaccgtacccgttaggaaacgttacgtttacgacgtttaaagtttttactaacttcgtacaacgtaccgtaaggtaccggttaaagggttaaacgggttcgggcccgttaaccggttccgggaaccccggtaaagggggacccgtaaaccgggtaacggttaaccggggtaaaacggtttaaaaccgggtacggttaacgggtacggttaaccccgttgggaacccctaaaccgttaacgttccgggttaacgtttcccgttaacccgttaacgttccccctttaccccggacttaccttaacgttaaggtaaaccg

SEQ ID NO: 385922 - DNA, 548 bp, Homo sapiens
  misc_feature: GZ8MTXP01AJ9DM.52.10.A10.1.454.CMB.2.raw
  modified_base (353)..(353): a, c, t, g, unknown or other
  modified_base (495)..(495): a, c, t, g, unknown or other
  modified_base (505)..(505): a, c, t, g, unknown or other
  modified_base (521)..(521): a, c, t, g, unknown or other
  modified_base (530)..(530): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagaggccaccctctcctgcagggccagtcagaatattacctcttacctggcctaggtaaccaaacaaaacctgcccaggctcccagctcctcatctatgatgcatccaagtcgggccactggcatcccagccaggttcagtggcaggtgggtcgtgggacngtaaccttcaactctacaccatcagaccaaacctagacgcctagaacgtctttgacttagtttatactgcagcaggtacggtagtagtcggcgtcgtcggaccaagggtcacgtcgtagggaaacgttaaccgaatggcgtncgcaacgttnttcttgttaaccttcncgtttcccncccgctaagttccgtaag

SEQ ID NO: 385923 - DNA, 591 bp, Homo sapiens
  misc_feature: GZ8MTXP01DDGWP.52.10.A10.1.454.CMB.2.raw
  modified_base (289)..(289): a, c, t, g, unknown or other
tcagcgcagtacgacacgaccggtgctcgatttagcgtcgatctcaggggggaggaactgctcagttaggacccagagggaaccatggaagccccagctcagcttctcttcctcctgctactctggctccagatggtaccggagaaagtgtattgacacagtctccaggcaccctgtctttgtctcatgagagaggccaccctctcctgcagggccagtcagtaatattacctcttacctggcctaggtaaaccaaacaaaaacctgcccaggcctcccaggcctcctnatctatgatgcatccaagtccgggccacgtcggaccacgtcccacgccgtaggttcaggtggcgtaggtgggtcgtggggactagtaaccttcaactcacaccatcagcaaacctgacgtcctagtaactctttgacttagtttatacgtgcgtaagcgtagtacggggtagttaacggtcgacgtcgttacggaccgtaaggaccgagtaaccgtagggtaaacggttaaagcgtgcgggtcttacggcctaaccgttgttcttcgttcctactccttcccgtccgttactcgttcgtaag

SEQ ID NO: 385924 - DNA, 553 bp, Homo sapiens
  misc_feature: GZ8MTXP01D1V2Y.52.10.A10.1.454.CMB.2.raw
  modified_base (362)..(362): a, c, t, g, unknown or other
  modified_base (373)..(373): a, c, t, g, unknown or other
  modified_base (383)..(383): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctgtaccaaacaaaacctgcccaggctcccaggctcctcatctatgatgcatccaatccggcactggcatcccagccaggttcagtgcaggtcggctgggacagactcactctcaccntcagcaactangctagaagtnttgactagtttatactgtcagtcagcgttagggtaagtggcgtacgttcggaccgaagggacaacggtacgtagggaagttaaaccgaacgttggtacggttcgttacgccgaacccgtattccgttcgttccttcctacttcccttccccgcttacttccttaagtaac

SEQ ID NO: 385925 - DNA, 712 bp, Homo sapiens
  misc_feature: GZ8MTXP01B17TJ.52.10.A10.1.454.CMB.2.raw
tcagcgcagtacgacacgaccggtgctcgatttagcgtcgatctcaggggggaggaactgctcagttaggacccagagggaaccatggaagccccagctcagcttctcttcctcctgctactctggctccagatggtaccggagaaagtgtattgacacagtctccaggcacctgtctttgtctccatgagagacggccacctctcctgcagggccagtcaagtaatacttacctcttacctggtacctaggtaaccaaacaaaacctcgaccctaggcctcccaggcctcctcatctatgatcgcatccaacgtccgggaccacgtcgctactcccgagcctaggttcaaggtggaccgtaggttcgggtcgtaggggaaccacgtaacctttaccaactcctaccaacccactacgaacgacctaaacccgtagacgacccgtagtaacgtacttttaggacttaagttttactactcggttacaagtacctaggtacggttaaaggttaagggtcggtaccgtaccggttacgggaaacccggtaaggggaaaccctaacggtaaccgggttaggggtaaaaccgggttaaaacgtaaccggtcgggttagggacccttcggaacccgtaacccttagtttccccgttacggtttccttaaaccccttcggtttccccttcccggacccctaagtttaacccgtttaag

SEQ ID NO: 385926 - DNA, 694 bp, Homo sapiens
  misc_feature: GZ8MTXP01A33FY.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggccaccctgtctttgtctccaggagagacgggcccaccctctcctgcagggccagtcagtaatattacctcttacctggtcctaggtaacccaaactaaaaaccctcgaccccgaggcctacccgacggcctccctcatcctatgatgctactccaaacgtcccgggaccacgtcggacctacgtcccccgacgtacccgtagggtttccaggttacggccgtagggttccggggtcggtacggggacctaggtaccctttaccaccttctaccaacctactacaacgtaccaaacgtaagaccgtcgtaagaacgttactttcgacgtttaacgtttacttaccgtgtaccagaacgtagtacggttaaggtaagggtcgggtaccgtcggttacggaccgaagggacctacggtacgtagggtaaaggttaaaccgagttcgggtcgttacgtacgaccgtactacgttccgttcggttaccttccgtacttcccgttccccgaccttattaaccgttgtaaac

SEQ ID NO: 385927 - DNA, 550 bp, Homo sapiens
  misc_feature: GZ8MTXP01DMITQ.52.10.A10.1.454.CMB.2.raw
  modified_base (337)..(337): a, c, t, g, unknown or other
  modified_base (407)..(407): a, c, t, g, unknown or other
  modified_base (525)..(525): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagaggccaccctctcctgcagggccagtcagaatattacctcttactggcctggtaaccaacaaaacctgcccaggctcccaggctcctcatctatgatgcatccaatcggccactgcatcccagcaggttcagtgcagtgggtntgggacagaaccttcaactctccaccatcagcaaacctgagcctagaagtactttgactagttttatacngtactagcaggtcggtaaggtaaggtggaccgtcgttaccgggctaagggaacacggtacgttagggaagtttaaacgaacttggttggcttggacctacttacttcttagtcttacnttccctcccgactaagttcttaacg

SEQ ID NO: 385928 - DNA, 619 bp, Homo sapiens
  misc_feature: GZ8MTXP01BLM1M.52.10.A10.1.454.CMB.2.raw
  modified_base (276)..(276): a, c, t, g, unknown or other
  modified_base (278)..(278): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgccaggctccagcncncatctatgatgcataccaagtccgggccacgtcggaccactccccaagcccgtaagggtttccaggtggaccgtaggtcggggtcgtggggactaggaccttcaactcctaccacctatccgacgaccaaacctagacgtaccgtagaagtacttgacttagtttacttactgtacagctagtcgttagggtaaggtggtccgtacgttacggaccgaacgggacacggtacgtagggtaaacggttaaacgaaggttggtcggactcggacctaaccgtaattccggttcgttccttaactacctttcccgtaccccgtcttaacttcgttaagttaacg

SEQ ID NO: 385929 - DNA, 659 bp, Homo sapiens
  misc_feature: GZ8MTXP01A30N2.52.10.A10.1.454.CMB.2.raw
  modified_base (286)..(286): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagacgggccaccctctcctgcagggccagtcagaatattacctcttacctggcctaggtaaccaaacaaaacctgcccaggcctcccgagctcncatctatgatgacatccaagtccgggccacgtcggactacgtcccgacgtcccgaaggtttccgaggtggacgtaggtccggggtctagggggacacggtacccttcacctcctacaaccactacgacgacctaaacgtgacgtcgtagaacgtactttagactttagtttacttacgtcgtacagtaccgtaggtaccgttaaggggtaacgtcggggtacctacggttacccggacccgaaagggtacccaacgggtacgtaacggggtaaacggtttaaaccgacggttaaggtcgggacctcggacctaaccgtattccggtttacttcttccctacgttcccttccccgacttacttcgttaagtaag

SEQ ID NO: 385930 - DNA, 647 bp, Homo sapiens
  misc_feature: GZ8MTXP01BV6PP.52.10.A10.1.454.CMB.2.raw
  modified_base (278)..(278): a, c, t, g, unknown or other
  modified_base (399)..(399): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggcccaccctctcctgcagggccagtcagaatattacctcttacctggcctgtaccaacaaacctgccaggctccagcctcnatctatgatgacatccaagtccggccacgtggcactccccagccgtaggttccaggtggcgtaggtcgggtctggggactagtaccttacaccttctacacccatcacgaccaactagacncctagaagtcttgacttagtttacttacgtgtacagtcaaggtacgtagggtaacggtcgggtccgtccggttaccggaccggtaaacgggacccgtaacggtacgttaacggggtaaacggttaaaccggtaacggtggtaacgggttaccgttacggaccctaaaccgtattcccggttcgtttacccgttaacctaccgtttccccgttacccccggtacccttattaacccgttgttaaaaccg

SEQ ID NO: 385931 - DNA, 672 bp, Homo sapiens
  misc_feature: GZ8MTXP01DKPML.52.10.A10.1.454.CMB.2.raw
  modified_base (303)..(303): a, c, t, g, unknown or other
tcagcgcagtacgacacgaccggtgctcgatttagcgtcgatctcaggggggaggaactgctcagttaggacccagagggaaccatggaagccccagctcagcttctcttcctcctgctactctggcctcccagatggtaccggagaaagtgtattgacacagtctccaggcacccttgtctttgtctccgaggagaggacgggccctaccctctcctgcgagggccagtcaagtaattacttacctcttacctggccctaggtaaccaaacaaaaccctgcccaggcctcccgaggcctccncattctatgatgcatacccaagtccggccacgtggaccactccccgagtccgtaggttcaggtggcgtaggtcgggtcgtaggggactacgtccttaccacttctaccacctatccagaccaaacgtgactctagtaagtctttagactttaagttttacttacgtcgtacagtcgtaagggtacggttaaggggttaacggtcgggtaccgtacggttaccgggaacccgtaaggggtacctaaacccgggtggtaacggggtaaacgttaaaaccgggtacggttaagggttcgggttacctcgttaaacctcggttacttcgttctttactcctaccttccgtcctacttacttcgttaattaacg

SEQ ID NO: 385932 - DNA, 573 bp, Homo sapiens
  misc_feature: GZ8MTXP01AZWCX.52.10.A10.1.454.CMB.2.raw
  modified_base (206)..(206): a, c, t, g, unknown or other
  modified_base (394)..(394): a, c, t, g, unknown or other
  modified_base (525)..(525): a, c, t, g, unknown or other
  modified_base (550)..(550): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagacggccaccctntcctgcagggccagtccagtaattattacctcttacctggccctaggtaacccaaacaaaaacctgacccaggcctcccaggctcctcatctatgatgcactccaagtccgggaccacgtcggcactcccaaggcctaggttcaggtggcaggtcgggtgtgggacagtaacttcaactctcacctancacgacaactagacgtccagtaagtcgtttgacttagttttaactctgtcagcgtagcgggttaagtaggtcggcgtcgtcggaccgaaacggacaccggtagtaggaacggttaaacgaacgttggcggnttcgactccttattcttgttcctancttcctcccgactcgttcttaag

SEQ ID NO: 385933 - DNA, 609 bp, Homo sapiens
  misc_feature: GZ8MTXP01DDUA2.52.10.A10.1.454.CMB.2.raw
  modified_base (282)..(282): a, c, t, g, unknown or other
  modified_base (557)..(557): a, c, t, g, unknown or other
tcagcgcagtacgacacgaccggtgctcgatttagcgtcgatctcaggggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggcccacctctcctgcagggccagtcagaatattacctcttacctggcctaggtaaccaaacaaaacctgcccaggctcccagcnctcatctatgatgcactccaagtcggccacgtgacactcccagccaggttcagtggcaggtcgggtctaggggacacgtacctttccaacttcaccaacccatccaagactaaatcgtaagacgtaccctagaacgtactttggaacttaggttttaacttacgtgttacagtactaggtacggttaaggtaaggttcggaccgtcgttaccgggaccgtaaggggaccgacggtaacgtagggtaaaggttaaacgtaaacgtggttaggaccngtaccgacttacgttcttagtccttacgtcttccgttccactcgttcgtaag

SEQ ID NO: 385934 - DNA, 656 bp, Homo sapiens
  misc_feature: GZ8MTXP01B1EFA.52.10.A10.1.454.CMB.2.raw
  modified_base (279)..(279): a, c, t, g, unknown or other
  modified_base (286)..(286): a, c, t, g, unknown or other
  modified_base (507)..(507): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgctccatgagagagggccacctctcctgcagggccagtcagatattacctctacctggcctagaaccaaaccaaactcgcccagcctaccagcctccncatctancgatcgactacgtaccaacggtccggccctacgtcggacctacctaccccgacggtcccgtaacggtttcgaacggtcggtacgtaccggggttggggtacgtagggactacgttaacccgttctaacctcctaaccacctactacgacgtaccctaaacgtaggaccgtaccgtaagaacgttcgtttacgacgtttacgtttttactacgtgttaccgngacgtacgggtagttaacgggtagtcggacctccggtcggacgaacggtacaacggtagtacgggtaaacgtaaacgtaacgtggttcgaccttgaacctcgttacttcgttcgttctcgtaaccttcccgccttacttaacttcgtaa

SEQ ID NO: 385935 - DNA, 713 bp, Homo sapiens
  misc_feature: GZ8MTXP01DZSL0.52.10.A10.1.454.CMB.2.raw
  modified_base (304)..(304): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccgaggagaggacgggcccacccgtcctccgtgccgacgggccaggtacggaattacttaccttcttacctggcctacggtaaccaaacaaaacctcgacccaggcctccaggcctccncatctatgatgacataccaaagtccgggaccacgttcggaccactccccgacggtacccgtaaggttcagggttcggtacgtaaggggttcggggtcccgttaggggaactagtacccgttcaaaacccttcctaaccacctaactaccgaaacgacccgtaaaccgttagggaccgtaccgttagtaaacggttactttaggtacctttaagttttaacttacgtgttacagaccgtaggtacgttaaggttaacgggggtcgtacggttccggttaaccgggacggtaaacggacgacggtaaccgtagggtaaacggttaactaacggtggtaacgcttacgggaccacgttactcgttattccttacgtaacgtcccttccacctgttcctaagttaacttaacg

SEQ ID NO: 385936 - DNA, 706 bp, Homo sapiens
  misc_feature: GZ8MTXP01CR6CD.52.10.A10.1.454.CMB.2.raw
  modified_base (238)..(238): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagacggcccacctctcctgcagggccagtcagaatatacctctacnggacctggtaaccaaacaaaacctgacccaggcctccaggctcctcatctatgatgcataccaagtccggaccactcggcactcccacgccgtaggttccaggtgcgtaggtcggtcgtgggactacgaccgttactacctctccaacctatacgacgacctaaacgtaacgacgtacctaggtaaacgtactttcgaacgttacgtttttaacgttaacgtcgtaacgtacgtaccgtaggtaaccggttaagggttaaagggttccgggtaccggttaccggttaccgggaacccggtaacgggaaccgtaaccgtacgggttaacggggtaaaggttaaaaccgcggttaacggtcgggttacctacgggacctaaacccggtaacttcccggttcgtttacccgttaaccttactttcccccggtttaccccggaccttacctttcccgttaaggttaaacccg

SEQ ID NO: 385937 - DNA, 830 bp, Homo sapiens
  misc_feature: GZ8MTXP01A2BOH.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctcaggagagacggcccacctctcctgcgagggccagtacagtaattacttaccctcttaccgtcggtaccgtacggtaaccaaacaaaaccctcgaccccaggcctacccgaggcctcctcattctatgactcgcactaccaacgtccggactacgtcggactacgtacccgacgtccgtaggttaccgtacggtcggacgtaggggttccggggtaccgttaggggaaccgtacggttaaccctttacccgtaacctttcccaccctaaacccgtacgttaacccgaaaccgtaacccttaaacccgggttaaagacccgttaaccccgtaaagggtttaaaacccggttaaccgtttttacggaaccgtttttaaaacgggtttttaacctttacgttaccgggtaacccgttaacggtaacgggtaccgttaaccggggtttaaaggggttaacggggttaccggggtacccggttaccgggtttaacccgggaaccggttaaacggggaacctaacggggtaaacggttacggggtaaacggttaaaacgacgggttggtacggcgtacgaccgtacggtactttcgttcgttactttaaccgactttccccgtaccggtacttcttaaccgttgttaaccg

SEQ ID NO: 385938 - DNA, 626 bp, Homo sapiens
  misc_feature: GZ8MTXP01CQH15.52.10.A10.1.454.CMB.2.raw
  modified_base (480)..(480): a, c, t, g, unknown or other
  modified_base (486)..(486): a, c, t, g, unknown or other
  modified_base (550)..(550): a, c, t, g, unknown or other
  modified_base (575)..(575): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagacgggcccaccctctcctgcagggccagtcaagaattactacctcttaccgtggacctacggtaaccaaacaaaaccctcgaccccgacggtcctaccccgaggtcctcctacacttctatgatcgactactacccgaagtccgggcctacgtcggaccaccgtccccgacgtccgtaggttcgaggtcggcgtagggtccgggtacgtgggacagtacctacacctctacaccatacacgacctaactagacgtctaaggaagttcttagacttagttttactcngtcagntagtacgtagggtaggtcggccgtacgtacggacgaggactacggagtacgggaacgttaacgngtggacggctacggacctaaccgtnttaccgttgttacccttcacctttcccgtccgattactccgttaagttaac

SEQ ID NO: 385939 - DNA, 627 bp, Homo sapiens
  misc_feature: GZ8MTXP01AE9EH.52.10.A10.1.454.CMB.2.raw
  modified_base (356)..(356): a, c, t, g, unknown or other
  modified_base (374)..(374): a, c, t, g, unknown or other
  modified_base (382)..(382): a, c, t, g, unknown or other
  modified_base (554)..(554): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagacgggcccaccctctcctgcgagggccagtcagaatattacctcttacctggcctaggtaaccaaacaaaacctcgccacggcctcccaggtcctcctcactacgtatgatgactactaccgaagtcggaccacgtgcacctccgagcctaggtccagtggngtaggtcggcgtgggacngtactacnctctaccactatcagtacgaaacgtagacgtcctaggtaagtacctttagaccttaagtttacttacgttacgacgagtacgtacgggtacgtaaggggtaggtcgggtcgtaccggttccggaacgaacgggacgtaccggtagtacgggtaaacggtaacgacggtgggngttctaccggacctacgtacgttcgttacgttcctttaaccgtcttccggttccccacttagttcgttgtaac

SEQ ID NO: 385940 - DNA, 702 bp, Homo sapiens
  misc_feature: GZ8MTXP01EYSXX.52.10.A10.1.454.CMB.2.raw
  modified_base (274)..(274): a, c, t, g, unknown or other
  modified_base (691)..(691): a, c, t, g, unknown or other
tcagcgcagtacgacacgaccggtgctcgatttagcgtcgatctcaggggggaggaactgctcagttaggacccagagggaaccatggaagccccagctcagcttctcttcctcctgctactctggctcccagatggtaccggagaaagtgtattgacacagtctccaggcaccctgtctttgtctccatgagagacggccaccctctcctgcgagggccagtcagaatacttacctcttacctggcctaggtaaccaaacaaaacctgacccnggcctcccaggcctcctcatctatgatgcatccaagtccgggaccctacgtcggacctacgttcccccgagtacccgtaggtttaccgaggttcggacgtacggggttcgggggtacgtacgggggtaacctaacggttaaacccttccgtaaccttccctacccaaacctaacgtaccgaacggaacctaaacccgttaggacgtacccgttaaggtaaacgttacttttcgtaaccgttaagttttttaactaacgttgtaaccgagtaccgtaaggtccggggttaaaggttacggtcggtaccgtcggttaccggacgtaaagggaccacggtaacgtagggtaacggttaacgaacgtggttacggccttggaccctacttagttcgttagttcctctaacgttcccctccnctcttcgtaag

SEQ ID NO: 385941 - DNA, 770 bp, Homo sapiens
  misc_feature: GZ8MTXP01AHGTL.52.10.A10.1.454.CMB.2.raw
  modified_base (267)..(267): a, c, t, g, unknown or other
  modified_base (270)..(270): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagaggccaccctctcctgcaggccagtcagaatatacctctactgcctgtaccaacaaactgccaggctccagcnctnatcatgatgcactccaagtccggaccacgtggcactcccgagcccgtaggtttcaggtggcgtagggtccggggtctaggggactaggtacctttaccgaccttcctaccaaccctagtccgaacgtaccaaacccgtaggacgtacccgtaggaaacgttcgtttacggactttaaacggttttaacttaaccgttggttacccagtaccgtaacgggttaccggttaaacggggttaaaggggttccggggtcccggttaccgggtttaaccccgggggaaaccccgggtaaaacgggggaaccccgtaaacccggggttaaaccggggttaaccgggggtaaaaacgggtttaaaaacccgggtaaaccggttaagggggtaccgggttccgtacccgggaacccgtaaccccgttaagtttcccggttctttacccgtttaacctaccctttccccgttcccccggtaccttaacgttcccgttaaggttaaaccg

SEQ ID NO: 385942 - DNA, 499 bp, Homo sapiens
  misc_feature: GZ8MTXP01EKCNP.52.10.A10.1.454.CMB.2.raw
  modified_base (230)..(230): a, c, t, g, unknown or other
  modified_base (251)..(251): a, c, t, g, unknown or other
  modified_base (257)..(257): a, c, t, g, unknown or other
  modified_base (259)..(259): a, c, t, g, unknown or other
  modified_base (262)..(262): a, c, t, g, unknown or other
  modified_base (264)..(266): a, c, t, g, unknown or other
  modified_base (268)..(269): a, c, t, g, unknown or other
  modified_base (271)..(272): a, c, t, g, unknown or other
  modified_base (275)..(275): a, c, t, g, unknown or other
  modified_base (278)..(278): a, c, t, g, unknown or other
  modified_base (282)..(283): a, c, t, g, unknown or other
  modified_base (286)..(287): a, c, t, g, unknown or other
  modified_base (290)..(291): a, c, t, g, unknown or other
  modified_base (296)..(296): a, c, t, g, unknown or other
  modified_base (298)..(298): a, c, t, g, unknown or other
  modified_base (300)..(301): a, c, t, g, unknown or other
  modified_base (308)..(308): a, c, t, g, unknown or other
  modified_base (313)..(313): a, c, t, g, unknown or other
  modified_base (318)..(318): a, c, t, g, unknown or other
  modified_base (326)..(326): a, c, t, g, unknown or other
  modified_base (334)..(334): a, c, t, g, unknown or other
  modified_base (337)..(337): a, c, t, g, unknown or other
  modified_base (341)..(341): a, c, t, g, unknown or other
  modified_base (358)..(358): a, c, t, g, unknown or other
  modified_base (476)..(476): a, c, t, g, unknown or other
  modified_base (482)..(482): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagacggccaccctctcctgcaggccagtcagatatctntactgctgtaccaacaaactnccagcncngcncnnntnnanncancancgcnngcnnccnncagtngngnnggtggtnggacngatcnctctcacnacagcacngcnctanagtctgacttgttatcngtacagtagacgaggttagtacgtcgggcgtaccgttccggaacgttagggaacctagggtaccgtaggtaacggtaaacgaacttggaggcttgcgaacttgttcgttcgttctacncttccnccgttctaagttcgaag

SEQ ID NO: 385943 - DNA, 644 bp, Homo sapiens
  misc_feature: GZ8MTXP01DEFND.52.10.A10.1.454.CMB.2.raw
  modified_base (594)..(594): a, c, t, g, unknown or other
  modified_base (632)..(632): a, c, t, g, unknown or other
tcagcgcagtacgacacgaccggtgctcgatttagcgtcgatctcaggggggaggaactgctcagttaggacccagagggaaccatggaagccccagctcagcttctcttcctcctgctactctggctccagatggtaccggagaaagtgtattgacacagtctccaggcaccctgtctttgtctcatgagagacggccacctctcctgcagggccagtcaagtaatacttacctcttactggtcctaggtaaccaaacaaaacctcgcccaggcctcccgaggcctcctacatactatgtatcgcaactcctaacgtcgggccaacgtcgacactccccagtccgtaggttcaggtgacgtaggtcggggtacgtacggacgtagtaaccttcgaacctccctaccaaacctactaccaacgaccgtaaaccgagtacgtaccgtagtaacggttactttagacgtttaattttactacgtcgtacgtacgacgaaggttaccggggttaaggttacggtaggtcccgtcgttaccggaccgaaaggggacctacggtaatcggggtaaataaaccgtaagtggttacggtcncgtacacttagttcttagttcctacaaccttctacccntaacttcgtaag

SEQ ID NO: 385944 - DNA, 608 bp, Homo sapiens
  misc_feature: GZ8MTXP01EAD8Z.52.10.A10.1.454.CMB.2.raw
  modified_base (210)..(210): a, c, t, g, unknown or other
  modified_base (277)..(277): a, c, t, g, unknown or other
  modified_base (282)..(282): a, c, t, g, unknown or other
  modified_base (583)..(583): a, c, t, g, unknown or other
  modified_base (597)..(597): a, c, t, g, unknown or other
tcagcgcagtacgacacgaccggtgctcgatttagcgtcgatctcaggggggaggaactgctcagttaggacccagagggaaccatggaagccccagctcagcttctcttcctcctgctactctggctcccagatggtaccggagaaagtgtattgacacagtctccaggcaccctgtctttgtctccatgagagacgggccaccccgtntcctgcgagggccagtcagaatacttacctcttacctggacctaggtaaccaacaaaacctgacccnggccncccaggcctcctcatactatgatgactactaccgaatccgggacctaacgtcggactacgtcccctaagccgtaggttacagtcggacgtacggtgggtacgtaggggacctacggtaacctactaacgtctaccaacctataccagacaaacctagacgtacctaggaacttgtttacgacttagtttaatcctagtaccagacagtacgggtaagtttaaggcgacgtacgtcggacgtaacgggactcgtagtacggtaagtaacaagtgttgacttgacacttagttcttctctacnccttccgacccttnttaacttgtaa

SEQ ID NO: 385945 - DNA, 563 bp, Homo sapiens
  misc_feature: GZ8MTXP02JMAXI.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccgagaaagtgtattgacacagtctccaggcaccctgtctttgtctccatgagagagggccaccctctcctgcaggccagtcagaatattacctcttacctgcctggtaccaacaaaacctgcccaggctcccaggctcctcatctatgatgcatccaatcggccactggcactcccagccaggttcagtggcacggtgggtcgtggacagacttcactctcaccatcagacaaaccctagacgacctagaacgtactttgacttagtttattacctgtacgacgacgtagtacggttaggtaaagtgggtccgtacgtttacggaccgaaacggggacaacggacgtagggtaaacggtaaaaccgtaacgtggtaggacgcgacaccattctcgtaactctactccctcccgactactcttag

SEQ ID NO: 385946 - DNA, 532 bp, Homo sapiens
  misc_feature: GZ8MTXP02GATHF.52.10.A10.1.454.CMB.2.raw
  modified_base (283)..(283): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccaggctcctnatctatgatgcatccaatcgggccactggcatcccagccaggttcagtgcaggtcggtctgggacagcttcactctcaccatcagacaaacctagagaccctagaaacgtactttgctaagtttatactgtcagcagcgtagtagtgcgcttcggccaagggcacgacgtgggaagttaaacgaacgtggtagcgtacgacacctatccgtgttccttcgaacttccttacccgctaacttctagtaac

SEQ ID NO: 385947 - DNA, 490 bp, Homo sapiens
  misc_feature: GZ8MTXP02IHH59.52.10.A10.1.454.CMB.2.raw
  modified_base (373)..(373): a, c, t, g, unknown or other
  modified_base (486)..(486): a, c, t, g, unknown or other
tcagcgcagtacgacacgaccggtgctcgatttagcgtcgatctcaggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccagctccaggctcctcatcatgatgcatccaatcggccactggcatcccagccaggttcagtgcagtggtctgggacagacttcactctcacatcagcaactagagccngaagctttgctagtttatactgtcagcagcgtaagtagtgcgtcgttcggccaagggcacgactggagttaaacgactgtggctgcaccatctgcttcactcttccgctatcngtac

SEQ ID NO: 385948 - DNA, 510 bp, Homo sapiens
  misc_feature: GZ8MTXP02GE7ZA.52.10.A10.1.454.CMB.2.raw
  modified_base (490)..(490): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctccaggctcctcatctatgatgcatccaagtcggccactggcatcccagccaggttcagtgcaggtcggtctgggacagacttcactctcaccatcaagcaaacctgagcctagaagtctttgctagtttacttatgtcagcagtcgtagtaagtgcgtcttcggaccaagggcacgacgtggaagttaaacgactggagctgctacatctgttctaacncttcttcccgctatctgaac

SEQ ID NO: 385949 - DNA, 538 bp, Homo sapiens
  misc_feature: GZ8MTXP02I96U0.52.10.A10.1.454.CMB.2.raw
  modified_base (487)..(487): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcctaggctcctcatctatgatgcatccaatcgggccactggcatcccagccaggttcagtgcagtggtctgggacagacttcactctcacatcagcaaacctagacgcctagaacgtactttgctagtttatactgtcagcaggcgtaagtagtggactcgttacggaccaaaggggacacgaacgtgggaaacgttaaaacgaacttggaggacncgaccactacgtctgtaccttaacgtactccctacccgactactctacgta

SEQ ID NO: 385950 - DNA, 516 bp, Homo sapiens
  misc_feature: GZ8MTXP02GVLFX.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccacctctcctgcagggccagtcagaatattacctcttacctggcctggtaccaacaaaacctgcccaggctcccaggctcctcatctatgatgcatccaatcggccactggcatcccagccaggttcagtgcagtggtctggggacagacttcactctcaccatcagcaaacctagacgcctagaagtactttgactagtttatactgtacagcagcgttaagtaagtggcgacttcggaccaaagggacacggactagggaaagttaaacgaactggtaggctgcaccatctgtcttcacttctcccgcactctag

SEQ ID NO: 385951 - DNA, 508 bp, Homo sapiens
  misc_feature: GZ8MTXP02J1293.52.10.A10.1.454.CMB.2.raw
  modified_base (488)..(488): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccagctcctcatctatgatgcatccaatcgggccactggcatccccagccaggttcagtgcagtggctgggacagacttcactctcaccatcagcaaacctgacgccctgaacgtactttgctagtttatactgtcagcagcgtagtagtgacgtcttcggacaaggggacacggacgtggaagttaaacgaactgtaggctgcacgatctgtctnactcttcccgctactctgta

SEQ ID NO: 385952 - DNA, 558 bp, Homo sapiens
  misc_feature: GZ8MTXP02JYKX5.52.10.A10.1.454.CMB.2.raw
  modified_base (235)..(235): a, c, t, g, unknown or other
  modified_base (377)..(377): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctnttacctggcctggtaccaacaaaacctgcccaggctcccaggctcctcatctatgatgcatccaatcgggccatggcatcccagccaggttcagtggcaggtcggtctgggacagcttcactctcacatcagcaaacctganccctagaacgtactttgctagtttattactgtcagcagtcgtagtagtggcgtcgttcggaccaaggggacacggtactaggggtaaggttaaaaccgaacgttcggtaggcgttcggacaacccgtatcttcgttaccttcgaactttccgtttacccccgtacctacttccgtagtacg

SEQ ID NO: 385953 - DNA, 574 bp, Homo sapiens
  misc_feature: GZ8MTXP02HCUB3.52.10.A10.1.454.CMB.2.raw
  modified_base (356)..(356): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttacctggcctggtaccaacaaaacctgcccaggctcccaggctcctcatctatgatgcatccaatcggccactggcatcccagccaggttcagtggcaggtgggtctgggacagacttcnctctcaccatcagccaaacctagacgccctagaaacggtaccttttgacttaagttttattactgtacagtcagtcggtaagtaagtcggacgtcttccgggaccgtaaaggggaccacggtacgtaggggaaacggtttaaaaccgaacgtggtagggtactaggacctaaccgattcccttaggtcctttacacgttccttcccgactactcctag

SEQ ID NO: 385954 - DNA, 518 bp, Homo sapiens
  misc_feature: GZ8MTXP02GXL5C.52.10.A10.1.454.CMB.2.raw
  modified_base (234)..(234): a, c, t, g, unknown or other
  modified_base (508)..(508): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctccaaatggtaccggagaaagtgtattgacacagtctccaggcaccctgtctttgtctccatgagagagggccaccctctcctgcagggccagtcagaatattacctnttacctggcctggtaccaacaaaactgcccagctcccagctcctcatcatgatgcatccaaatcggccatggcatcccagccaggttcagtggcaggtcggtctgggacagacttcactctcacatcagcaactgacgcctagaatcttgctagtttatactgtcagcagcgtagtaagtggctcgttacggaccgaaaggggccacggacgtagggaaacggttaaaacagttggtcggatcgacacctatcctgttctcacttcctaccccntactctatac

SEQ ID NO: 385955 - DNA, 523 bp, Homo sapiens
  misc_feature: GZ8MTXP02GVLI3.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaaacaaaacctgcccaggctcctaggctcctcatctatgatgcatccaaatcgggccactggcatcccagccaggttcagtgcagtggtctgggacagacttcactctcaccatcagcaaacctagagcctagaacgtactttgactagtttattactgtacagcagcgtaagtaagtggctcgttcggaccaagggacacgacgtggaaggttaaacgacgtgtggctacgcaccagtctgtctcactccttcccgactactctagtaac

SEQ ID NO: 385956 - DNA, 575 bp, Homo sapiens
  misc_feature: GZ8MTXP02GL026.52.10.A10.1.454.CMB.2.raw
  modified_base (357)..(357): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttacctggcctggtaccaacaaaacctgcccaggctcccaggctcctcatctatgatgcatccaatccggccactggcatcccagccaggttcagtggcaggtggtctggggacagacttcnctctcacatcagcaaacctagacgcctagaaagtactttgactagtttatactgtacagtacagcgttaggtaagtgggacgcgttaccggcctaaaggggaccaacggacgtagggaaagggttaaaaccgaacgttgggtacggacgtgaccgtacctacttccttaggttcctttacgaactttccctttacccccgcctaacgttctttaacgg

SEQ ID NO: 385957 - DNA, 559 bp, Homo sapiens
  misc_feature: GZ8MTXP02GH0K0.52.10.A10.1.454.CMB.2.raw
  modified_base (455)..(455): a, c, t, g, unknown or other
  modified_base (531)..(531): a, c, t, g, unknown or other
  modified_base (539)..(539): a, c, t, g, unknown or other
  modified_base (551)..(551): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttacctggcctggtaaccaaacaaaacctgaccccaggcctcccaggcctcctcatctatgatgcatccaagtccggccacgtggcactcccagccaggttcagtggcaggtgggtctggggacagtaccttcactctacaccatccaagcaaaccctagactccctagaaactactttgactaagttttattacgtgtacagtacagtgtaagttaagnggcgtacgttccggacgaaggggacacgagtagggaaacgttaaaacgacgttggtggcctgaccacctatcgttntctttacncttccttccccnctatctag

SEQ ID NO: 385958 - DNA, 536 bp, Homo sapiens
  misc_feature: GZ8MTXP02GIF0E.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttacctggcctggtaaccaaacaaaacctgcccaggctcccaggctcctcatctatgatgcatccaatcggcactgcactcccagcaggttcagtgcaggtggtctgggacagacttcactctacaccatcagacaacctagacgcctagaagtactttgactagttttatactgtacagacagtacgttagtaagtcggacgtcgttacggacaaaggggacaacgacgtagggaaaggttaaaacgaacgtgtaggctgacaccatctagtcttcacttccgttcccactactcgtaag

SEQ ID NO: 385959 - DNA, 586 bp, Homo sapiens
  misc_feature: GZ8MTXP02G76L8.52.10.A10.1.454.CMB.2.raw
  modified_base (387)..(387): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccaggctcctcatctatgatgcatccaatcgggccactggcactcccagcccaggttcagtggcaggtcgggtctgggacaggacttcactctcacatcagaccaaacctagacncctagaatactttgacttagttttacttacgtcgtacagtcagtcgttaaagtaaggtcggacgtcgttacggaccgaagggaccaacggacgtagggaacggttaaaacgacgttggtacggctacggacctaacgtacttaccgttcgttccttaacgaccttacccgtttccccgacttactaccggtacgtaaac

SEQ ID NO: 385960 - DNA, 514 bp, Homo sapiens
  misc_feature: GZ8MTXP02I3I90.52.10.A10.1.454.CMB.2.raw
  modified_base (255)..(255): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaanaaaacctgcccaggctcccaggctcctcatctatgatgcatccaatcggcactggcatccagccaggttcagtggcagtggtctggggacagacttcactctcaccatcagcaaacctgagcctgaagactttgctagtttattactgtcagcagcgtagtaagtgcgcttcgccgaagggacacgaactggaaggttaaaacgaactgtgggctcgacaccatcctgtcttctactcttccctcctactacttacgta

SEQ ID NO: 385961 - DNA, 519 bp, Homo sapiens
  misc_feature: GZ8MTXP02G9CD0.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccaggctcctcatctatgatgcatccaatcggccactggcatccagccaggttcagtggcagtcgggtctgggacagacttcactctcacatcagcaacctgacgcctagaagctttgactagtttatactgtcagcagcgttagtagtgcgcttcgaccgaaggacagacgtggaagttaaacgacgtggtggctggacaccgtatccgtgttctcgtacttccgttcccgactactcctagtaac

SEQ ID NO: 385962 - DNA, 538 bp, Homo sapiens
  misc_feature: GZ8MTXP02HJ3ZU.52.10.A10.1.454.CMB.2.raw
  modified_base (348)..(348): a, c, t, g, unknown or other
  modified_base (406)..(406): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctcatgagagaggccacctctcctgcagggccagtcagaatattacctcttacctggcctggtaccaaacaaaacctgcccaggctccagctcctcatctatgatgcatccaatcggcacgtgcatcccagcaggtcagtgcagtggtctgggacagtaccttcnctctcaccatccagacaacctagacgcctagaacgtacttgacttagtttactacgtntacagactagtacgtagttagcggcgtcgttacggaccgaagggaccaggtacgtagggaaagttaaaccgacgtggtcggctagcctaccgattcctacgtaaccttcacttccgtacctcaacttctaag

SEQ ID NO: 385963 - DNA, 569 bp, Homo sapiens
  misc_feature: GZ8MTXP02F7G2V.52.10.A10.1.454.CMB.2.raw
  modified_base (353)..(353): a, c, t, g, unknown or other
tcagcgcagtacgacacgaccggtgctcgatttagcgtcgatctctgggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttactggcctggtaccaacaaaacctgcccaggctcccaggctcctcatctatgatgcatccaatcggccatggcatcccagccaggtccagtggcagtgggtctgggacagacttcnctctcaccatcagccaaacctagagccctagaagtactttgactagtttactactgtacagacaggcgtaagtaagtgggacgtcttaccgggacgaacgggacacggtacgtaggggtaaacggttaaaaccgaacgttgggtacggacgttacgaccaacccgattccgttaggtccctttacgaacttcccttaccccgctaacttccgttag

SEQ ID NO: 385964 - DNA, 541 bp, Homo sapiens
  misc_feature: GZ8MTXP02ICDI8.52.10.A10.1.454.CMB.2.raw
  modified_base (280)..(280): a, c, t, g, unknown or other
  modified_base (383)..(383): a, c, t, g, unknown or other
  modified_base (434)..(434): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattactcttacctggcctggtaccaacaaaacctgacccagctcccagctccncatctatgatgcatccaatccggcccagtcggacactcccagccaggttcagtggcaggtgggtctgggacagaccttcactctcaccatcagacaaccctanagcctagacgtactttgacttagtttatactgtcagacagtcgtagtaagnggtcgtcttacggccaaagggactacggacgtagggaaaggttaaaacgactaggtggactggacctaccgattcctgtcctctacttcctcccgtactattcctag

SEQ ID NO: 385965 - DNA, 604 bp, Homo sapiens
  misc_feature: GZ8MTXP02FNFTA.52.10.A10.1.454.CMB.2.raw
  modified_base (353)..(353): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttacctggcctggtaccaacaaaacctgcccaggctcccaggctcctcatctatgatgcatccaatcggcactggcatcccagccagttcagtggcagtgggtctgggacagacttcnctctcaccatcagaccaaacctagacgtccctagaaacgtcttttgactagttttatacgtgtacagacaggtacgttaagtaagtcggcgtaccttccgggacgtaaagggacctaacggacgtaggggtaaacggttaaaacgaacgttggtacgggtcctacgggaccctaacccgtaattcccgttacggttaacctttaccgtaacctttccccgtttacccccggacctaagtttcccttaaagg

SEQ ID NO: 385966 - DNA, 532 bp, Homo sapiens
  misc_feature: GZ8MTXP02JBB9B.52.10.A10.1.454.CMB.2.raw
  modified_base (288)..(288): a, c, t, g, unknown or other
  modified_base (358)..(358): a, c, t, g, unknown or other
  modified_base (420)..(420): a, c, t, g, unknown or other
  modified_base (524)..(524): a, c, t, g, unknown or other
  modified_base (531)..(531): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttacctggcctggtaccaacaaaacctgcccaggctcccagctcctcatctangatgcatccaatccgggcactggcactccccagccaggttcagtggcagtgggtctggggacagacttcnctctcaccatccagaccaacctagcgtcctagaagtactttgacttagtttatactgtacanacagtcgtaggtaagtcgggacgtccgtacggccgaagggtacacggacgtagggaagttaaaccgatggtagctgaccacacgtctgtcttcattcctacccnctactcng

SEQ ID NO: 385967 - DNA, 534 bp, Homo sapiens
  misc_feature: GZ8MTXP02GC7MK.52.10.A10.1.454.CMB.2.raw
  modified_base (359)..(359): a, c, t, g, unknown or other
  modified_base (432)..(432): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttacctggcctggtaccaaacaaaacctgcccaggctcccaggctcctcatctatgatgcatccaatccggccactggcactcccagccaggttcagtggcagtgggtctgggacagaccttcnctctcaccatcagccaacctagactcctagaacgtctttgacttagtttatacgtgtcagcagtcgtagtagngcgtcgtcggaccaagggcaacggactagggaacgttaaacgacgtggtcggctcgaccaacctcttcgtcgtcctactacttccctaccgactacttctag

SEQ ID NO: 385968 - DNA, 536 bp, Homo sapiens
  misc_feature: GZ8MTXP02GPDAJ.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccacctctcctgcagggccagtcagaatattacctcttacctggcctggtaccaacaaaacctgcccaggctcccaggctcctcatctatgatgcatccaatcgggaccacgtggcactcccagccaggttcagtggcaggtgggtctgggacagacttcactctcaccatcagcaaaccctgacgcctagaactactttgactagtttatactgtcagtcagtcgtaagtagtggcgcttaccggacaacggggacacggacgtagggaaacgttaaaacgacgtcgaggcctagaccaccatctagtcttacacttccgttacccactactcctag

SEQ ID NO: 385969 - DNA, 535 bp, Homo sapiens
  misc_feature: GZ8MTXP02I699B.52.10.A10.1.454.CMB.2.raw
  modified_base (351)..(351): a, c, t, g, unknown or other
  modified_base (358)..(358): a, c, t, g, unknown or other
  modified_base (384)..(384): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttacctggcctggtaccaaacaaaacctgcccaggctcccagctcctcatctatgatgcatccaatccggccactggcactcccagcctaggttcagtggcaggtggtctgggacngacttcnctctcaccatcacgcaaacctagacncctagaacgtctttgactagtttatctgtacagcgagtcgtagtaagtggcgtcgttcggacctaaggggacaccggagttagggaaaggttaaaccgacgtggtggactgacacctatctgtaacctctactccctaccgcctagtctag

SEQ ID NO: 385970 - DNA, 567 bp, Homo sapiens
  misc_feature: GZ8MTXP02G6ER5.52.10.A10.1.454.CMB.2.raw
  modified_base (276)..(276): a, c, t, g, unknown or other
  modified_base (562)..(562): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttactggcctgtaccaacaaactgccaggctccagctcctnatcatgatgcatccaagtcggaccacgtgcactcccagccaggttcagtgctagtcgggtctgggactagtacttcgactctacacatcagacaaacctagacgtcctaggtaataccgtttgaccttaagttttactacgtagtacagcaggtacgttaagtacggtggacgttcggtacggaccgaaagggcaaccggtagtagggaaacgtttaaaacgacgtaggtcggctacgactaccgtattcgtgttacctgtacgtcccttaccgacctattacgtntaaac

SEQ ID NO: 385971 - DNA, 635 bp, Homo sapiens
  misc_feature: GZ8MTXP02JU2D9.52.10.A10.1.454.CMB.2.raw
  modified_base (349)..(349): a, c, t, g, unknown or other
  modified_base (356)..(356): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctcatgagagagggccaccctctcctgcagggccagtcagaatattacctcttacctggcctggtaccaacaaaacctgcccaggctcccaggctcctcatctatgatgcatccaatcgggccacgtggcactcccagccaggttcagtggcagtggtctgggacngacttcnctctcaccatcagcaaacctagacgtcctagaacgttactttgacttaagttttacttaacgtgttcaagtccgaaggtccgttaaaggtaacggtgggtccgtacgtttccgggaaccggtaaacggggaccaacggtaccggttaaggggtaaaccgggtttaaaaacgtaaccggttggggtaccgggtacttcgggaaccctaccccgtaagtttcccttaacggtttcccgttcctaactttcccggtttcccccgacttaacttccgttaacg

SEQ ID NO: 385972 - DNA, 575 bp, Homo sapiens
  misc_feature: GZ8MTXP02GANUB.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccaggctcctcatcatgatgcatccaatcggccactggcatcccagccaggttcagtggcaggtcggtctgggacagtactcactctcaccatcagcaaaccgtagacgtccctaggaacgtacgtttgaccttaagtttattaacctggtaccagacctaaggtaccgttaaggtaaggtgggtccgtacggttaccgggacccaaggggaccacggtacggtagggtaaaggtaaaacgacgtaggtgggactggaccactactcgtgttactaacgtactccttcccactactctataag

SEQ ID NO: 385973 - DNA, 526 bp, Homo sapiens
  misc_feature: GZ8MTXP02H2L2U.52.10.A10.1.454.CMB.2.raw
  modified_base (326)..(326): a, c, t, g, unknown or other
  modified_base (351)..(351): a, c, t, g, unknown or other
  modified_base (371)..(371): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctccagatggtaccggagaaagtgtattgacacagtctccaggcaccctgtctttgtctccaggagagaggccaccctctcctgcagggccagtcagaatattacctcttacctggcctggtaacccaacaaaaacctgcccaaggctcccaggctcctcatctatgatgcatccaaatcggcactggcatccagccagtnagtgcagtggtctgggacagacttnactctcacatcagcaaactnagcctagaagcttgctagtttatactgtcagcaagtcgtaagtaaggtggacgtcgttacgggaccaaaaggggcaacggactaggggtaaggttaaaacgaacgttggacgggtctagcaaccgatctgtcttcattcctccgctacttcagaa

SEQ ID NO: 385974 - DNA, 585 bp, Homo sapiens
  misc_feature: GZ8MTXP02INPBX.52.10.A10.1.454.CMB.2.raw
  modified_base (318)..(318): a, c, t, g, unknown or other
  modified_base (336)..(336): a, c, t, g, unknown or other
  modified_base (372)..(372): a, c, t, g, unknown or other
  modified_base (420)..(420): a, c, t, g, unknown or other
  modified_base (425)..(425): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttactgcctgtaccaacaaaacctgcccagctcccagctcctcatctatgatgcatccaagtccgggccacgtggcatccccngccctaggttcagtggcnggtcgggtcgtgggacagtacttcactctcacctanccacgcaaactggactcctaggaactacttgacttagttttatacgtntcganctagtcgttagtaaggttcggacgttcgttaccggacgaacgggaactacggaacggtagggtaaacggttaaaaccgaacgttgggtacggtctacggaccactacgttcgtcgtttccttaactctttcccggtcccccatacttcgttaacgtaacg

SEQ ID NO: 385975 - DNA, 527 bp, Homo sapiens
  misc_feature: GZ8MTXP02FI5CH.52.10.A10.1.454.CMB.2.raw
  modified_base (430)..(430): a, c, t, g, unknown or other
  modified_base (483)..(483): a, c, t, g, unknown or other
  modified_base (514)..(514): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccaggctcctcatctatgatgcatccaagtcgggccactggcatcccagccaggttcagtggcaggtgggtctgggacagacttcactctcaccatccagacaaacctagacgctagaagactttgactagttattactgtcagcagcgtaagtaagnggacgtcgttcggaccgaagggacacggacgtaggtaaggtaacgaacgtagnggctcgcaccatctgtctcgactccgttccnctactctagtaac

SEQ ID NO: 385976 - DNA, 571 bp, Homo sapiens
  misc_feature: GZ8MTXP02HF9OT.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccagctcctcatctatgatgcatccaagtccggccactggcactcccagccctaggttcagtcggctaggtcgggtctggggacagtacttcgactcctacacatcagaccaaactagacgcctagaacgtactttgacttagtttactactgtacagtcaaggtcgttaagaagttcggcctacgttccgggacctaaggggacacggtacgtggaacggttaaaacgacgtggtacggcttacggactaccgtatcctagttcctaacgtacttccttccccgactacgtctactaa

SEQ ID NO: 385977 - DNA, 545 bp, Homo sapiens
  misc_feature: GZ8MTXP02JQMZM.52.10.A10.1.454.CMB.2.raw
  modified_base (355)..(355): a, c, t, g, unknown or other
  modified_base (359)..(359): a, c, t, g, unknown or other
tcagcgcagtacgacacgaccggtgctcgatttagcgtcgatctcagggggaggaactgctcagttaggacccatagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttacctggcctggtaccaacaaaacctgcccaggctcccagctcctcatctatgatgcatccaatcggccactggcatcccagccaggttcagtggcaggtggtctgggacagtacttcnctcncaccatcagccaaacctagacgtccttagaagtctttagctagtttattactgtacagcagtacgtagtaagtggcgtcgttcggacgaacgggacaacgtactagggtaagttaaaacgacgttggtacgccgtggaccaccgattcctggttccttctacgttccttaccccgactactactag

SEQ ID NO: 385978 - DNA, 576 bp, Homo sapiens
  misc_feature: GZ8MTXP02GN1TU.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccagctcctcatctatgatgcatccaatcggccactggcatcccagccaggttcagtggcagtcgggtctgggacagacttcactctcaccatcagcaaacctagacgcctagaagtactttgactagtttattactgtacagtcagtcgtaagtaagtgcgtcgttcggaccgtaagggacaacggtaacgtagggaaacgggtttaaaacgaacgttaggtacgggtactcggaccaaccgtactccgttacgttacttccgtaacttccgtttacccccggacctactccgttacggtaac

SEQ ID NO: 385979 - DNA, 617 bp, Homo sapiens
  misc_feature: GZ8MTXP02G2WEP.52.10.A10.1.454.CMB.2.raw
  modified_base (274)..(274): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttactgcctggtacaacaaaactgccagctccagctccncatctatgatgcatccaaagtccgggaccacgtcggcactccccagccctaggttcagtggactaggtcggggtctggggacagacttcgactctcacctatacagacaaacctagacgtacctagaaatacgtttgacttaagtttacttacgttgtacagtcgaaggtacgttaaggtaaggttggaccgtcgttaccggggaaccgaaaggggaccctaggtaaccggtagggtaaaacgggtttaaaacgaccgttaggtacgggtcgtacgaccgtaaactacgttccgtgttacttaacctacttcccgttaccccgactacgttacctagtaaacg

SEQ ID NO: 385980 - DNA, 532 bp, Homo sapiens
  misc_feature: GZ8MTXP02JUBUU.52.10.A10.1.454.CMB.2.raw
  modified_base (385)..(385): a, c, t, g, unknown or other
  modified_base (483)..(483): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccaggctcctcatctatgatgcatccaatcgggcactggcatccccagccaggttcagtggctaggtcgggtctggggacagacttcactctcaccatcagcaaacctagacncctagaacgtactttagctagtttatactgtcagcagcgtagtagtgcgcttcggcaagggacacgacgtgggtacgttaaacgacgttagcggtacncgacctactactcgtcttctcgtacttccgtcccgactactactacgta

SEQ ID NO: 385981 - DNA, 537 bp, Homo sapiens
  misc_feature: GZ8MTXP02F07UH.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccaggctcctcatctatgatgcatccaatcggccactggcatccccagccaggttcagtggcaggtcgggtctgggacagtcttcactctcacatcagacaaactagacgccctagaacgtactttgacttagtttattaactgtcagcagcgtaagtagtgcgtgtacggaccgaagggcacgacgtgggaagttaaacgaacgtggtggacgtcgactaaccgattcgtgttctcgtactccttaccccgctactccgtataa

SEQ ID NO: 385982 - DNA, 591 bp, Homo sapiens
  misc_feature: GZ8MTXP02HIMBC.52.10.A10.1.454.CMB.2.raw
  modified_base (387)..(387): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttacctggcctggtaccaacaaaacctgcccaggctcccaggctcctcatctatgatgcatccaagtcgggccactggcatcccagcctaggttcagtggcaggtgggtctggggacaggtacttcactctcaccatcagcaaacctagacncctagaacgtactttgactagtttatactgtcagcaggtacgtagtaagtggcgtcgttcgggaccgaaaggggccaacggtacgtaggggaaaacggtttaaaaccgaagttcgggtaggtcctaggaccctaaccgtacttccgttcgttaacccttacgaacctttcccgttacccccggactaacgtttaccttaaacgg

SEQ ID NO: 385983 - DNA, 530 bp, Homo sapiens
  misc_feature: GZ8MTXP02HVTBQ.52.10.A10.1.454.CMB.2.raw
  modified_base (235)..(235): a, c, t, g, unknown or other
  modified_base (357)..(357): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctnttacctggcctggtaccaacaaaacctgcccaggctcccaggctcctcatctatgatgcatccaatccggcacgtggcatcccagccaggttcagtggcagtgggtctgggacagtacttcncttctcaccatcacgcaaacctgaagccctagaacgtactttgactagtttatacgtgtacagcagcgtagtaagtggacgtcttcggaccaagggacacggtactgggtaagttaaaaccgagtggtaggctggacaccatcgtatccttcacttcctccgacctattctag

SEQ ID NO: 385984 - DNA, 580 bp, Homo sapiens
  misc_feature: GZ8MTXP02IR9BP.52.10.A10.1.454.CMB.2.raw
  modified_base (283)..(283): a, c, t, g, unknown or other
  modified_base (364)..(364): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagaggccaccctctcctgcagggccagtcagaatattacctcttacctggctggtaaccaacaaaacctgacccaggcctcccaggctccncatctatgatgcatccaagtccggccactggcactcccagccaggttcaggtcggcaggtgggtctggggacagtacttcncctctcacctatcacgccaaacctagacgcctagagtactttgactagtttatactgtcagacagcgttaagtaagtcggcgtcgtcgggaccaaaggggacacggacgtagggtaaacggttaaaaccgtacgtgggtacggtactaggaccctacgtacttccgttaggttccttacgtacgttcccctttaccccggccctaattcccttaag

SEQ ID NO: 385985 - DNA, 579 bp, Homo sapiens
  misc_feature: GZ8MTXP02G6X4H.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttactggcctggtaaccaacaaaacctgacccaggcctcccaggcctcctcatctatgatgcatccaagtccggccacgtggccactccccagccgtaggttcaggtggcacggtggggtcgtgggactagacttcactctcaccatcacgaccaactagacgaccgtagaagtacttgtacttagtttacttactcgtacagactaggtacgtaaggtaggtcggtacgtcgttacggaccgaagggtacacggtacgtagggtaaacgttaaacgtaacggtggtacgcgtacgacacctagtcgttcgtaacgttctactccctacccgactactcctaag

SEQ ID NO: 385986 - DNA, 606 bp, Homo sapiens
  misc_feature: GZ8MTXP02JH55Q.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaactgcccaggctcccaggctcctcatctatgatgcatccaatcgggccactggcactcccagccaggttcagtggcaggtcgggtctgggacaggtacttcacttcctaccaaccatccagaccaaacctagacgccctagaacgtactttgacttagtttatactgtacagcgaaggtcgtaaggtaaggtcgggctaccggttccggaaccgtaaaggggacaacggtacgtagggtaaacggttaaaacgaacgtcggttacggacttacggacctaaccgtacttcgttcgtttcccttaacgtctttacccgttccccggtacctacgttactacggttaaac

SEQ ID NO: 385987 - DNA, 594 bp, Homo sapiens
  misc_feature: GZ8MTXP02HDB1F.52.10.A10.1.454.CMB.2.raw
  modified_base (529)..(529): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaaccaaacaaaacctgcccaggcctcccaggcctcctcatctatgatgcataccaatccgggaccacgtggaccactccccagccctaggttcagtggctaggtcgggtcgtgggactagacttcaactctcaactatccagacaaacctagacgcctagaactcgtttgacttagtttactacttgtacagcgtagtcgtaagtagtggcttcggttaccggacgtaacggggacacggacggtagggtaaagttaaaaccggacttgggtacggtacncggacctaaccgtagtccgttcgttacctaaccgtcttacccgttcccgactcttcgtactaaac

SEQ ID NO: 385988 - DNA, 594 bp, Homo sapiens
  misc_feature: GZ8MTXP02GJLNG.52.10.A10.1.454.CMB.2.raw
  modified_base (278)..(278): a, c, t, g, unknown or other
  modified_base (439)..(439): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccgagaaagtgtattgacacagtctccaggcaccctgtctttgtctccatgagagagggccaccctctcctgcagggccagtcagaatattacctcttactgcctgtaccaaacaaaacctgcccagctcccaggctccncatctatgatgacatccaagtcgggccactggacactacccacgcctaggttcaggtggcaggtgggtctagggacagtaccttcactcctacaccgtatcacgacctaaaccctagacgtcccttaggaaacgtacctttgacctaagttttattaccgngtacacgacgtagtacggttagtacggcgtccgtacgtaccggacgaaggtaccaacgacggtaagggtaaacgttaaaacgtagtcgggtagtctacgacctaacctagttccgttactctttaccacgttcccgtaccccgactactacgtag

SEQ ID NO: 385989 - DNA, 643 bp, Homo sapiens
  misc_feature: GZ8MTXP02IU9LA.52.10.A10.1.454.CMB.2.raw
  modified_base (277)..(277): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagatattacctcttacctgcctggtaccaacaaacctgcccagctccagctcctnatctatgatgcatccaagtccgggccacgtcggcactccccagccgtaggttcagtggctaggtcgggtctgggacacgtacttcacctctcacctatccagaccaaacctgacgcctagaacgtactttgacttagtttactactagtcagtactaggtacggttaagtaacgggtggtaccgtacgttacccgggaccgtaacgggggacctaacggtaacggttaggggtaaaaccgggttaaaacgtaacgttacggtacgggtaccgttcggaccctaaccgtacgttaccgttcggtttacccttaaccgtactttaccccgttacccccggacctttacgttaccgttagttaaacccg

SEQ ID NO: 385990 - DNA, 553 bp, Homo sapiens
  misc_feature: GZ8MTXP02G6ZWO.52.10.A10.1.454.CMB.2.raw
  modified_base (237)..(237): a, c, t, g, unknown or other
  modified_base (269)..(269): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagatatacctctacngctgtaccaacaaactgccagctccagctctnatctatgatgcatccaatcggccacgtggcactcccgagccaggttcagtggcacgtcgggtctgggacagtaccttcgactctacacctatccagaccaaacctagacgtaccctagaaacgtactttgacttagttttactacgtgtacagcgtagacgtagtagtcggacgtcgttacggacgtaagggacaacgcgtagggtaaacgttaaacgacgtgtagggcctaggccaaccattctacggttctacctactcccgttcccgacctaatccgtaag

SEQ ID NO: 385991 - DNA, 509 bp, Homo sapiens
  misc_feature: GZ8MTXP02FGJGZ.52.10.A10.1.454.CMB.2.raw
  modified_base (362)..(362): a, c, t, g, unknown or other
  modified_base (485)..(485): a, c, t, g, unknown or other
  modified_base (491)..(491): a, c, t, g, unknown or other
  modified_base (503)..(503): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatatacctcttacctggcctggtaccaacaaaacctgcccaggctcctaggctcctcatctatgatgcatccaatcgggccactggcatccccagccaggttcagtggcagtcgggtctggggacagacttcactcncaccatcagcaaacctagacgcctagaagtactttgctagttattactgtcagcagcgtagtagtgcgcttcggccaagggacacgactagggaagttaaacgaactgtaggctgcaccatcngtactnatcctccgctanctgtac

SEQ ID NO: 385992 - DNA, 627 bp, Homo sapiens
  misc_feature: GZ8MTXP02H77TA.52.10.A10.1.454.CMB.2.raw
  modified_base (347)..(347): a, c, t, g, unknown or other
  modified_base (363)..(363): a, c, t, g, unknown or other
  modified_base (391)..(391): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttactggcctggtaccaacaaacctgcccaggctcccagctcctcatctatgatgcatccaatccggggccacgtggcactcccagccaggttccaggtggcaggtgggtcnggggacagtaccttcnctctcacctatccagaccaaacctaganccctagaatactttgacttagttttacttacgtgtacagtcgagtacggtaaggttaacgtcgggtaccgtacgtttaccgggaccgtaaacgggggtaccaaacgggtacttagggggtaaaacggtttaaaacccggacgttagggttcggaccgttacggaccctacccgtagttcctttcggttaaccttccggtaactttcccccttacccggacccttaggttacctacg

SEQ ID NO: 385993 - DNA, 569 bp, Homo sapiens
  misc_feature: GZ8MTXP02I7LV5.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctccagatggtaccggagaaagtgtattgacacagtctccaggcaccctgtctttgtctccaggagagagggccaccctctcctgcagggccagtcagaatattacctcttactggcctggtaaccaaacaaaacctcgacccaggctcctaggctcctcatctatgatgcatcaatcgggccagtgcatcccagccaggttcagtggacaggtcggtctgggacagtacttcactctcacatcagaccaaactagacgcctagaaacgtactttggacttaagttttatacttcgtacagtctaaggtcgttaagtaaggttggacgtcgttaccggacgaaacggggacacggtaacggtagggtaaacggtaaacgaacgtggtacggctgacctactactcttagtccttaactactcccttccgactactctagtaaac

SEQ ID NO: 385994 - DNA, 653 bp, Homo sapiens
  misc_feature: GZ8MTXP02I1AQ5.52.10.A10.1.454.CMB.2.raw
  modified_base (273)..(274): a, c, t, g, unknown or other
  modified_base (398)..(398): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttactgcctggtacaacaaacctgccagctccagctcnntcatgatgcatccaatcgggaccacgtcggcactccccagcccaggttccaagtcggcgaggtcgggtacgtagggacacggtacttcacttctccaactactacacgacctaaaccgtagacnccgtagaacgtacgtttgaccttagtttactactacgtacgagcgtaggtacgttaagggtaacgtgggaccgtacggtttaccggaacccgtaaaggggacctaacggaacggttagggtaaaacgggtttaaaacccgacgttaggtacgggtacttaccgggaaacctaaacctcggttacgttccgtttaccgtttaaccgtaccgtttcccctttacccccggccctagttacccgttagtttaaaaccg

SEQ ID NO: 385995 - DNA, 623 bp, Homo sapiens
  misc_feature: GZ8MTXP02F7RP2.52.10.A10.1.454.CMB.2.raw
  modified_base (282)..(282): a, c, t, g, unknown or other
  modified_base (363)..(363): a, c, t, g, unknown or other
  modified_base (394)..(394): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttacctggcctggtaccaaacaaaacctgccaggctcccagctcctnatctatgatgcatccaagtccgggccacgtggacactcccagcctaggttccagtggcaggtgggctgggacagaccttcncctctcacctatcacgtaccaaacctagganccctagaaacgtctttagactaagttttacttaacgtgtaccagtacgtaggtaccgttaagtaacgggtggtaccggtaccgttaccgggacccgtaaaggggacctaaccgggtaccgttaaggggtaaacggtttaaaacgaaccgttgggttacggacgttcggacctaccgtattcgtacggttccttactaacgtttcccgttcccgacctaagttccgtaag

SEQ ID NO: 385996 - DNA, 532 bp, Homo sapiens
  misc_feature: GZ8MTXP02H37SM.52.10.A10.1.454.CMB.2.raw
  modified_base (237)..(237): a, c, t, g, unknown or other
  modified_base (253)..(254): a, c, t, g, unknown or other
  modified_base (269)..(269): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctcaggagagagggccaccctctcctgcagggccagtcagaatatactcttacngctgtaccaacaaacnnccagctccagctccncatcatgatgcatccaaagtcggcactggcatccagccaggtcagtggcaggtcggtctaggggacagacttcacttcctcacatacagaccaaacctagaacgcctagaaagtactttagacttaagtttactaactgtacagacagtacgtagtaaggtggacgcgttcgggaccaaagggacacggactagggaaagttaaaacgaacgtgtacgggctgaccaccatcgtgtctcacttccttacccgctactctagac

SEQ ID NO: 385997 - DNA, 573 bp, Homo sapiens
  misc_feature: GZ8MTXP02GE6BG.52.10.A10.1.454.CMB.2.raw
  modified_base (241)..(241): a, c, t, g, unknown or other
  modified_base (345)..(345): a, c, t, g, unknown or other
  modified_base (357)..(357): a, c, t, g, unknown or other
  modified_base (382)..(382): a, c, t, g, unknown or other
  modified_base (414)..(414): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttaccnggcctggtaccaacaaaactgacccaggcctcccagcctcctcatctatgatgcatccaagtcggctacgtgcactcccagcctagtcaggtgcaggtgggtcngggacagactcnctcacaccatcagccaaactagacncctaagactacttgacctagtttaactacgtntacgagtaccagtacgtaagtaggtcgcgacgttacggacgaagggacacggtagtagggtaaaacggttaaacgacgttggacgtacgacgtacccaacgttacttcggttacgttccttacccgtaatttcccccgttccgacttactaccgttaag

SEQ ID NO: 385998 - DNA, 584 bp, Homo sapiens
  misc_feature: GZ8MTXP02FZ9PI.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccagctcctcatctatgatgcatccaagtccggccactggcactccccagccaggttccagtggctaggtgggtctggggacaggtactcactctcaccatccagtaccaaaccttgacgcctagaacgtactttgacttaagtttataactgtacagctaggacgttaggtaagtggcgtccgttacgggaccgtaaggggacacgggtacgtacgggtaagttaaaaccgacttggtacgggtctacggacctacctacgtccgttcgttactaaccgtacttacccttcccgacctagttcctagtaac

SEQ ID NO: 385999 - DNA, 584 bp, Homo sapiens
  misc_feature: GZ8MTXP02JF6NT.52.10.A10.1.454.CMB.2.raw
  modified_base (349)..(349): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccaggctcctcatctatgatgcatccaatcggccactggcatcccagccaggttcagtggcagtcgggtctgggacngacttcactctcaccatccagcaaacctagacgcctagaaacgtactttgctaagtttacttaactgtacagctagtccggtaagtaacggtgggaccgtcgtttaccgggaccgaaacgggggacaaccggtacgtaggggtaaacggttaaaacgtacttaggtacggacgtcggacctaaccgtatacctgttaccttcaacgtttccctcccgacctacttcgtacgtaac

SEQ ID NO: 386000 - DNA, 650 bp, Homo sapiens
  misc_feature: GZ8MTXP02IUFXY.52.10.A10.1.454.CMB.2.raw
  modified_base (276)..(276): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccgaggagagagggccaccctctcctgcagggccagtcagaatattacctcttacctggcctggtaccaacaaaactgccagctcagctcnatctatgatgacataccaagtccgggaccacgtcggacactcccagcctaaggttcaaggtggactaggtcgggtctaggggactagtacctcgactctccaacatccagtaccaaacgtagacgtcctaaggaacgttacctttaggactaagtttttaactacgtagttaccgaagccgtaaaggtaccgtttaaagtaaggttccggtaccgtaccggtttaccggggaaaccccgaaagggggtaccttaaccgggaacggttacgggtaaaccgttaaaacggtaacctggggtacgaccgttacgacccgtaaactcgttacttgtaccttaaccgtcgtcccttacccgacctatcgtaacgtaacg

SEQ ID NO: 386001 - DNA, 522 bp, Homo sapiens
  misc_feature: GZ8MTXP02G75PR.52.10.A10.1.454.CMB.2.raw
  modified_base (241)..(241): a, c, t, g, unknown or other
  modified_base (256)..(256): a, c, t, g, unknown or other
  modified_base (356)..(356): a, c, t, g, unknown or other
  modified_base (378)..(378): a, c, t, g, unknown or other
  modified_base (387)..(387): a, c, t, g, unknown or other
  modified_base (417)..(417): a, c, t, g, unknown or other
  modified_base (493)..(493): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttaccnggcctggtaaccaanaaaacctgcccaggctcccaggctcctcatctatgatgcatccaatcggccactggcatcccagccagtcagtgcagtggtctgggacagacttcactcncaccatccaagcaaacctagancctaggaanactttgactagtttattaactgcaagcagngtagtaagtgcgcgttcgcgaacggacgacgacgtaggaaggtaaacgtaaacgtagtaggacgtacgacacactntctcgtctactctccgtacctactactcg

SEQ ID NO: 386002 - DNA, 542 bp, Homo sapiens
  misc_feature: GZ8MTXP02JJ2SK.52.10.A10.1.454.CMB.2.raw
  modified_base (272)..(272): a, c, t, g, unknown or other
  modified_base (279)..(279): a, c, t, g, unknown or other
  modified_base (417)..(417): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttactgcctgtacaacaaactgccagctccagctctnatctatnatgcatcaatcggccatggcatcccagccaggttcagtgcagtcgggtctgggacagcttcactctcacatcagcaaacctagacgcctagaacgactttgactagttttactactgtacagcctagcgtaagtaagnggtctacgttcggacgaagggaccaacggacgttagggaacggtttaaaacgaaccggttaggtggtactacggaccaaccagtcctagtacttctactcccttacccgctacgttcctagtaac

SEQ ID NO: 386003 - DNA, 569 bp, Homo sapiens
  misc_feature: GZ8MTXP02GBPXU.52.10.A10.1.454.CMB.2.raw
  modified_base (279)..(279): a, c, t, g, unknown or other
  modified_base (339)..(339): a, c, t, g, unknown or other
  modified_base (355)..(355): a, c, t, g, unknown or other
  modified_base (359)..(359): a, c, t, g, unknown or other
  modified_base (374)..(374): a, c, t, g, unknown or other
  modified_base (406)..(406): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccacctctcctgcagggccagtcagaatattacctcttacctggcctggtaccaacaaaacctgcccaggctccagctccncatctatgatgcatccaatcgggccatggcactccagccaggttcagtggcaggtgggcngggacagcttcactcncacntacagacacgagacncgtaagagtactttgacttagtttactatganagtcgagtcgtaaggtacgtcggacgtcggttacggaccgaaggggacccaaggtaccgtaggaaacggttaaacgagttacggtggtacgtcggaccacgtacgtccttacggttcctaacgtacccttcccgttacccgtacctacggtcctaagtaaccg

SEQ ID NO: 386004 - DNA, 612 bp, Homo sapiens
  misc_feature: GZ8MTXP02HCMYJ.52.10.A10.1.454.CMB.2.raw
  modified_base (280)..(280): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtatgacacagtctccaggcaccctgtctttgtctccaggagagagggccaccctctcctgcagggccagtcagaatattacctcttacctggcctggtaccaacaaaacctgcccaggcctccagctccncatctatgatgcatccaaagtccgggccacgtggccactccccagccgaggttcagtggcaggtcgggtctgggacagtacttcactctcacatcagaccaaactagacgcctagaacgtacttgacttagtttactactgtaccagccagtacgttaagtaacgtggaccgtcgttaccggaccgtaaagggacaacggacgtagggtaaacggtttaaaacgacgttaggtacggtacgtacgaaccgaacccgtagttccgttacgttaccgttaacttaaccgtttccccgttaccccggtaccttaactttccggtaatttaaaccg

SEQ ID NO: 386005 - DNA, 588 bp, Homo sapiens
  misc_feature: GZ8MTXP02FF8D4.52.10.A10.1.454.CMB.2.raw
  modified_base (429)..(429): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctcaggcaccctgtctttgtctccatgagaggaggccaccctctcctgcgagggccagtcagaatattacctcttacctggcctaggtaaccaaacaaaacctcgacccaggcctccccgagcctcctcatctatgatgcatccaagtccgggccacgtggcactccccagcctaggttcaggtggctaggtgggtcagggacagaccttcactcctacacatcagaccaaactagacgcctaggaatcttgtactagtttatactnactagacagtacgtaaggtagtcggtaccgtcgttaccggacgaaaggggtaccacggtaacgtaggggtaaacggttaaaacgaacgttggtcggtactacggaccaccgtaagttccttgttaaccttctacgttcccttcccgctacgtcttaacg

SEQ ID NO: 386006 - DNA, 534 bp, Homo sapiens
  misc_feature: GZ8MTXP02HO2DG.52.10.A10.1.454.CMB.2.raw
  modified_base (434)..(434): a, c, t, g, unknown or other
  modified_base (439)..(439): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttacctggcctggtaccaacaaaacctgcccagctccagctcctcatctatgatgcatccaatccggccagtggcatcccagccagttcagtgcagtgggctgggacagacttcactctcaccatcacgaccaaaccctagacgtaccctagaacgtacttttgactagttttatacgtgtacagcagtcgtaagtagngcgtnttcggacgagggacacggactagggtaagtaaaacgactggtggactggacaccgtattccgtagttcctacacttccgtcccgactacttctag

SEQ ID NO: 386007 - DNA, 662 bp, Homo sapiens
  misc_feature: GZ8MTXP02I80C9.52.10.A10.1.454.CMB.2.raw
  modified_base (368)..(368): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttactggcctggtaaccaaacaaaactgcccaggcctccagctcctcatctatgatgcatccaagtccgggaccacgtcggcactcccagcctaggttcagtggcaggtcggtctgggacacgtcttcactcncaaccagtcagacaaactagacgcctagaaagtactttgacttaagtttacttaacgtcgtacacgcgtaagtacgggttaacggtaaaggtgggacccgtacggttaccgggaacccggttaaaaggggacctaaccggtaaggtacgggggttaaaacggttaaaaccggtaaacggttgggttaacgggactttaccgggaaccctaaaacccggttacgtttaccgttacgtttacccttaacgtacccgtttaccccgttaccccgacttacgttaccgttagtaaacg

SEQ ID NO: 386008 - DNA, 575 bp, Homo sapiens
  misc_feature: GZ8MTXP02I5TU6.52.10.A10.1.454.CMB.2.raw
  modified_base (567)..(567): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgacccaggctcccaggctcctcatctatgatgcatccaatcggccactggcatccccagccaggttcagtggcagtcgggtctggggacagtacttcgactctcacctagtccagacaaacctagacgacctagaaacgtactttagccttaagtttacttaactgtacagcaggtacgttaagtaacggtgtccgtacgttaccggaccgtaaacggggactacggtacgtagggaaacgttaaaacgaacgtggtacgcgtcggaccactacgtctgttactcacttccttcccgactacgtntacgtaac

SEQ ID NO: 386009 - DNA, 657 bp, Homo sapiens
  misc_feature: GZ8MTXP02JDK9Z.52.10.A10.1.454.CMB.2.raw
  modified_base (279)..(279): a, c, t, g, unknown or other
  modified_base (359)..(359): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttactggcctggtaccaacaaaactgcccaggctccagctcctnatctatgatgcatccaatccggccatgcactcccagccagttcagtggctagtcgggtctggggacagtacttcacttcncaccatccagaccaaacctgacgccctagaacgtacctttagacttaagtttacttacgtgttaccagactaggtaccggttaaggtaaacgttcgggactaccggtttaccgggaaccgtaaacggggacctaaacgggtacgtacggggtaaacggtttaaaacccgaaggttacgggtacggtccgttaacgggaccctaaccgggtaacttccgggtttacgttaccctttaacggtaaaccgttttacccccttcccccggtaccgttactttacccggtaagtttaaacccg

SEQ ID NO: 386010 - DNA, 616 bp, Homo sapiens
  misc_feature: GZ8MTXP02HJU9V.52.10.A10.1.454.CMB.2.raw
  modified_base (289)..(289): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccaggctcctcatctangatgcatccaatcggccactggcactcccagcccaggttcaggtggcgaggtcggggtctggggacagtcttcactcgcacatcagacaacctgaacgcctagaagtacgtttacgattagtttttacttacgtggttccaacgcgtaaacgtcgttaaaggtaaggttaggtccgtacggtttaccggaccgtaaacgggggacctaacggtacgtaaggggtaacggttaaaacgaacgttcggtacggcgttacggaccaccgtaattccgtacgttaccttaaccgtacttccccggttcccacctacgttccttaaggtaac

SEQ ID NO: 386011 - DNA, 582 bp, Homo sapiens
  misc_feature: GZ8MTXP02I6OG7.52.10.A10.1.454.CMB.2.raw
  modified_base (277)..(277): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccacctctcctgcagggccagtcagaatattacctcttacctgcctggtaccaacaaaacctgcccaggctccagctcncatctatgatgcatccaagtcggccactggcatcccagcctaggttcagtggctaggtcggtctaggggacagtacttcactctacacatcagacaaaccgtgacgtcctagaacgtacttgactaagtttcttactgtacagcagtacgtaggtaaggtggcgtcgttacgggacccgtaagggaccacggtacgtacgggtaacggttaaaacgacgttaggcggtactacggacaacctcgtacgttcggttaccttaacgactttcccgttaccccgtacctacgttaccgtacgttaacg

SEQ ID NO: 386012 - DNA, 516 bp, Homo sapiens
  misc_feature: GZ8MTXP02FQCQV.52.10.A10.1.454.CMB.2.raw
  modified_base (360)..(360): a, c, t, g, unknown or other
  modified_base (415)..(415): a, c, t, g, unknown or other
  modified_base (507)..(507): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttacctggcctggtaccaacaaaacctgcccaggctcccagctcctcatctatgatgcatccaatcggccactggcatcccagcctaggttcagtggcaggtgggtctgggacagacttcactcncaccatcagcaaacctagacgcctagaacgtctttgactagttttatactgtacngcagcgtagtagtggcgtcttcggacaaggggcaacgcgtagggaaggttaaacacgtggagctgactacatctgtctcactccgttacccnctactctag

SEQ ID NO: 386013 - DNA, 674 bp, Homo sapiens
  misc_feature: GZ8MTXP02H4QRI.52.10.A10.1.454.CMB.2.raw
  modified_base (273)..(273): a, c, t, g, unknown or other
  modified_base (310)..(310): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctcaggagagagggccaccctctcctgcagggccagtcagaatatacctcttactgcctgtaccaacaaaacctgccagctccagctctnatcatgatgcatccaagtcggcacgtggcactccccngacccgtaggttcaaggttcggacgtagggtcgggtcgtaggggacacggtacttcgacctctaccacatacacgaccaaacctagacgccgtagtaaacgtacgtttagacttaagttttactacgttagttaccagtacgtaggtaacggttaggtaaacgggttcgggaccgtacgttacccggggaacgaaacggggtacctaacggtacggttaacggggtaaaaggtttaaaacccgtaacggttagggtaccggtacgttacgaacccgtaccgtacgttcccgtttacggtccctttaaccggacctttaaccccgttcccccggtattaaacccgtttccgtttaaggtaaaccg

SEQ ID NO: 386014 - DNA, 538 bp, Homo sapiens
  misc_feature: GZ8MTXP02I9B9J.52.10.A10.1.454.CMB.2.raw
  modified_base (358)..(358): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttacctggcctggtaccaaacaaaacctgacccaggcctcccaggctcctcatctatgatgcatccaatcggccactggcatcccagccaggttcagtggcagtggtctgggacagaccttcnctctacacctatcagccaaacctagacgcctagaagtctttgactagtttatactgtacagcagtcgtagtagtcggcgtcttcggacaaggggcaacggactagggaaacggttaaacgaacgtggtacggctaggacctaccgtatcgttagtcttcacttccttccccgctatctag

SEQ ID NO: 386015 - DNA, 563 bp, Homo sapiens
  misc_feature: GZ8MTXP02FMLB7.52.10.A10.1.454.CMB.2.raw
  modified_base (355)..(355): a, c, t, g, unknown or other
  modified_base (407)..(407): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagaggccaccctctcctgcaggccagtcagaatattacctcttacctggcctggtaaccaacaaaactgccagctccagctcctcatctatgatgcatccaatcggccactggcactccccagccaggttccagtggcaggtgggtctggggacagtacttcnctctcaccatcagccaaactagagctagaagtacttgtactagtttattacngtttttacagtacgagtacgtacgtaagtggtacgtcgttaccggacgaacgggacgacggacgtagggtaaacgggttaaaacggtaacgtggtacggtcgtggaccacgtactcgttacgtcgttactacttccttcccgtacctactcttacg

SEQ ID NO: 386016 - DNA, 574 bp, Homo sapiens
  misc_feature: GZ8MTXP02FIN42.52.10.A10.1.454.CMB.2.raw
  modified_base (241)..(241): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtacccggagaaagtgtattgacacagtctccaggcaccctgtctttgtctccaggagagagggccaccctctcctgcagggccagtcagaatattacctcttacnggcctggtaccaacaaacctgcccaggctcccaggctcctcatctatgatgcatccaagtccgggccactggccactccccagcccaggttccagtggctagtcgggtctggggacagacttcactctcacatcagcaaacctagacgcctagaagtactttgactagtttattactgtcagcagtcgtaagtagtggccgtcgttccgggccaaaggggacctaacggtaccgtagggtaaacggtttaaaacgaacgtggttaggcttaacggccaacctacttcctagttccttcgtactccctttaccccgctaactccttaggtaaac

SEQ ID NO: 386017 - DNA, 563 bp, Homo sapiens
  misc_feature: GZ8MTXP02FS63C.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccaggctcctcatctatgatgcatccaaatcggccacgtggcacgtccccagcccgtaggttcaggtggcaggtcgggtactggggacagtacttcactctccacatcagtcaaacgtgagcctagaacgtactttgactagtttattactgttaccagcagtcgtaagtacgtggaccgtcgttacggaccgaagggacgaacgtacgtagggaaacgttaaacgacgttaggtcggactcgacacgtacttctcgttactcgtactcccttacccgctacttctataac

SEQ ID NO: 386018 - DNA, 657 bp, Homo sapiens
  misc_feature: GZ8MTXP02FX95F.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtatattgacacagtctccaggcaccctgtctttgtctccaggagagagggccacctctcctgcagggccagtcagaatattacctcttacctgcctggtaccaacaaacctgccagctccagctcctcatctatgatgcataccaatccgggccacgtcggacactcccagccaggttcaggtgcaggtcggtctggggacagtcttcgactctcaccgatccagaccaaacctagacgcctagaacgtctttgacttagtttacttaactcgttacacgacgtaggtacgttaaggttaaggtcggtccgttaccggtttaccggaacccggtaaaggggtacctaacgggaccggttaaggggtaaacggtttaaaacggtaaccgttaagggtcgggtacgttaccgggaacctacccgttaagttaccgtttacggtttccccgtttaacgtaacccttttcccgttacccccggtactaaccgtttaccgtacggtttaaaccg

SEQ ID NO: 386019 - DNA, 552 bp, Homo sapiens
  misc_feature: GZ8MTXP02JN12B.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccaggcctcctcatctatgatgcatccaagtcggccactggcatcccagccaggttcagtggcagtcgggtctgggacagacttcactctcacatcagcaaacctagacgcctagaacgtactttgactaagtttatactgtacagcagtcgtagtagtggacgtcgtacggcaagggacacggacgtaggaacggttaaacgaacgttggtcggctacggacctacctagttcctcgttcttaacctacgttccgttacccgctacttccgtagtaacc

SEQ ID NO: 386020 - DNA, 585 bp, Homo sapiens
  misc_feature: GZ8MTXP02IHFTL.52.10.A10.1.454.CMB.2.raw
  modified_base (266)..(266): a, c, t, g, unknown or other
  modified_base (286)..(286): a, c, t, g, unknown or other
  modified_base (354)..(354): a, c, t, g, unknown or other
  modified_base (436)..(436): a, c, t, g, unknown or other
  modified_base (572)..(572): a, c, t, g, unknown or other
  modified_base (576)..(576): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagacgggcccacctctcctgcagggccagtcagaatattacctcttacctggcctaggtaacccaacaaaaccngcccaggctcccagctcccncatctatgatgcatccaatcggccactggcactcccagcctagtcagtcgcgtaggtcgtcgtggacngtacctcactcctacacactcgacaccaactacgctactaagatactttcgattagttttaatacgttcacgtactaacggngtaggttaacggtagtccgggtcggttaaccgtccggaaaccggaaggaccgaacggtaggtaacggggtaaaacgtaaaacgtaacggtggtaggcgtcgaccttacgtactcgtctccttactcttccgtaccncctntaccggtaa

SEQ ID NO: 386021 - DNA, 709 bp, Homo sapiens
  misc_feature: GZ8MTXP02F9FBC.52.10.A10.1.454.CMB.2.raw
  modified_base (243)..(243): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagacggccaccctctcctgcacgggccagtcagaattattacctcttaccnggcctggtaaccaaacaaaacctcgacccaggcctcccaggcctcctcactctactgatgcatccaacgtccggaccacgtggacactcccagtcctaggttcaggtcggcgaggtgggtcgtagggactagtaccttcaccgtcctacaccgtactcaacgacctaaaccgtagactacccgtagtaaacgttacgtttacggtacttagtttttaaactttacgttacggtacgtaacgtaccggtaaagggttaccggttaagggttaacggttcggggtacccggtaccggtttacccgggaaaccggtaaaacggggtaccgtaaaccgggtacggttaacgggggtaaaacggggtttaaaacccgaacggtttcgggtacgggtcgttacggaaccctaccgtacttaccgttcgttaacctttcgtaccttcccgttacccaccttacttcgttaacg

SEQ ID NO: 386022 - DNA, 712 bp, Homo sapiens
  misc_feature: GZ8MTXP02IB5CA.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccacctctcctgcagggccagtcagaatattacctctacctggcctggtaccaacaaaacctgcccaggctccagctcctcatctatgatgcactcctaagtccggggaccctaacgtcggaccaacgttcccccgacgccgtaggttaccgaggtcggcgtaccggggtacggggttccggtacggggaacacggttacctttaccaccttccctaccaaccctactaccgaacgaccctaaaccgtacgacgacccgttaggaaacgtttacttacgtacgtttaagttttaataccgtagtacgacggaccgtaaggttaccggtaaagggttacggtccggtcggttacccggtaccggaaccggtaacgggaccgaacggtacggtaagggtaaacggttaaaacgtacggtgggtacggtactacggacccgtaaccgttacgttaccgttacgttaacccgttacgttacccgtttccccgtacccgtaccttacgttaccgtaacg

SEQ ID NO: 386023 - DNA, 550 bp, Homo sapiens
  misc_feature: GZ8MTXP02GQNOV.52.10.A10.1.454.CMB.2.raw
  modified_base (381)..(381): a, c, t, g, unknown or other
  modified_base (519)..(519): a, c, t, g, unknown or other
  modified_base (540)..(540): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttactggcctggtaccaaacaaaacctgacccaggctcccgagctcctcatctatgatgcatccaagtcggaccacgtggcaatccccagcctaggttcaggtgcgaggtgggtctaggggacacgtacttcaccttcacacctanccaagtccaaaccgtagacgtcctagaagtacttgactagttttaatacgtgactagcagtcgtaagtagtcgcgtctacggacaaggctagacgtggaacgttaaacacgtggacggtctagctaccgtatccgttntaacctctaccttccgtaccnctactactcg

SEQ ID NO: 386024 - DNA, 585 bp, Homo sapiens
  misc_feature: GZ8MTXP02FGC53.52.10.A10.1.454.CMB.2.raw
  modified_base (370)..(370): a, c, t, g, unknown or other
tcagcgcagtacgacacgaccggtgctcgatttagcgtcgatctcagggggaggaactgctcagttaggacccagagggaaccatggaagccccagctcagcttctcttcctcctcccgctactctggctcccagatggtaccggagaaagtgtattgacacagtctccaggcaccctgtctttgtctccaggagagagggccaccctctcctgcagggccagtcagaatattacctcttacctggcctggtaccaaacaaaacctgcccaggctcccaggcctcctcatctatgatgcatccaatccgggccactggcactccccagccaggttcagtggcaggtcggtctgggacagacttcactccncaccatcagtacaaactagacgcctagaaacgtctttgacttagtttattactgtcagtcagtcgtaagtaggtggcgtcgttcgggaccaaagggggaccaacggtacctaggggaaacggtttaaaacgaacgttgggtaggctacggacctacccgtaattcccgtgttaccttaacaccttcccgttcccccgactaacgtcctggtaaac

SEQ ID NO: 386025 - DNA, 611 bp, Homo sapiens
  misc_feature: GZ8MTXP02JFTS9.52.10.A10.1.454.CMB.2.raw
  modified_base (281)..(281): a, c, t, g, unknown or other
  modified_base (376)..(376): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagaggccaccctctcctgcagggccagtcagaatattacctcttacctggcctggtaccaaacaaaacctgcccagcctccagctcctnatctatgatgcatccaagtccgggccacgtggcactccccagccgaggttcaggtggctaggtcggggtctggggacagtacttcactctcactntccagcaactacgacgcctagaacgtatttgacttatttattacttgtcagcctaaaggcggttaaggtaaggttcgggcgtacggttccggaccggaaacggggtaccaacggacgttaacggggtaaacggttaaaaccgacgtacggttcgggactcgaacctaccgtaacgttccgtgttaccttaacacgtttccccttaccccggacctaacgtttcctagtttaaacg

SEQ ID NO: 386026 - DNA, 657 bp, Homo sapiens
  misc_feature: GZ8MTXP02IDB27.52.10.A10.1.454.CMB.2.raw
  modified_base (547)..(547): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctccagatggtaccggagaaagtgtattgacacagtctccaggcaccctgtctttgtctcatgagaggacggccacctctcctgcagggccagtcaagtaatacttacctcttacctggcctagtaaccaaacaaaacctcgaccaggcctcccgaggctcctacatcgtatgaatcgactactacctaacgtccggacccaagtcggtaccaacttccccgacggtccgtaaggttcgaggtcgggacgtagggtcggggttcgaggggaccaggtaccttcaccttcctacaccctagtccacgacctaaaccctagaccgctaagtaacgtctttgtacttagtttttataactcgtacacgtacggtagtacggttaaggtacggtgtaccggcgtttaccggacgaaaggggtaccncggtaaacggttcggggaaaagttaaacccggacgttgggttacggacttacggacctactacgttcttcggttaacctcgtaccttcccttaccgacctacgttatacg

SEQ ID NO: 386027 - DNA, 609 bp, Homo sapiens
  misc_feature: GZ8MTXP02FKNY2.52.10.A10.1.454.CMB.2.raw
  modified_base (391)..(391): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaaacaaaacctgacccaggcctcccgaggcctcctcatctatgatgcatccaagtcggccacgtggcactcccagcccaggttcagtggcaggtcgggtctgggacagtactcactctccacatcagaccaactagacncctagaagtactttgctagtttattactgtcagctaggacgttaagtaaggtcgtcgtcggttaccggcccaaaggggaccacggtacgtacggggaaaggtttaaacggaactgggtacggaccttacggaaccctacccgtaagttccttcggtttcctttaaccgtaactttcccccggtttacccccgaccttaagttccctaaggtttaaccg

SEQ ID NO: 386028 - DNA, 565 bp, Homo sapiens
  misc_feature: GZ8MTXP02F6DUL.52.10.A10.1.454.CMB.2.raw
  modified_base (284)..(284): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatatacctcttacctggcctggtacccaacaaaacctcgacccaggctcccaggctccncatctatgatgcatccaatcgggccactggcactcccagccaggttcagtggcagtcgggtctggggacagtactacactctcaccatcagtacaaaccgtagacgtccctagaaacgtactttgactagtttactttactgtcagcaggacgtagtaacggtgcgtacgttcggaccgaaaggggacacggacgtgggaaacggttaaaacgaaactggtagcgtacgacacctagtcgtgttccttcgaacttccttccccgacctacttcctacgtaa

SEQ ID NO: 386029 - DNA, 564 bp, Homo sapiens
  misc_feature: GZ8MTXP02I0TRR.52.10.A10.1.454.CMB.2.raw
  modified_base (273)..(273): a, c, t, g, unknown or other
  modified_base (278)..(279): a, c, t, g, unknown or other
  modified_base (284)..(284): a, c, t, g, unknown or other
  modified_base (286)..(286): a, c, t, g, unknown or other
  modified_base (340)..(340): a, c, t, g, unknown or other
  modified_base (411)..(411): a, c, t, g, unknown or other
  modified_base (416)..(416): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggcccaccctctcctgcagggccagtcagaattacttacctcttacctgcctgtaccaacaaacctgcccagctccngctcnntctangntgcatcagtcggcacgtgcactcccagccgtaggttcagtggctggtcggtcgngggacagtctcactcacacactcacgacaaaccgtgacgtctagtaacgtcttagacttagtttactactntagangtacgtcgtaagtacggtgccggtacgtccggaccgtaagggacacggtaacggtaggtaaacgggtaaacgaggtcggtaggtctacgacctagttcgtcgttcttacttaaccgtccgttccctaccgtctactacgtattaaccg

SEQ ID NO: 386030 - DNA, 535 bp, Homo sapiens
  misc_feature: GZ8MTXP02IEVIK.52.10.A10.1.454.CMB.2.raw
  modified_base (276)..(276): a, c, t, g, unknown or other
  modified_base (370)..(370): a, c, t, g, unknown or other
  modified_base (428)..(428): a, c, t, g, unknown or other
  modified_base (445)..(445): a, c, t, g, unknown or other
  modified_base (448)..(448): a, c, t, g, unknown or other
  modified_base (525)..(525): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcaggccagtcagaatattactcttacctgcctgtaccaacaaaacctgcccaggctccagctccncatctatgatgcatccaaatcggccacgtggcaactccccgagccctagggttcaagtggacaggtcggggtctggggacagtacttcacttcnccaaccatcaacgccaaacccagaacgcctagaacgtactttgacttagtttattatntcagcagcgtaagtagngcncgttacgaccgagggacagacgtaggaagttaaaacgactgtacggctcgacacactctcgtctcgacttctacccntacctcataa

SEQ ID NO: 386031 - DNA, 499 bp, Homo sapiens
  misc_feature: GZ8MTXP02FEQOD.52.10.A10.1.454.CMB.2.raw
  modified_base (240)..(240): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagaggccaccctctcctgcagggccagtcagaatattacctcttaccnggcctggtaccaacaaaactgcccaggctcccaggctcctcatctatgatgcatccaatcgggcactggcatcccagccaggttcagtggcagtggggtctggggacagacttcactctcaccatcagcaaacctagagcctgaagctttgcagtttatactgtcagcagcgtagtaagtggcgcttcggccaaggggacacgactggagttaaaacgaactgtggctgcaccatctgtcttcatcttccccgcatctg

SEQ ID NO: 386032 - DNA, 581 bp, Homo sapiens
  misc_feature: GZ8MTXP02JQU5V.52.10.A10.1.454.CMB.2.raw
  modified_base (282)..(282): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatatacctcttacctggcctggtaccaacaaaacctgacccaggctcccaggctccncatctatgatgcatccaatccgggccacgtggcactcccagccaggttcaggtggcaggtgggtctggggacaggtacttcactctacaccatcacgcaaacctagacgacctagaacgtctttagacttagtttacttacgtgtccagtacgagtacggtagtaacggtcggacgtacgttccggacgaaggggtacacggtacgtagggaacgttaaaacgacgttggtcggacgtgaccacgtacttccgtagttccttaccgtactttcccgttaccccgccttataccgttaag

SEQ ID NO: 386033 - DNA, 540 bp, Homo sapiens
  misc_feature: GZ8MTXP02JVIBY.52.10.A10.1.454.CMB.2.raw
  modified_base (238)..(238): a, c, t, g, unknown or other
  modified_base (248)..(248): a, c, t, g, unknown or other
  modified_base (253)..(254): a, c, t, g, unknown or other
  modified_base (260)..(260): a, c, t, g, unknown or other
  modified_base (262)..(262): a, c, t, g, unknown or other
  modified_base (265)..(265): a, c, t, g, unknown or other
  modified_base (267)..(269): a, c, t, g, unknown or other
  modified_base (271)..(272): a, c, t, g, unknown or other
  modified_base (274)..(277): a, c, t, g, unknown or other
  modified_base (285)..(285): a, c, t, g, unknown or other
  modified_base (288)..(288): a, c, t, g, unknown or other
  modified_base (290)..(290): a, c, t, g, unknown or other
  modified_base (296)..(296): a, c, t, g, unknown or other
  modified_base (305)..(305): a, c, t, g, unknown or other
  modified_base (311)..(311): a, c, t, g, unknown or other
  modified_base (316)..(316): a, c, t, g, unknown or other
  modified_base (324)..(324): a, c, t, g, unknown or other
  modified_base (475)..(475): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagacgggccaccctctcctgcagggccagtcagatatacctctacngctgaccaanaaacnnccagcncngcncnnnannannnncatcgcangcncnccagcngtcagtgcngtggcnggacngtacttcnctctacacatcacgaccaacgtagcgacctagaacgtctttgacttagtttactactgtcagtacgagtacggttaagtaggtcggccggtacgttaccgggacgaaaggggaccaacgggtacgtaggggaaacgttaaacgacgtaggnggctacgactacctagttccgtgtccttaccgtacttcccgttacccgaccttagttaccgtaag

SEQ ID NO: 386034 - DNA, 670 bp, Homo sapiens
  misc_feature: GZ8MTXP02HJFIS.52.10.A10.1.454.CMB.2.raw
  modified_base (242)..(242): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggccaccctgtctttgtctccaggagagacgggccaccctctcctgcagggccagtcagaatattacctcttacngcctggtaccaacaaaacctcgcccaggctcccaggctcctcatcatgatgcactccaaagtccgggaccacgtcggcctacgtccccgacggtacccgtagggtttaccaggttcgggacgtacgggttccggggtccgtaggggaacctacggtaacttccgtactcccttaccaaacctactaccacgtaccaaacccgttaggaaccgtaccctagtaacggtactttaggtacttaggtttttaactacgttgtacctagcctaggtaccgttaaggtaaggtcggacgtcgttaccggacgaaacggggacaacgggtacgtacggtaaacggggttaaaaccacggttcgggtacgtcgtacgaccaccgtacgtcttaaccgtctttaacacgtttcccttccggactactcgttagaac

SEQ ID NO: 386035 - DNA, 609 bp, Homo sapiens
  misc_feature: GZ8MTXP02FX8IC.52.10.A10.1.454.CMB.2.raw
  modified_base (205)..(205): a, c, t, g, unknown or other
  modified_base (242)..(242): a, c, t, g, unknown or other
  modified_base (292)..(292): a, c, t, g, unknown or other
  modified_base (348)..(348): a, c, t, g, unknown or other
  modified_base (353)..(353): a, c, t, g, unknown or other
  modified_base (359)..(359): a, c, t, g, unknown or other
  modified_base (363)..(363): a, c, t, g, unknown or other
  modified_base (381)..(381): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagaggccaccctntcctgcagggccagtcaagaatacttacctcttaccnggcctggtaaccaaacaaaacctgacccaggctcccagctcctcatctangatgacatccaagtcggaccacgtgccatcccagccgtagtcagtgcaggtggtcnggacngacttnctcncacatcagcaaactgacnctagaatcttgactagttttatacgtgtacagtacaggtacgttaaaggtagtcggtcgtacgttaccgggaccgaaaggggtacctaacgggtacgttaacggggtaaaacggttaaaacccgtaagttcggggttacggaccttaaggggtacccaaccgttactccgttaaccgtttcccgttactccgttaccccggttccccctactagtttaccctaaacgg

SEQ ID NO: 386036 - DNA, 677 bp, Homo sapiens
  misc_feature: GZ8MTXP02H3OHV.52.10.A10.1.454.CMB.2.raw
  modified_base (404)..(404): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctcatgagaggagggccaccctctcctgcagggccagtcaagaatacttacctcttacctggcctaggtaaccaaacaaaacctgacccacggcctccacggtcctcctcatctatgatcgacactaccaacgtccggggaccacgtcggacctacctcccgacgtcccgaggttccgaggtcggacacggggtcggggtcgtaggggacaggtacttccnccttacctaccaccagtacaacgacctaaacctagacgcccgtagaacgtacttgtacttaagtttaacttccgtgttacagtctaggtacgttaaggtaagtcgggtaccgtaccggttcgaacccggtaaaggggtaccaaacgggtaaccggttaagggtaaaacgggtaaaacgtacggttacggtacgggtctacggacctaacgtacttccgttaggttaacctttaccgacttttcccctaccgaccccttaagtttcccgtaaag

SEQ ID NO: 386037 - DNA, 601 bp, Homo sapiens
  misc_feature: GZ8MTXP02GYXKQ.52.10.A10.1.454.CMB.2.raw
  modified_base (569)..(569): a, c, t, g, unknown or other
  modified_base (590)..(590): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctccagatggtaccggagaaagtgtatgacacagtctccaggcaccctgtctttgtctccgaggagagagggcccacctctcctgcagggccagtcagaatattacctcttacctggcctaggtaaccaaacaaaacctgacccaggcctccagctcctcatctatgatgacataccaagtccgggaccaacgtggaccactcccgaagcccgtaaggttcaaggtggactagggtcggggttaccgaggggaacacggtacttaccacttcctacaaccatacacgacaaacctagacgcctaaggaactactttgacttaagtttataacgtgtacagtcgaaggtagtaaagtaagtggccgtacgttcggaacccgaaaggggaccaaggtaacgtaggaaaggttaaaacgatgggtagactcgacaacctatccgttntactaacgacttcccgtaccnctatacgagta

SEQ ID NO: 386038 - DNA, 578 bp, Homo sapiens
  misc_feature: GZ8MTXP02JK9KZ.52.10.A10.1.454.CMB.2.raw
  modified_base (566)..(566): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccacctctcctgcagggccagtcagaatattactcttactgcctggtacaacaaactgccagctccagctctcatctatgatgcatccaagtcgggccacgtcggcactccccagtccaggttcaggtgctaggtcgggtctggggacacggtacttcactcgtccacctatccagaccaaacctagacgcctagtaacgtactttagacgttagtttacttacgtcgtacgagcgtaggacgttaaggtacggttgggacctcggttacgggaccgaagggaccaacggacgtagggaaacggttaaacaacgtggtaggctaggaccaacgtacgttctgttacttaacgactttcccgtaccccnctactctagtac

SEQ ID NO: 386039 - DNA, 682 bp, Homo sapiens
  misc_feature: GZ8MTXP02GPD8A.52.10.A10.1.454.CMB.2.raw
  modified_base (392)..(392): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaaacaaaacctgacccaggctcccaggcctcctcatctatcgatcgcatcccaagtccgggccactcggccaactccccgaagccgtaaggtttccaggtcggcgtaggtcggggtcctaggggaccaggtaccttaccncgttcctaccaaccatccacgacctaaaccctagacgtaccttaggaaagtaccgtttggacccttaagttttactttacgtacgttacgaaggtcctaaggtacggttaaagttaacgggttcggggcccgttaccgggtttaaccgggaccccgtaaagggggtaacccaacggttaaccggtaagggtaacgggttaaaaccgtaacggttgggtacggtacgtacggacctaacctacgttcccgtagttccttaacgtctcccgttaccgcttactcctagtaac

SEQ ID NO: 386040 - DNA, 503 bp, Homo sapiens
  misc_feature: GZ8MTXP02I1YUN.52.10.A10.1.454.CMB.2.raw
  modified_base (399)..(399): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttactgcctggtacaacaaacctgcccaggctccagctcctcatctatgatgcatccatcggcactgcatccagccaggttcagtgcagtggtctgggacagacttcactctcaccatcagcaaacctagacgcctagaagtactttgctagtttattactgtnagcagtcgtagtagtgcgtgtccggacgaaggcacgacgtggtaagtaaacgagtgtgctcgacacagtctgtctcgtacttcctaccgctactcgtacgtaac

SEQ ID NO: 386041 - DNA, 741 bp, Homo sapiens
  misc_feature: GZ8MTXP02IPZUE.52.10.A10.1.454.CMB.2.raw
  modified_base (286)..(286): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagagggccaccctctcctgcagggccagtcagaatattacctcttactggcctggaacccaaacaaaaccctgcccaggcctcccaggcctccncatctatgatgacatccaagtccgggacccacgtcggcactccccagcctaggttcaggtggcctagggtcggggtctaggggacctaggtaccctttcaccttctacccaacctacgtccaacgaccctaaacccgtaacggacgtaccccgtaaggaaacgttacctttttacggacctttaacggttttttaaactttaaccgttgggttaccaacggtaccgtaaggtaccggtttaaaggggtttaaggtccggggtacccgggtacccggtttacggggaccccggtaaaggggggtaacccaccggggttaacgttaagggggtaaacggggttaaaaccgtaaacgtggggttacggacgttaaccggacctaacccgttacgttccgtttacgttcccgttaccgttaccgtttccccgttacccgtaccttacgttacgttaacg

SEQ ID NO: 386042 - DNA, 603 bp, Homo sapiens
  misc_feature: GZ8MTXP02I41UO.52.10.A10.1.454.CMB.2.raw
  modified_base (286)..(286): a, c, t, g, unknown or other
  modified_base (358)..(358): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagaggccaccctctcctgcagggccagtcagaatattacctcttacctggccttggtaaccaaacaaaaacctgacccaggctcccaggctccncatctatgatgcactccaagtcggccacgtggcactccccagccaggttcagtggcaggtgggtctgggacncgacttcactcctcaccatcacgacaaaccctagacgtccttaaggaacgttacctttagacctaggttttaacttaacgtgtaccaagcgtacgtaggtaacgtaaggtcggccgtacgttcggacccgaaaggggaccaacggtacgttacggggtaaaacgttaaaaccgacgttaggtcgggactaggccctaacctatccgttacgttcctactacttcccttacccgactactacgtag

SEQ ID NO: 386043 - DNA, 607 bp, Homo sapiens
  misc_feature: GZ8MTXP02JKEHB.52.10.A10.1.454.CMB.2.raw
  modified_base (283)..(283): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccaggcctccncatctatgatgcatccaagtccgggccagtcggcactcccagccaggttcaggtggcaggtcgggtctggggacagtcttcactctccactatcacactaaacctagacgccctaaggaacgtactttgacttaagtttactacgtgtacagcaggtacgttaggtagtggcgtcgttaccggacgtaagggaccaacggtacgtagggtaacgggttaaaacgaaccgttggtacggcttacggacctaccgtacttccgtgttacccttaacgtacctttccccgttacccccggacttaaccgtttcgtacgtttaaaccg

SEQ ID NO: 386044 - DNA, 673 bp, Homo sapiens
  misc_feature: GZ8MTXP02F944J.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttactgcctggtaccaacaaaacctgcccaggctcccaggctcctcatctatgatgcatccaatcgggccactggcatcccagcccaggttccagtggcaggtcgggtctggggacagacttcactctcacatccagacaaaccgtagacgccctagaacgtacgtttgaccttaagttttactttaacttcgttaccaagtcctaagggtaccggttaaggttaaacggttcggggaccggttacccgtttaccggggaacccggaaaacggggtacccgtaaccggggtaaaccgttaggggaaaacggggtttaaaaccgtaaaaccggttggggtaaccgggtcgttaacggtaccgtaacctaacgtttcccgttaggttaccctttcgtaaccgttccgtttaccccccgactaccttaccgtagttaaacg

SEQ ID NO: 386045 - DNA, 643 bp, Homo sapiens
  misc_feature: GZ8MTXP02HX3MP.52.10.A10.1.454.CMB.2.raw
  modified_base (233)..(233): a, c, t, g, unknown or other
  modified_base (292)..(292): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagaggccacctctcctgcagggccagtcagaatattacctnttacctggcctggtaaccaacaaaacctgcccaggctccaggctcctcatctatgatcncactacacgtcggccacgtcgacactccacgcgtacgttacgagtggcgtaggtcggtcgtacggacgtacgtactacctactctacactactacacgacaactacgacgtacgtacgtaacgtacgttacgtacgttagtttaacgttacgttacgtacgtacgtacgtacgtacgtaaggttaaggtacggtacggtacggtaccggtaccgaacggaacggtaacggaacggtaacgggtaaacggtaaaacgtaaacggtacggtacggtacgtacgtaccgtacgtacgtacgtacgttacttaaccgtacgttaccttacccgtacctacttacgttacgtaacg

SEQ ID NO: 386046 - DNA, 648 bp, Homo sapiens
  misc_feature: GZ8MTXP02G0VKR.52.10.A10.1.454.CMB.2.raw
  modified_base (272)..(273): a, c, t, g, unknown or other
  modified_base (278)..(279): a, c, t, g, unknown or other
  modified_base (282)..(282): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattactcttactgcctgtaccaacaaactgccagctccagctccnntctannatncataccagtcggccacgtgacactccacgccgtaggttcaaggtcggacgtaggtccgggtcgtagggactaggaccttcgaccttctccaacctataccacgaaccaaacctagaccgcgtacggaaagtaccgtttgacgtttaaacgttttattacgtacgttacgaacgtaccgtaaggttaaccggttaaaggttaaacgggtcgggaccgttccggttaaccgggacccggaaaggtaccgaacgtaccggtaagggtaaacggttaaaacgaacgttggttacggactcgtaacggaccttacgtccttaccgtcgttaacgtacccttaccccgtactactacgtactaagttaaccg

SEQ ID NO: 386047 - DNA, 563 bp, Homo sapiens
  misc_feature: GZ8MTXP02G5GU6.52.10.A10.1.454.CMB.2.raw
  modified_base (412)..(412): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaaacaaaacctgcccaggctccagctctcatctatgatgcatccaagtcggaccacgtggcactcccagcctaggttcaggtggctaggtcgggtcgtgggacaggtaccttcactctacacctatcacgacaaaccgtagacgcctagaagtacgtttnacttagtttactactgtacagctaggtcgttaaggtagtcggcgtcgttacggaccgaaggacacgtagtagggaagttaaacgacgttaggtcgactcgaccaccgtatcgtcgttctaacgtacttccttccgactacgttctagtaac

SEQ ID NO: 386048 - DNA, 735 bp, Homo sapiens
  misc_feature: GZ8MTXP02HT4EF.52.10.A10.1.454.CMB.2.raw
  modified_base (281)..(281): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggcccaccctctcctgcagggccagtcagaatattacctcttacctggcctggtaccaaacaaaacctcgccagctccagctccncatctatgatgctatccaagtccggaccactggcactccccgagccgtagttcaggtcggcgtaggttcggggtaccgtacggggactaacggtacctttaccgaacttccctaccgtaaccctaacttacccgaacgtacccgaaaaccgttaggaaccgtaccctaaaggtaacgttacgtttacggtaacgtttaagttttacttacgttagttaccaacgaccgtaaaggtccggtttaaaggttaaacgggttcggtaccggttaccggttaccccgggaaccggaaacggggtaacccgaacgggtaacggttaacggggaaaacgggtttaaaaccggaaccgttagggttacggtaccgttacggaaccgtaacctaacgttccgttacgttacctttaaccgtacttaacccgttcccccgacttaaccgttccttaaggtaacg

SEQ ID NO: 386049 - DNA, 628 bp, Homo sapiens
  misc_feature: GZ8MTXP02GE62I.52.10.A10.1.454.CMB.2.raw
  modified_base (259)..(259): a, c, t, g, unknown or other
  modified_base (273)..(273): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggcccaccctctcctgcgagggccagtcagaatattacctctactgcctgtaccaacaaactnccagctccagctcnatctatgatgcatccaagtccgggaccacgtggcactcccgagccgtaggttcaggtggcgtaggtcgggtcgtagggacagtacctcactctcactatccacgacaacctagacgcctaggaactacgttgacgttagtttaacttacgtagtcaacgtcgtaaggtacgtaaaggttaacggtcggaccgttaccggttaccgggaaccgaaaggggacccgtaacggtaacggtagggtaaacgggttaaaacggtacgttaggttacgggtacgaccgtactaacgtcgttacgttcgtttacctaacgttcccttacccggtacctacctacgttacgtacgtttaaacg

SEQ ID NO: 386050 - DNA, 554 bp, Homo sapiens
  misc_feature: GZ8MTXP02IVDZS.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccaggctcctcatctatgatgcatccaatcgggccactggcatcccagccaggttcagtggcaggtcgggtctgggacagtacttcactctccaccagtcagcaaaccgtagacgcctagaagtactttgacttagtttacttaactgttcagcagtacgtaagtaggtgccgtcgttacggaccgaagggctacggaacgtgggaaacggttaaaacgacgtggtcggctcggacacctactccgtagttccttcacttccgttcccgctactctagtaac

SEQ ID NO: 386051 - DNA, 667 bp, Homo sapiens
  misc_feature: GZ8MTXP02FO004.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtatattgacacagtctccaggcaccctgtctttgtctccaggagagagggcccacctctcctgcagggccagtcagaatattacctcttacctggcctggtaccaaacaaaacctgacccaggcctcccaggcctctcatctatgatgacataccaagtccgggaccaacgtcggacctactccccaagccctagggttcagtggactaggtcgggtctaggggactagtacttcactcctacactatcagacaaacctagacgcctaagtaaagtctttaggacttaagtttacttactagtcaagcgtaagtcgtaaaggtaacggtcgggacgtacggttaccggaacccgtaaaggggacctaacggaacggttacggggtaaaaggtttaaaacggaccggttacggttagggtacctaggacccgtaaacgtaacgttcccttaagggtttaaccttccgtaaccgtttacccgtttacccccgtacgttaaccgttaccgttaacgtaaacg

SEQ ID NO: 386052 - DNA, 583 bp, Homo sapiens
  misc_feature: GZ8MTXP02GZNYG.52.10.A10.1.454.CMB.2.raw
  modified_base (275)..(275): a, c, t, g, unknown or other
  modified_base (505)..(505): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccacctctcctgcagggccagtcagaatacttacctcttacctgcctggtaaccaacaaactgccagctccagctcncactcatgatgcatccagtcggccacgtgcactcccacgcctaggttccaagtggcgaggtcggggtctggggacaggacttcgaactcgtacacacgtcacgacaactagacgcctagagtacttgactagtttactacgtgtcagtcagtacgtagtaacgtggacgtccgttacgaccgtagggacgtacgacgtacgggaaacggttaacgaacgttaggcggacncgtaacgaccctagttcccgttaggttccttaacgtactttaccccggttaccccgtaccgtacttacgtacgtaacg

SEQ ID NO: 386053 - DNA, 582 bp, Homo sapiens
  misc_feature: GZ8MTXP02J0NFR.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagacgggccaccctctcctgcagggccagtcagaatattacctcttacctggcctggtaacccaaacaaaaccctgccccaggcctcccaggcctcctcatcatgatgcatccaagtcggccactggcactcccagccgaggttcagtggctaggtcggtcgtgggactagtaccttacactctacaccatccagacaaacctagacgtcctagaacgtatttacgatagtttactattgccagtcagtcgtaaggtagtcgcgtcgttccggactaacgggacacggacgtaggggtaaacgttaaacgaacgttggacggtctacggaccaccgtatccgtccgtttactccgtaacttccccttcccgacctacttactcgtaaacg

SEQ ID NO: 386054 - DNA, 705 bp, Homo sapiens
  misc_feature: GZ8MTXP02II0JV.52.10.A10.1.454.CMB.2.raw
  modified_base (278)..(278): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccatgagagacgggccaccctctcctgcagggccagtcagaatattacctctactgcctgtaccaacaaacctgcccaggctcccagctcctnatctatgatgcatcgaatcggccacgtggcactccccagccctaggtcagtcggcgacggtgggtacgtaggggactaggtaccttcgacttcctaccaccgtattccaacggtacccaaaacccgttaggaacgtccccgttaggtaaacgttacctttttacggaccgttaagttttaaacgtttaccgttaacgttaccgacgtaacgtaacggtacggtttaaacggttaaacgggtcgggtacccgggtcccgtttaccggggaacccggtaaagggggtaccgaaccggtaacggtaacgggggtaaaacgttaaaaccggtaaacggttcggtacggtaccgttacggaacctaaccgttaacgttcctttacggttaaccttcgtaccttcccgttacccggtcctaagttcccttaag

SEQ ID NO: 386055 - DNA, 623 bp, Homo sapiens
  misc_feature: GZ8MTXP02JOUEY.52.10.A10.1.454.CMB.2.raw
  modified_base (260)..(260): a, c, t, g, unknown or other
  modified_base (276)..(276): a, c, t, g, unknown or other
  modified_base (282)..(283): a, c, t, g, unknown or other
  modified_base (588)..(588): a, c, t, g, unknown or other
  modified_base (598)..(598): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcgagggccagtcagaatattacctcttacctgcctgtaccaacaaactnccagctcccagctccnatcatnntgcatccaagtccggcacgtgcactcccagcaggttcagtgcgaggtccgggtctaggggacagtacctcgacttccgacctacataccacacctaaaccgtagacgtaccctaggaacgtacgtttacggctttaaagtttacttacttaggtacagtaccgtaggtaaccggttaggttaaacgggttcggggacccttcgggttaacccgggaaaccggaaacgggtacctaacgggtaacggtaacgggggttaaacggttaaaaacgacgtttcggtaacggcttaccggactacgtacncgttctactnacttccctacgactcttccgatacg

SEQ ID NO: 386056 - DNA, 740 bp, Homo sapiens
  misc_feature: GZ8MTXP02GW799.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggcccaccctctcctgcagggccagtcagaatacttacctcttacctggcctaggtaaccaaacaaaacctcgacccaggcctcccgagcctcctcactctatagatcgactactccaacgtccgggacctacgtcggactacctcccgacgccgtaaggttccaaggtcggcgtagggtccggggttcgtacgggaccgaaggttacctttaccgacctccgtaccacctaacgtaccgtaacgacccgtaaaccgtaggaaacccgtccgttaacggaaacgttacgttttacgacgtttaaaggtttttactacgtttacgacgtaacgtccgtaaaggttaccggttaaggttaacggggtcgggtacccgttacgggttaccggaaaccccgggaagggtaccctaaccgggacgggttaacgggtaaaacgggttaaacgtaaacggttgtacggtacgttacggaccgtaaccttacgttaccgtcgttacttaactacctttacccgtacccgtactacggttaccttagtaaccg

SEQ ID NO: 386057 - DNA, 587 bp, Homo sapiens
  misc_feature: GZ8MTXP02FLOIT.52.10.A10.1.454.CMB.2.raw
  modified_base (157)..(157): a, c, t, g, unknown or other
  modified_base (550)..(550): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctccagatggtaccggagaaagtgtattgacncagtctccaggcacctgtctttgtctcatgagagacggccacctctcctgcagggccagtcaagaatacttacctcttacctggcctaggtaaccaaacaaaacctcgacccaggcctcccaggctcctcatctatgatgacatccaagtcggcacgtgcactcccagcctaggttcaggtggctagggtggtctaggggacagtcttacgctctcaaccgactcaacgaccaaacctaggacctaccgtagtaacgtaccgtttgactagttttaacttacgtgtacaggtaccagtaggttaaggtaacgtcggacgtaccgtcgggaaccgaagggtacacggacgtaggggtaaaagtaaacgagtgggagtctacgacctaactcgtnttacgtcctactacttcccgttccactagttcctaag

SEQ ID NO: 386058 - DNA, 616 bp, Homo sapiens
  misc_feature: GZ8MTXP02JTBT8.52.10.A10.1.454.CMB.2.raw
  modified_base (578)..(578): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtcttgtctccaggagagagggccaccctctcctgcagggccagtcagaatacttacctcttacctgcctgtaaccaaacaaaacctcgacccaggcctcccaggctcctcaatctaatcgatgacatccaaagtccgggacctacgtggaccacgtaccccagcccgtaggttcaagttggacgtaggtcggggtccgtaggggaactagacttcactcctacaactatcaagccaaaccgtagacgtacccgttagaaaacgttctttgacttagttttaactacgtgtaccaggactacggcggttaaagtaggtcggccgtcgttaccgggaccgaaaggggacaaaccgggtataacgggggaagtttaaaacgacgtttcggaggtcacgacctaancttactgtaccttgactccgttccgctatcgtagtaac

SEQ ID NO: 386059 - DNA, 564 bp, Homo sapiens
  misc_feature: GZ8MTXP02FGLMZ.52.10.A10.1.454.CMB.2.raw
  modified_base (350)..(350): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccaggctcctcatctatgatcgcatacaatcgggccactggcatccccagccaggttcagtgcagtgggtctgggganagtacttcaactctcaccatcagcaaacctagacgcctagaaagtactttgcttacgtttattaactgtcagtcagtacgtagtaagtggccgtgttacgggcccaaaggggaccaacggactgggaaacggtttaaaacgaacgtgtacgggactacggacaactactcgtcgtctttaacgacttccgttaccccgcctaattccagttaac

SEQ ID NO: 386060 - DNA, 622 bp, Homo sapiens
  misc_feature: GZ8MTXP02I7681.52.10.A10.1.454.CMB.2.raw
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggcccacctctcctgcagggccagtcagaatattacctcttactgcctgtacaacaaactgcccagctccagctcctcatctatgatgcatccaagtcggccacgtggcactccccagtcccgtaggttccaggtcggccgtaggtcgggtacgtgggaacacgtacttaccactctaccaccatccaacgtaccaaccgtagacgtccctagaaacgtacctttaggaccttaagtttacttacgtcgttacacgctaggtaccggttagttaacggtcggtaccgtcggttaccggaccgtaacgggaccacggtaacgtagggtaaacgtaaacgtacgttaggtcgtacgtcggacctaaaccgtctccgttgttaccctaacgtaccttcccgtacccggccttaagtcccgtagttaacg

SEQ ID NO: 386061 - DNA, 586 bp, Homo sapiens
  misc_feature: GZ8MTXP02IC88V.52.10.A10.1.454.CMB.2.raw
  modified_base (237)..(237): a, c, t, g, unknown or other
  modified_base (269)..(269): a, c, t, g, unknown or other
  modified_base (276)..(276): a, c, t, g, unknown or other
  modified_base (280)..(280): a, c, t, g, unknown or other
  modified_base (286)..(287): a, c, t, g, unknown or other
  modified_base (289)..(291): a, c, t, g, unknown or other
  modified_base (298)..(298): a, c, t, g, unknown or other
  modified_base (305)..(305): a, c, t, g, unknown or other
  modified_base (312)..(312): a, c, t, g, unknown or other
  modified_base (314)..(314): a, c, t, g, unknown or other
  modified_base (323)..(323): a, c, t, g, unknown or other
  modified_base (325)..(325): a, c, t, g, unknown or other
  modified_base (327)..(327): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcacccttgtcttttgtctcgaggagagagggccacctctcctgcgagggccagtcagaatattacctntactgcctggtacaacaaaactgacccagtcnccagccncctnatctannannnatacacncgcacgngcacacncncgagtgagngngngtcggtgtagcgactctcactctacacacacacacacacgacactagagtattacgtacttagtttaattactatacagacgtagtaggtaaggtaggtaggtacgtacggtacggtaaccggaaacggaacgaacggtaacggtaaggtaaacggttaaaacgtaaacgtacggtacggtacgtacgtaaccgtacctactacgttacttacgttaacgttaccgttacccgtacccgtacctacttacgtacgtacg

SEQ ID NO: 386062 - DNA, 603 bp, Homo sapiens
  misc_feature: GZ8MTXP02GXICK.52.10.A10.1.454.CMB.2.raw
  modified_base (192)..(192): a, c, t, g, unknown or other
  modified_base (370)..(370): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccagganagaggccacctctcctgcagggccagtcagaatacttacctcttacctggcctaggtaaccaaacgtaaaacctcgccctaacggctcccaggcctcctcactctatgatgcataccaatccgggacctatcggccatccccagcctaaggttcagtcgcgtagtcgggtctgggacngtacttcactccgtacactactaccgactcaaacccgtgacgacccgtaagacgttacttaggacctttaggtttaacttcggtacttgaaccgtgtaacgtacgtaaggtacggtcggtacgtacgtaccggacgaggaccgaggtacgtaagggtaacgtaaacacgtggtcgtacgtacgctacgtactacgttctacttcctacgttcctaccgtactactacgtacta

SEQ ID NO: 386063 - DNA, 646 bp, Homo sapiens
  misc_feature: GZ8MTXP02HG6PI.52.10.A10.1.454.CMB.2.raw
  modified_base (202)..(202): a, c, t, g, unknown or other
  modified_base (223)..(223): a, c, t, g, unknown or other
  modified_base (227)..(227): a, c, t, g, unknown or other
  modified_base (237)..(237): a, c, t, g, unknown or other
  modified_base (257)..(257): a, c, t, g, unknown or other
  modified_base (261)..(262): a, c, t, g, unknown or other
  modified_base (269)..(269): a, c, t, g, unknown or other
  modified_base (272)..(272): a, c, t, g, unknown or other
  modified_base (326)..(326): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctccagatggtacggagaaagtgtattgacacagtctccaggcacctgtctttgctcatgagagaggccacctctcngcaggcagtcagaatatactntacngctgaacaanaaaactgccaggctcacgcnctcnnctatganganactactaacgtacggaccgacgacgacgactaccacgacgtagtacgtagtcgngtacggtggtacgtacggacgacgtacttactactactacacactacacgtaacaaaccgtaacgtacgtaccgtacgtaacgtacgttacgttacgttaacgtttaacgttaacgttacgttacgtacgtacgtaagtaaggttaacggttaaggtacgggtacggtacgttaccgggtaaccggaaacgggtaacgtaacggtaacggtaacgggtaaaacggttaaaacggtaaacggtacggtacggtacgtacgtacgtacgtacgtacgttacgttaacgttactacgtaccgtacccgtacctactacgtacg

SEQ ID NO: 386064 - DNA, 698 bp, Homo sapiens
  misc_feature: GZ8MTXP02I4ZZE.52.10.A10.1.454.CMB.2.raw
  modified_base (285)..(285): a, c, t, g, unknown or other
  modified_base (291)..(291): a, c, t, g, unknown or other
  modified_base (399)..(399): a, c, t, g, unknown or other
  modified_base (641)..(641): a, c, t, g, unknown or other
tcagcgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggcccaccctctcctgcagggccagtcagaatattacctctactggcctggtaaccaaacaaacctgacccaggcctcccgagcctccnatctangaatgcactccaacgtccgggaccacgtcggacacgtccccagtccgtagtttcgaaggttggacgtacggtcggggttacgtacggggacaacggttactttacccncgttacccttacaacccttagacccgaccgaaccgtaaaacccgttagggaaccgtaccgttaaacggtaaaccggttacgttttacgaccgtttaaagttttacccgttaagtcggttacacgggtatacgggtacgtaacgttaaggggtcgaccgttaccggtacggtaacccgaaaggggtactacccgggtaggtaaggttaacggtaaaacgtcgtacggtacgcgttacgaaccncttacgtacttcgtactaacgtcccttacgtcccccgaatcgttaccgtattaaacg

SEQ ID NO: 386065 - DNA, 583 bp, Homo sapiens
  misc_feature: GZ8MTXP01DCTS9.39.21.B10.1.454.CMB.2.raw
  modified_base (263)..(266): a, c, t, g, unknown or other
  modified_base (268)..(269): a, c, t, g, unknown or other
  modified_base (279)..(279): a, c, t, g, unknown or other
  modified_base (282)..(282): a, c, t, g, unknown or other
  modified_base (293)..(293): a, c, t, g, unknown or other
  modified_base (296)..(296): a, c, t, g, unknown or other
  modified_base (308)..(308): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagcgtgcgttttctagtggctattttaaaaggtgtcagtgtgaggtgcagctgttggagtctgggggaggcttggtacagccgggggggtcctgagactctcctgtgcagctctggatcacttcagcannnncnngcgcggcgcngcncgaggaggagnggngtggtcgtcgtntagtagtaggtagtgtgtactactaacaactacgacacgacctcgtcggacggcgtctcaccactctacacgacgactactacaagacgactactactatatctagactaaataacggaacgaacgtacgtacgacgtcgaccggacggacgaccgtaccgtacttaagttagttaagtagttacggtaaaggttagggtagggggtaggggttcggggttcggttacgttcgttcggttcggtttcggtacgttacggtcgggcgggtaacggg

SEQ ID NO: 386066 - DNA, 777 bp, Homo sapiens
  misc_feature: GZ8MTXP01CVH4S.39.21.B10.1.454.CMB.2.raw
  modified_base (268)..(268): a, c, t, g, unknown or other
  modified_base (277)..(277): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagcgtgtcgttttctaggtggctattttaaaaggtgtccagtgtgaggtgcagctgttggagtcgtgggggaggcttggtacgaggccgggggggtccctgagactctcctgtgcagcctctggattcaccttnagcagctancgccagtcgaccgtcgggtcccgccgaggccgtaccggaagggggaacggacgtggggaggttcgggtcttcggttacgttagttagggtaggtaaggttggttcgtactttaaacgtaaaccaaaacgtcgacctacggtcccgttaccgggtaaggggaaaccgggtcccgtccttacccaccctacttcccgtaccgaagtaacgttaaccttaacgttaacccgaaaaggcgtaccgtaaccttaccgttacgttaacgttacgttacgtaacgtaaaacgtaacggtaaacgtaacgtaccgtacggtacggtaccggacccggaaccggaaccggaacccggtacccgttaacgttaacgttaagttaaggttacggttaacggtaaacggttaggggttagggggtaggggttacgggggttcggttaccggttccggttcgggttcgggtttacggttacggttaccgggtaacggggttccgggtaacggg

SEQ ID NO: 386067 - DNA, 719 bp, Homo sapiens
  misc_feature: GZ8MTXP01ARDJH.39.21.B10.1.454.CMB.2.raw
  modified_base (269)..(269): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagcgtggtcgttttctaggtggctaattttaaaaggtgtccagtgtgaggtgcagctgttggagtcgtgggggagcttggtacgagggccggggggtccctgagactctcctgtgcagcctctggattcaccttnagcagctatgccagtcgaccgtgggtcccgcgaggcctccgaggggaaggactgggagtggtctcgtctaagtttggtggaagttgggtagctttaactaacaaaactcgcacgtccctcccggtgaaacggggccctcttaccacctactctacccgagacgtactacttacccaaaggtacacctaacttccgtacgttaagttccgttaacgtaacgtaaacgtaacggtaaacgtaacgtaccgtacggtacggtacggaccggaaccggaaccgtaacccgtacccgttaacgttaacgtttaagttaacggttacggttaacgggtaaacgggttagggggtacgggggtacgggggttacgggggttaccggttaccggttccggttcgggttcggtttacggttaccggttaccgggtaaccggggttaaccgggtaacggg

SEQ ID NO: 386068 - DNA, 649 bp, Homo sapiens
  misc_feature: GZ8MTXP01AG642.39.21.B10.1.454.CMB.2.raw
  modified_base (257)..(257): a, c, t, g, unknown or other
  modified_base (280)..(280): a, c, t, g, unknown or other
  modified_base (299)..(299): a, c, t, g, unknown or other
  modified_base (339)..(339): a, c, t, g, unknown or other
  modified_base (414)..(414): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagcgtggtcgttttctaggtggctaattttaaaaggtgtccagtgtgaggtgcagctggttggagtcgtgggggagcttggtacgagggccggggggtccctgagactctcctgtgcagcctntggattccaccttcagcagctancgccatcgacctgggcccnccgaggctccggaggggacggacgtggagtgggtctcgtntagttaggaggtaagtggtgtacttacaaccaactacgcacgtcccgtcggtggacgggccctcttaccaacctntcctaccgaggactaacctactaccgaagacgacctacttctagtactctagaactaaagtacgggaacacgtccgtaggaacggtccgccggaagacctacccggtaccttaagttatttagtgtacggttaaggtaaagttggggggttagggggaggttcgggggttaccttcggttcccggtgggttccggttttaggacccgtttaggggtcggggaacccgtaaggggg

SEQ ID NO: 386069 - DNA, 594 bp, Homo sapiens
  misc_feature: GZ8MTXP01DR24H.39.21.B10.1.454.CMB.2.raw
  modified_base (141)..(141): a, c, t, g, unknown or other
  modified_base (165)..(165): a, c, t, g, unknown or other
  modified_base (194)..(194): a, c, t, g, unknown or other
  modified_base (248)..(248): a, c, t, g, unknown or other
  modified_base (256)..(258): a, c, t, g, unknown or other
  modified_base (260)..(261): a, c, t, g, unknown or other
  modified_base (263)..(264): a, c, t, g, unknown or other
  modified_base (268)..(268): a, c, t, g, unknown or other
  modified_base (273)..(273): a, c, t, g, unknown or other
  modified_base (276)..(276): a, c, t, g, unknown or other
  modified_base (287)..(287): a, c, t, g, unknown or other
  modified_base (289)..(289): a, c, t, g, unknown or other
  modified_base (301)..(301): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagcgtgngtttctagtggctatttaaaaggngtccagtgtgaggtgcagctgttggagtntggggagcttggtacagccggggggtcctgagactctcctgtgcagctctgatnacttcagnnntnncnngcgngcgcngcncgaggaggagngngtggtcgtcgtntagtagtaggtagtggtgtcttactactaactacgacacgaccgtccgtcggacggccgtctcacactactacagacgtactactacaagacgactactactagtatctacgtacaaataacggaacgacgaccgtacggacggtacgaccggacggaaccgtaccggtaccgtacttaacgttagttaagtacgttacggtaaaggttagggtagggggtaggggttacggggttcggttacgtcggtcggttcggtttacggtacgttacggtcggggttcgggtaacggg

SEQ ID NO: 386070 - DNA, 598 bp, Homo sapiens
  misc_feature: GZ8MTXP01AF0UC.39.21.B10.1.454.CMB.2.raw
  modified_base (300)..(300): a, c, t, g, unknown or other
  modified_base (371)..(371): a, c, t, g, unknown or other
  modified_base (402)..(402): a, c, t, g, unknown or other
  modified_base (474)..(474): a, c, t, g, unknown or other
  modified_base (498)..(498): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgttggagtcgtgggggaggcttgggtacgagggccgggggggtccctggagactctcctgtgcagcctctggattcaccttcagcagctatcgccatcgacctgggtcccnccgaggctaccggaggggaacggactgggagtggggtctcggtcttagttaggtggaagtggtgtcttaanacaaactcgcagccctcggtgaacgggcccncttccgacctatcctaccagacgaactacttaccaaagacgactactctagtatctagacaaatcggaaacncgcctggagtcgaccggaggaccnccggtccctaattattgttgacgaggtaaagttggggtaggggggtagttcgggggcttacgtccgtggttcgtttggacgttcgtgggttccgaagggg

SEQ ID NO: 386071 - DNA, 593 bp, Homo sapiens
  misc_feature: GZ8MTXP01B9CCF.39.21.B10.1.454.CMB.2.raw
  modified_base (188)..(188): a, c, t, g, unknown or other
  modified_base (270)..(270): a, c, t, g, unknown or other
  modified_base (272)..(273): a, c, t, g, unknown or other
  modified_base (275)..(275): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagcgtgtcgttttctaggtggctaattttaaaaggtgtcagtgtgaggtgcagntgttggagtgtgggggaggcgttggtacgagggccggggggtcctgacgctctcctgtgcagctctgtatcacttcagcagntnncntcgcgtcggtccgcgcgcgacggagggaggagtggtggtggtcgtcgtacgtagttaggtaggtagtggtagtacttaacctaactaactacgacgacgtaccgtccggtcggacggaccgtcctactacctactctacacgactactactacaacgacactactctatatctactaactaagacgaactacgtacgtacgacgtacgacgacgacgacgtactattattagttgtagttaggtaggttagggtaggggtgggttcgggttcgttacgtcgttcggttcgttcgtacgttacggtcgggttcggtcgg

SEQ ID NO: 386072 - DNA, 580 bp, Homo sapiens
  misc_feature: GZ8MTXP01D5ZJL.39.21.B10.1.454.CMB.2.raw
  modified_base (254)..(254): a, c, t, g, unknown or other
  modified_base (276)..(276): a, c, t, g, unknown or other
  modified_base (351)..(351): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttgggtacgagggccggggggtccctgagactctcctgtgcagcctntggattcaccttcagcagctangccatcgaccgtcgggtccgccgacggcgtccgaggggacggacgtggagtggtcgtcgtcgtattagtggagtntgggggggcttactacaaactacgcacgcctccgtggacgggccgtcgtccaccactctcagagactacttacaagagacactctgtatctgacaatacgaacgacgcacgagtcgcgagaccgacggtacctactattattgtagttcgaagttgggtagggggtagggttacggggttcgttacgttcgtaggtcgtttgtacgttacggtcgggttcgaaccgggg

SEQ ID NO: 386073 - DNA, 645 bp, Homo sapiens
  misc_feature: GZ8MTXP01CM81G.39.21.B10.1.454.CMB.2.raw
  modified_base (291)..(291): a, c, t, g, unknown or other
  modified_base (299)..(299): a, c, t, g, unknown or other
  modified_base (358)..(358): a, c, t, g, unknown or other
  modified_base (401)..(401): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagcgtggtcttttctgtggctatttaaaggtgtccagtgtgagtgcagctgttggagtcgtgggggagcttggtacaggccgggggggtccctgagactctcctgtgcagcctctggattcaccttcagcagctatgccatgaccctggggtccccncgacggcncggaaggggaggacgtgggtaggtcgggtcctcgtacttaagttaggtaggtagtggtntacttaactaacaaactcgacacgtccctacggtggacggccnctcacatcacagacactactacaagacactactctagtactctagaactaaagtacggaaacgtacgtccgtaggacgtaccggaccgaacggacccgtaccgtacccttaagttacttagttaacggtaggttaggtaaagggttagggggtcggggggtaggttcgggggttaccttaccgggttcgttacgggtttcggtttcggtaccggttaccggggtccggggaacccggtaacggg

SEQ ID NO: 386074 - DNA, 584 bp, Homo sapiens
  misc_feature: GZ8MTXP01AZ600.39.21.B10.1.454.CMB.2.raw
  modified_base (276)..(276): a, c, t, g, unknown or other
  modified_base (294)..(294): a, c, t, g, unknown or other
  modified_base (391)..(391): a, c, t, g, unknown or other
  modified_base (408)..(408): a, c, t, g, unknown or other
  modified_base (421)..(421): a, c, t, g, unknown or other
  modified_base (434)..(434): a, c, t, g, unknown or other
  modified_base (450)..(450): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagcgtggtcttttctgtggctattttaaaggtgtccagtgtgaggtgcagctgttggagtcgtggggggaggcttgggtacgaggccgggggggtccctgagactctcctgtgcagcctctggattcaccttcagcagctangccatgaccgtgggcccnccgaggcctccgaaggggaggcgtgggagtgggtctcggtctagttaggtggaagtggtgcttaacacaaacgtcgcagccctccgtgaacgggccncttcactatctccaganactataccaaganctatctagtactnacgactaagaggaacncgacgtaggacgtcgaccggacggaccgaccgtaccttaattattagttgtagaggtaaggttggggtagggggtcggttcggggttcttacgtcgttggttcgtttggacgttacgggtcgggttcggaacgg

SEQ ID NO: 386075 - DNA, 862 bp, Homo sapiens
  misc_feature: GZ8MTXP01EUUUB.39.21.B10.1.454.CMB.2.raw
  modified_base (255)..(255): a, c, t, g, unknown or other
  modified_base (268)..(268): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgttggagtcgtgggggagtcttggtacgagggcccggggggtcctgagactctcctgtgcagcctntggattcaccttnagcagctatcgccatcgaccgtgggtcccgccgaggcctaccggaagggggtaacgggacgttggggacggttcgggggtccttacggttaccgtttaagtttagggtaggggtaaagtttgggggttacgtaccgtttaaactaaaccgtaaaaaccgttacggacctaaccggtcccccgttaccgggttaacgggaaaccgggggtccccgtacccttttacccgaaccccgttataccccgttaccccgaaggtaaccgtaaaccttaacgttacccaaaacggtacgtaccctaaccgtttccttaggttaacttccgtaacgtaacctaaaagttacgggggaaactacgggtacccttagggaacggttaccggacccgggaaacggaaacccggtaccccgggtacccctttaaatttaaccgttttaacggttggttaacgggttaacggtaaaagggtttcggggggtagggggggggtaacggttcgggggggttaaccctttaccggttcccggggttgggtttcccggtttttaacgggaccggtttacccgggtcggggggttaacccggtaacgggggg

SEQ ID NO: 386076 - DNA, 602 bp, Homo sapiens
  misc_feature: GZ8MTXP01BHALU.39.21.B10.1.454.CMB.2.raw
  modified_base (261)..(261): a, c, t, g, unknown or other
  modified_base (270)..(270): a, c, t, g, unknown or other
  modified_base (287)..(287): a, c, t, g, unknown or other
  modified_base (330)..(330): a, c, t, g, unknown or other
  modified_base (345)..(345): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtggggagcttggtacaggccggggggtcctgagactctcctgtgcagcctctggattcaccttnagcagctangccatgacctgggtccncaggctccgaggggaggactggagtgggtctcgtctagttagnggaagtggtgcttanacaaactcgcagccctcgtgaacgggccgcttcacatctaccagagactactaccaagagacactctgtatctgacaaatcggaacacgccgtagacgtcggaccgaggaccgaccggtaccctaattacttagttggtacgttaacggtaaaggttgggtaggggggtaacgggttcgggggttccttaccggttccggttagggttcggtttttcggaccggttacgggtcgggggttaacccggtaaccggggg

SEQ ID NO: 386077 - DNA, 762 bp, Homo sapiens
  misc_feature: GZ8MTXP01CMYEL.39.21.B10.1.454.CMB.2.raw
  modified_base (300)..(300): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggctttttcttgtggcttattttaaaaggtgtccagtgtgaggtgcagctgttggagtcgtgggggagtcttggtacagggccggggggtccctgagactctcctgtgcagcctcgtggattcaccttcagcagctatcgccagtcgacccgtcgggtcccnccgaggcctacccgagggggaacggtacgtgggaggttcgggtctcgtcgtttaagttaggtggtaaaggttggtacgtactttaactaaacctaaaacgttaccgacaccggtaccccgttacccgggtgggaaaccggggcccgtaccttacccacccgtagtccctacccgaagtacgtaaccttaacgttaccgaaacggacgacctaaccttctacggttacttcgttacggaactaaacgttacgggaaaccgtacggtccccgtagggtaacggtaccgaccccgggaacggaaacccgtcccggtaacccgtttaattactttaaggttcggtaggaaacggtaaagggttgggggttaggggggggacgggttcgggggttcctttacccggttcggttacgggtttcggtttacggaccggttaccgggttaagggggccccgtaacggggg

SEQ ID NO: 386078 - DNA, 579 bp, Homo sapiens
  misc_feature: GZ8MTXP01B3HFP.39.21.B10.1.454.CMB.2.raw
  modified_base (301)..(301): a, c, t, g, unknown or other
  modified_base (348)..(348): a, c, t, g, unknown or other
tcagtcgcactagtcacgaccggtgctcgatttagtgtcgtcgcaagagaggagggggggaggaactgctcagttaggacccagacggaaccatggaagccccagcgcagcttctcttcctcctgctactctggctcccagatatcactggagaaatagtgatgacgcagtctccagcccaccctctctgtgtcctccaggagaaagcgcccaccctctcctggtacgggccagtcagagtgtagctacaacttgcctggacagcagaacctgaccaggtcccagctcatcatctatggtncactccaccgagggccagtcggtactcccagtccctaccgtttaggngactaggtgggtctagggaacagtcgttcactctacactatcgagcacgctgctagtctagtaagttatttgacttagtttattacgtgtactaaactagtaactaagtcgtacgtcggtccttcgtcgtacgtttcgggaacgggtaacgggttaaccggtaagggttacggaagtacgttaaccgaaacgttaccgtgggtacgcgtcgaccttacctaacgttcttcg

SEQ ID NO: 386079 - DNA, 735 bp, Homo sapiens
  misc_feature: GZ8MTXP01D65HQ.39.21.B10.1.454.CMB.2.raw
  modified_base (290)..(290): a, c, t, g, unknown or other
  modified_base (311)..(311): a, c, t, g, unknown or other
  modified_base (347)..(347): a, c, t, g, unknown or other
  modified_base (366)..(366): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggtctttttcttgtggctaattttaaaaggtgtccagtgtgaggtgcagctggttggaggtcgtggggggaggtcttggtacgagggcccggggggggtccctggagaccttctccgtgtgcagccttctggattccaccttcagcagctancgccatcgaccgtgggtcccnccgaggctcgaggggaggacgtggagtgggtctgtnttattaggtggaagttggngtactttaacaactaaactcgacacgtccctcggtgggaacgggtcccgtccttacaccgtacttcctacccaagtaacgtactaactaccaaagacgtacctaacttctacgtactccgttagaactaaaacgtacggaaactacggtcccgttaggacggtaccggacccgggaaggaaaccccgtacccgggttaacccctttaaagtttacttttaaggttaacggttagggaaccggggttaaaaggttggggggttaacgggggggtagggttacggggggttacctttaccgggttccggttacggggttccggtttttacggaccggttacgggggttccgggggaaccggtaaccggggg

SEQ ID NO: 386080 - DNA, 743 bp, Homo sapiens
  misc_feature: GZ8MTXP01AQKXN.39.21.B10.1.454.CMB.2.raw
  modified_base (282)..(282): a, c, t, g, unknown or other
tcagtcgcactagtcacgaccggtgctcgatttagtgtcgtcgcaggagagaggagcacagccctgggattttcaggtgttttcatttggtgatcaggactgaacagagagaactcaccatggagtttgggctgagctggtctttttcttgtggctattttaaaaggtgtccagtgtgaggtgcagctgttggagtcgtgggggagcttggtacgaggccggggggtcctgacgactctcctgtgcagcctctggacttcaccttcagtcagctatgacccntcgaccgtcgggtcccgccgaggcctcccgaaggggaacggtcgtggaggtgggtctcgtacttagttaggtggtaaggtggtggtaccttaataaactaaacccgtacgcctaaaacgccccgtccggtagggaaacggggtccccgtacctttaccgaccctaactcctacccgagacgtactacttacccgaagaacgtctaactcctagtactcgtagaacctaaagtacgaaacgacgaccgttggaacggtacggacccggtaaacgggaacccgtaacccggggtacccttaatttaacgtttaagtttacgggttacgggtaaacgggttaaagggtggggggttaacgggggggggacgggtttcggggggggaacctttaaccggttccgggttccggggtttcgggttttacgggttaacccgttaacggggttccgggggtaacccggg

SEQ ID NO: 386081 - DNA, 651 bp, Homo sapiens
  misc_feature: GZ8MTXP01EKK7U.39.21.B10.1.454.CMB.2.raw
  modified_base (295)..(295): a, c, t, g, unknown or other
  modified_base (315)..(315): a, c, t, g, unknown or other
  modified_base (366)..(366): a, c, t, g, unknown or other
  modified_base (377)..(377): a, c, t, g, unknown or other
  modified_base (403)..(403): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggtctttttcttgtggctattttaaaaggtgtccagtgtgaggtgcagctggttggaggtcgtggggggaggtcgttgggtacgacgggcccgggggggggtccctggacgacttcctccgtgtgcacgcctcgtggattccaccttcagcagctangccatcgaccgtgggtcccnccgaggcctccgaggggaggacgtggaggtcgggtctcgtcttagttaggnggtaagtggtnacttaacacaaactcgcagccctcgnggacgggccgtcttcaccatctaccagacgactactacaaagacgactactctagtaactcgtagaactaaagtcgggaaacacggtccctaggacgtcggacccggaaggaaccgaccgggtacccttaatttacgttagttggtgaacgggtaaaggttgggggtaggggggtaaggttcggggggttcttaccggttcggtggttcggttttcggaacgttcggggtcggggttccgaacggggg

SEQ ID NO: 386082 - DNA, 689 bp, Homo sapiens
  misc_feature: GZ8MTXP01C8G5H.39.21.B10.1.454.CMB.2.raw
  modified_base (283)..(283): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggtctttttcttgtggcttaattttaaaaggtgtccagtgtgaggtgcagctgttggagtcgtgggggaggtcgttggtacgagggccggggggtccctgagactctcctgtgcagcctgtggtattccaccttcagcagtctancgccatcgaccgtgggtccgccgaggcctaccgaggggaacggacgtggaggttgggtcctcggtacttagttagtggaagtggtgtactttacaactaaacgtcgcacgtcccttacgtggaacgggcccgtacgttccaaccattcctacagaacgactacttaccaagtacgactaactcttagtactacgtcgtaaactaaacgtaacgggtaaaccacggtaccgttacggaacggttacggacccgggaacggaaacccgaccggtacccttaaagtactttagttaaggtacgttaacggtaaaggttgggggtagggggtcggttacgggggttcttaaccggttcggttacggtttcggttttacggacgttacgggttcggggccgttaacggggg

SEQ ID NO: 386083 - DNA, 558 bp, Homo sapiens
  misc_feature: GZ8MTXP01AFKWI.39.21.B10.1.454.CMB.2.raw
  modified_base (274)..(274): a, c, t, g, unknown or other
  modified_base (291)..(291): a, c, t, g, unknown or other
  modified_base (351)..(351): a, c, t, g, unknown or other
  modified_base (485)..(485): a, c, t, g, unknown or other
  modified_base (497)..(497): a, c, t, g, unknown or other
  modified_base (516)..(516): a, c, t, g, unknown or other
  modified_base (540)..(540): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgttggagtcgtgggggagcttggtacaggccggggggtccctgagactctcctgtgcagcctctggattcaccttcagcagctangccatgacctgggtccnccaggctccgaggggaaggctggagtgggtctcgtctagttaggtggaagtggtgcttanacaaactcgcgcctcgtgaaggccgcttcaccatctcagagtactaattccaagagcacttctgtactctgaacaaatacgaacgagccgttgaacggtgcccgaggacaccggccctagtacttagtggtaanacgaaagtgggngggggtaggtggggcttcnccgtggggtctttgacgttacggnggggtccgaagggtccgg

SEQ ID NO: 386084 - DNA, 617 bp, Homo sapiens
  misc_feature: GZ8MTXP01AQAXM.39.21.B10.1.454.CMB.2.raw
  modified_base (279)..(279): a, c, t, g, unknown or other
  modified_base (471)..(471): a, c, t, g, unknown or other
  modified_base (489)..(489): a, c, t, g, unknown or other
  modified_base (561)..(561): a, c, t, g, unknown or other
  modified_base (573)..(573): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggagtcgttggtacgaggcccggggggtccctgagactctcctgtgcagcctcgtggacttcaccttcagcagtctancgccatcgacgtcgggtccgccgaggcctaccgaggggacggacgtggaggtcggtctcgtacttagttaggtgttagtggtgtagcccacatacgtacgcaaacgtacgtcggtaggaacggggtcccgttaccacctatccgtacccaagaacgaacctaataccgaaaagaacctacggcttagtactnacgaacaaagtcgaaacnggtacctaggacgacgaccggagaaccgacggcgttaatatcgtgtcgaacgttaagtacgagtaccggtanaggttcgttagngtcggtcgggtccttacggttaccggtggggccccgtaacgggg

SEQ ID NO: 386085 - DNA, 763 bp, Homo sapiens
  misc_feature: GZ8MTXP01A4GWG.39.21.B10.1.454.CMB.2.raw
  modified_base (262)..(262): a, c, t, g, unknown or other
  modified_base (384)..(384): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggtctttttcttgtggcttaattttaaaaggtgtccagtgtgaggtgcagctgttggagtcgtgggggaggtcgttggtacgaggccggggggatcccgtgacgactctcctgtgcacgtcctntgtacttccaccttcagcagctagtcgccagtcgaccgtcggtcccgcgacggccgtaccggagggaacggacgtgggagtcggtctcgtcttagttaggtggaagtggtactacctttaanaacgtaaacgtcgacgaacgtcctccgtagggaaccgggtccgtacgttccaacctactacctacccgaagtacgtaaacgtacttaacccgaaagtacggcctacgttaccgtagttactaccgtagaaacctaaaggttacggaaaccgtacggtacccgtaggtaccggtacgaccccgggaaaggaacccgtaaccccggtaccctttaaagttagtttaaggtttacggttaacggtaacgggttaaaacgggttcggggggtaggggggggttaaccggttcggggggttaccctttaacccgggttcggtaaccggggttttaccggtttacggggttaaccgttaaccgggggttcgggggtaaccccggg

SEQ ID NO: 386086 - DNA, 650 bp, Homo sapiens
  misc_feature: GZ8MTXP01DF3LZ.39.21.B10.1.454.CMB.2.raw
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggtcttttttcttgtggcttaattttaaaaggtgtccagtgtgaggtgcagctgttggagtcgtggggggaggtcttggtacgagggccgggggggtccctggagactctcctgtgcagcctctggattcaccttcagcagctacgccatgatcgtcgggtcccgccgaggcctccggaagggggaacggggcgtggggaggttcggggtcctcgacgtcctacgtttccggactaaggtgggtgggtcggaccacaccactacgacagtccgtccggtagggaaacgggtcccgttcacccgtcaccgagacgactaactccgaagaacctactctactagtctaagaaatgaaatacggtccgtaggaacgacgacccgaacgaccgacggacctaatacttattattggaacgaacgaaaccgaccccgaaggtaccgaaccttacgttagttcgggaactttcgtttcggaaccgtttcgggacggggaaccgaaacggggtaacccg

SEQ ID NO: 386087 - DNA, 685 bp, Homo sapiens
  misc_feature: GZ8MTXP01BCAQR.39.21.B10.1.454.CMB.2.raw
  modified_base (277)..(277): a, c, t, g, unknown or other
  modified_base (297)..(297): a, c, t, g, unknown or other
  modified_base (345)..(345): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggtctttttcttgtggctattttaaaaggtgtccagtgtgaggtgcagctgttggagtcgtgggggagcttggtacgagggccgggggggtccctggagactctcctgtgcagcctctggattcaccttcagcagctangccatcgaccgtgggtcccnccgaggcctccgaggggaaggactggagtgggtctcgtctagttaggnggaagtggtgcttaacacaaactcgcacgccctccggtggaacggggccctcttccacctatcctaccaagtacgtaacttacttacccgaaagacgacaaccttcgttagtaactccgtagaacaaatacggaaacgacgcccgtaggaaggtccggacccggaacggaacccgaccgggtaccccttaaagttaactttaagttcggtacggttaacggtaaaaggttgggggtacggggggggtaagggttcggggggttcctttaaccggttccccggttggggttcccgtttttaggaaccggtttacggggttccgggggccggtaaccggggg

SEQ ID NO: 386088 - DNA, 665 bp, Homo sapiens
  misc_feature: GZ8MTXP01BBVED.39.21.B10.1.454.CMB.2.raw
  modified_base (270)..(270): a, c, t, g, unknown or other
  modified_base (279)..(279): a, c, t, g, unknown or other
  modified_base (297)..(297): a, c, t, g, unknown or other
  modified_base (315)..(315): a, c, t, g, unknown or other
  modified_base (317)..(317): a, c, t, g, unknown or other
  modified_base (597)..(597): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggtctttttcttgtggcttaattttaaaaggtgtccagtgtgaggtgcagctgttggagtcgtgggggagtcgttggtacgagggccgggggggtcctgagactctctgtgcagcctctggacttcaccttnagcagctancgcatcgaccgtggtccncgagctacgaggggacgngnggagtggtctcgtactaagttacgtagggaagttggtagtactttaaacaacgtaaacgtacgctacggtacccctacgtgggaaaccggggtcctccgttaccaacctacgtcctaccgagacgtaacttactaacctaagacgacctaacttcgtcgtaactctacgaaactaaagtcggaaacaacggtccaacgggtagccgaaccggaggaacccgaccggtacccttaagttacttagttgtaacggacggtaaagggttggggttaggggggnggttacgggggttcttaccggttcgtaggttcgttacgtaaccgttcgggtcgggaacggtaacgggg

SEQ ID NO: 386089 - DNA, 689 bp, Homo sapiens
  misc_feature: GZ8MTXP01EY5G7.39.21.B10.1.454.CMB.2.raw
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggtctttttcttgtggctaattttaaaaggtgtccagtgtgaagtgcagttgttggattcgtgggggaggcttggtacaggccgggggggtcctgagactctctgtgcagcttgagtattcagtcttagcagctacgcatgacgcgtcggtccgccaggcctaccgaagggagggactgggagtgggtctgaggtagttggtgcaggtggtgagacccccagattacaacggcaaacgtactccggtagaaacggggtcccggttacaacccattccctaccaaaggaacgacctaaacttcccgaaaaagaaccctaacccttgtacctgtacgtaactaaacgtaaacgaaacctaaacgtacgaacggaaccggaccgggaaaccggaaccgaacccggtaaccgttaaacttaacttaacttaacgtaaaacgtaaacgtaacggtaaccggttaacggtaacgttaagtaacgtaaacgttaacgttaacggttacggttaaggttacggttaacgttacgtacttacgtccggttcggggtccgg

SEQ ID NO: 386090 - DNA, 610 bp, Homo sapiens
  misc_feature: GZ8MTXP01E1C7I.39.21.B10.1.454.CMB.2.raw
  modified_base (219)..(219): a, c, t, g, unknown or other
  modified_base (285)..(285): a, c, t, g, unknown or other
  modified_base (288)..(288): a, c, t, g, unknown or other
  modified_base (331)..(331): a, c, t, g, unknown or other
  modified_base (452)..(452): a, c, t, g, unknown or other
  modified_base (469)..(469): a, c, t, g, unknown or other
tcagtcgcactagtcacgaccggtgctcgatttagtgtcgtcgcaggagagaggagccccagccctgggatttttcaggtgttttcatttggtgatcaggactgaacagagagaactcaccatggagtttgggctgagcgtggtcgttttcttagtggctattttaaaaggtgtccagtgtgaggtgcagctgttggagtgtggggagcttggtaacgnggccggggggggtccctgagacttctcctgtgcagcctcgtggatccaccttcgagccagctagcnccntagtaccgtcgggtcccgccgacgcgtcgacggggaaggacgngggtaggtggtcgtcgttacttagttagtaggaaggtggtgtacttaactaacaaactacgacaccgccgtccgtcggaacgggcccgtcctacaaccactactccacgacatactacaanagacactactgtatctntacaaagacgaaacagccgtagacgcgacgacgaccgaccggtactacttacttattgtagttacgaaggttagggtggggtaggcggggcgttacgtcctacggttcgttacgtacgttacggtcgggcggtaaccgggg

SEQ ID NO: 386091 - DNA, 546 bp, Homo sapiens
  misc_feature: GZ8MTXP02J2FWA.39.21.B10.1.454.CMB.2.raw
  modified_base (371)..(371): a, c, t, g, unknown or other
  modified_base (379)..(379): a, c, t, g, unknown or other
  modified_base (394)..(394): a, c, t, g, unknown or other
  modified_base (407)..(407): a, c, t, g, unknown or other
  modified_base (414)..(414): a, c, t, g, unknown or other
  modified_base (420)..(420): a, c, t, g, unknown or other
  modified_base (427)..(427): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagcgtgtcgttttctaggtggctattttaaaaggtgtccagtgtgaggtgcagctgttggagtcgtgggggagcttggtacaggccggggggtcctgagactctcctgtgcagcctctggattcaccttcagcagctatgccatgacctgggtccgcaggctccgaggggaaggctgggagtgggtctcggtctagttaggtggaagtggtgacttatacaaactacgcagcctcgngagggccnctcaccatctcaganactataccaagcncactctntatctnacaatanacacgcgagagcgacgacgacgacgacctatattagtagtagagtaagtagggtagggggtacgggtcggggtacgtacgtcgtcggttcggttcgtacgtacggtacgggacggacgg

SEQ ID NO: 386092 - DNA, 617 bp, Homo sapiens
  misc_feature: GZ8MTXP02FPPXN.39.21.B10.1.454.CMB.2.raw
  modified_base (276)..(276): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagcgtggtcgttttctaggtggctattttaaaaggtgtccagtgtgaggtgcagctgttggagtcgtgggggaggcttggtacaggccggggggtccctgagactctcctgtgcagcctctggattcaccttcagcagctancgcatcgaccgtcggtccgccgacgcgacgagggaaggacgtaggaggtggtcgtcgtctagttaggtaggtagtggtgtacttactaactaaactacgacacgccgtcgtcggacgggccgtccgtacctaccactctacacgacgtactactacaacgagacactactagtactactacgacaaataacgaacgacgacgtacgtacgtacgacggacggaacgaccgtacctacttagttagttacgtagtagtaacggtaggggtagggggtacggggtacggggtacgtacgtcgtcggttcggtttacggtacgtacggtacgggtacggtacgg

SEQ ID NO: 386093 - DNA, 550 bp, Homo sapiens
  misc_feature: GZ8MTXP02I6RMD.39.21.B10.1.454.CMB.2.raw
  modified_base (290)..(290): a, c, t, g, unknown or other
  modified_base (389)..(389): a, c, t, g, unknown or other
  modified_base (397)..(397): a, c, t, g, unknown or other
  modified_base (410)..(410): a, c, t, g, unknown or other
  modified_base (417)..(417): a, c, t, g, unknown or other
  modified_base (423)..(423): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagcgtggtcgttttctgtggctattttaaaggtgtcagtgtgaggtgcagctgttggagtcgtgggggaggcttggtacaggccgggggggtccctggagactctcctgtgcagcctctggattcaccttcagcagctatgccatgacctgggccnccaggctccgaggggaaggctggagtgggtctcgtctattaggtggaagtggtgtcttatacaaactacgcagcctcgtggaacgggccgcttcaaccntctccagnacctatccaaagncactctntatctnacaatagaacacgcgtagagcgacgacgacgacgactactattatagtagtagtaaggtagggtagggggtacgggtacggggtcgtacgtcgtcggttcgttcgtacgtacggtcgggacggacgg

SEQ ID NO: 386094 - DNA, 620 bp, Homo sapiens
  misc_feature: GZ8MTXP02JS33P.39.21.B10.1.454.CMB.2.raw
  modified_base (168)..(168): a, c, t, g, unknown or other
  modified_base (206)..(206): a, c, t, g, unknown or other
  modified_base (247)..(247): a, c, t, g, unknown or other
  modified_base (263)..(263): a, c, t, g, unknown or other
  modified_base (267)..(267): a, c, t, g, unknown or other
  modified_base (270)..(271): a, c, t, g, unknown or other
  modified_base (274)..(274): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagcggtgtgtttctaggtggctattttaaaaggngtcagtgtgaggtgcagctgttggagtgtgggggaggngttggtacgaggccggggggtccgtgagactctcctgtgcncgctctgtctctctcngcanctnncancgcgtcggccgcgcgcgcgaggaggacgtggaggtggtcgtcgtcgttagttaggtaggtaggtggtgtacttaactaactaacgtacgacgacgccgtcggtcggacgggaccgtcctaccacctactctacacgacgactactacaacgacgactactctatactactacgacaaagtacgaacgacgacgtacgtacgacgacggacggacgaccgtaccgtactagttagttacgtaggtaggtaacgggtaggggtacgggggtacggggtacggggtacggttaccggttcggttcgggttacggttacggtacggtacgggtacggggtacggtacggg

SEQ ID NO: 386095 - DNA, 674 bp, Homo sapiens
  misc_feature: GZ8MTXP02JYLBA.39.21.B10.1.454.CMB.2.raw
  modified_base (252)..(252): a, c, t, g, unknown or other
  modified_base (291)..(291): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggtctttttcttgtggctattttaaaaggtgtccagtgtgaggtgcagctgttgaagtcgtgggggagcttggtacaggccgggggggtccctgagactctcctgtgcagcctntggattcaccttcagcagctatgccatgacctgggtccnccaggctccgaggggaaggactggagtgggtctcgtctagttagtaggaagtggtgtacttagtacaaactacgacacgccctcgtggaacgggcccgcttaccacccgatcctacccgaagacgtacctacttacccgaaagacgtaccaaccttcgtacgttactcgttacgaacctaaaagttaccgaaacacgtaccctagggtacgtaccggacccggaacgggaacccgacccgggtacccttaattaacgttagtttggtacgaaccggtaaaagggttcgggggtaggggggtacggtacgggggtaccttaccggtccggttcgggttcggtttttacggaccgtttaccgggtacgggggacccgtacggggg

SEQ ID NO: 386096 - DNA, 565 bp, Homo sapiens
  misc_feature: GZ8MTXP02FT43Q.39.21.B10.1.454.CMB.2.raw
  modified_base (414)..(414): a, c, t, g, unknown or other
  modified_base (420)..(420): a, c, t, g, unknown or other
  modified_base (422)..(422): a, c, t, g, unknown or other
  modified_base (429)..(429): a, c, t, g, unknown or other
  modified_base (431)..(431): a, c, t, g, unknown or other
  modified_base (434)..(434): a, c, t, g, unknown or other
  modified_base (436)..(436): a, c, t, g, unknown or other
tcagtcgcactagtcacgaccggtgctcgatttagtgtcgtcgcaggagagaggagcccagccctgggatttcaggtgttttcatttggtgatcaggactgaacagagagaactcaccatggagtttgggctgagcgtggcgttttctagtggctatttaaaaggtgtccagtgtgaggtgcagctgttggagtctgggggaggcttggtacaggccgggggggtccctgagactctcctgtgcagcctctggattcaccttcagcagctatgccatcgacctgggtcccgccaggcctccgaggggaaggactggagtggggtctcgtctattaggtgaagtggtgcttatacaaactagctagcctcgtgagggccgcttcaccatcctccagagtacctattccaaaggcnctactntntatctananaananacacgcgtgagcgcgacgacgacgacctactattagttacgtagacgtaggtagggtagggggtacgggtacggggtcggtacgtccgtcggttcggtttcggtacggtacggtacgggtacggtacgg

SEQ ID NO: 386097 - DNA, 554 bp, Homo sapiens
  misc_feature: GZ8MTXP02GLGZ0.39.21.B10.1.454.CMB.2.raw
  modified_base (289)..(289): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtctgggggagcttggtacaggccgggggggtccctgagactctcctgtgcagcctctggattcaccttcagcagctatgccatgacctgggtccnccaggctccgaggggaacggactgggagtgggtctcgtctagttagtggaagtggtgtacttataccaaactcgcagccctcgtggaacgggccgtcttcaccatcctacagacgactactccaagagacactctgtatctgacaaatgaacagccagagtcgaccgaggacaccggcctactattacttgtagacgaaagtggtagggggagtcgggggtctacgtcgtggtcgtttacgtacgtacgtcggggtacgacgggg

SEQ ID NO: 386098 - DNA, 537 bp, Homo sapiens
  misc_feature: GZ8MTXP02JJFG7.39.21.B10.1.454.CMB.2.raw
  modified_base (347)..(347): a, c, t, g, unknown or other
  modified_base (351)..(351): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggtctttttcttgtggctattttaaaaggtgtccagtgtgaggtgcagctgttggagtcgtgggggaggcttggtacaggccggggggtccctgagactctcctgtgcagcctctggattcaccttcagcagctatgccatgacctgggtcccgcaggctccgaggggaaggactggagtggtctcggtctagttagtggaagtggtgnttanacaaactcgcagccctcgtgaacgggccgcttccaccatctccagagactatccaagacgcactctgtatctgtacaaatgaacagcctgagtgccgaggacacggcctatacttatgtgacgaaagtgggtagggggagtcgggggctacgtccgtggtccgtttgacgtacgtcgggccgaggg

SEQ ID NO: 386099 - DNA, 707 bp, Homo sapiens
  misc_feature: GZ8MTXP02HR1OM.39.21.B10.1.454.CMB.2.raw
tcagtcgcactagtcacgaccggtgctcgatttagtgtcgtcgcaggagagaggagcccagccctgggattttcaggtgttttcatttggtgatcaggactgaacagagagaactcaccatggagtttgggctgagcgtgcgttttctagtggctattttaaaggtgtccagtgtgaggtgcagctgttggagtcgtgggggaggcttggtacgaggccggggggtcctggagactctcctgtgcagcctctggattcaccttgacgcacgctatcgacagtcgtaccgtcgggtcccgaccgacggtcctaccggaaggggaacggtcgtagggtaggtcggtcgtcgtattacgttaggtacggtaagtggtcgtacgttactaacgtaaacctcgactacgtcccgttacggtcggaacgggccgtctaccacgtactaccaccgagtacgtaaccttacgtaccgaagtacgtacctacgttcgtagtactaccgttaggacctaaagtcgaaacgtacgtacgtacggacgtccgaccggtagacccgtacggtaccctaagttaacgttacggttcggaacggttaacggtaaaggttcgggggtaaacgggggttcgggtaccggggttaccgttaaccgttccggggttaggttaccggttttacggacgtttaaccgggggtcgggacgtaaccgggg

SEQ ID NO: 386100 - DNA, 557 bp, Homo sapiens
  misc_feature: GZ8MTXP02FZQD5.39.21.B10.1.454.CMB.2.raw
  modified_base (355)..(355): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggcttttcttgtggcttattttaaaaggtgtccagtgtgaggtgcagctgttggagtcgtgggggaggcttggtacaggccggggggtccctggagactctcctgtgcagcctctggattcacttcagcagctatgccatcgacctgggtcccgccaggctccgaggggaacggactgggagtgggtctcgtctagttaggtggaagtggtgcttanacaactacgcagcctccgtggaacgggcctcttccacatctacagagactataccaagagcactctagtactctgacaaatagaaacagacctagagtcgaccgaggaccacggcctatattacgtgtagacgtaaagtgggtagggggagtcgggggctacgtccgtaggtcgtttagacgtacgtcggggacgtacgggg

SEQ ID NO: 386101 - DNA, 549 bp, Homo sapiens
  misc_feature: GZ8MTXP02IR6QB.39.21.B10.1.454.CMB.2.raw
  modified_base (290)..(290): a, c, t, g, unknown or other
  modified_base (327)..(327): a, c, t, g, unknown or other
  modified_base (392)..(392): a, c, t, g, unknown or other
  modified_base (430)..(430): a, c, t, g, unknown or other
  modified_base (438)..(438): a, c, t, g, unknown or other
  modified_base (444)..(444): a, c, t, g, unknown or other
  modified_base (450)..(450): a, c, t, g, unknown or other
  modified_base (483)..(483): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacaggccggggggtccctgagactctcctgtgcagcctctggattcaccttcagcagctatgccatgacctgggtccnccaggctccgaggggaaggctggagtgggtctcggtntagttaggtggaagtggtgtctttaataccaaaactcggcaggtcccttccgtggaacgggcccncttccaccatctccagagactattaccaagagcactcngtatctanacaaanagaacnacgtagagcgccgagacacgacctatattatgngagaagtgggtagggggaggtcgggtactacgtcgtggtacgtttcgacgtacggtcgggcgacgg

SEQ ID NO: 386102 - DNA, 542 bp, Homo sapiens
  misc_feature: GZ8MTXP02JFYDU.39.21.B10.1.454.CMB.2.raw
  modified_base (290)..(290): a, c, t, g, unknown or other
  modified_base (334)..(334): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacaggccggggggtcctgagactctcctgtgcagcctctggattcaccttcagcagctatgccatgacctgggtcccncaggctccgaggggaaggactggagtgggtctcgtctagttagnggaagtggtgcttatacaaactacgcagcctcgtggaacgggccgcttcaccatcctccagacgactataccaagacgacactctgtatctgacaaatgaacagcctgagtcgccgaggacacgcctagtacttatgtgacgaaagtgggagggggagtcgggggctacgtcgtggtcgtttgacgttacggtcggggccgaacgggg

SEQ ID NO: 386103 - DNA, 711 bp, Homo sapiens
  misc_feature: GZ8MTXP02F951U.39.21.B10.1.454.CMB.2.raw
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggtctttttcttgtggctattttaaaaggtgtccagtgtgaggtgcagctgttggagtcgtgggggaggcttggtacgaggccggggggttccctggacgactctcctgtgcagcctctggattccaccttcagcagctatcgccatcgacccgttgggtcccgccgaggcctaccgaggggaacggacgtggagtggtctcgtcttagttagtggaagttggtgtacttaacgtaccaaaacgtcgacacgcccttaccgggtggaacgggcccgtcttacccaccgtaatccgtacccaagtacgtacttaacttacccgaaagacgtacctaaccgttctacgttaactccttaggacctaaaacgttacgaaacgtacgacccgttaggaacggtacgacccgggaaggaacccgaccgggtaccccttaagttacttaagttgtacgaacggtaaagttgggggtacgggggtacgggttacggggggaccttaaccgggttcccggttcggggttaccggttttacggtacccgtttaacgggccgggggtaaccggtaaccggggg

SEQ ID NO: 386104 - DNA, 560 bp, Homo sapiens
  misc_feature: GZ8MTXP02FFPXP.39.21.B10.1.454.CMB.2.raw
  modified_base (355)..(355): a, c, t, g, unknown or other
  modified_base (383)..(383): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggcttttcttgtggctattttaaaaggtgtccagtgtgaggtgcagctgttggagtcgtgggggaggcttggtacaggccgggggggtccctgagactctcctgtgcagcctctggattccaccttcagcagctatgccatgacctggggtcccgccaggcctccgaggggaaggactgggagtgggtctcgtctataggtggaagtggtgtcttanacaaaactcgcagcctcgtgacgggccnttcaccatcctccagagactatccaagagcactctagtatctgacaaatagaacagcctaggacgtcgaccgaggaccaccggaccctaattattatgtagacgtaaaagtggggtagggggaggtcgggggacttacgtccgtggtcgttttacgactacggtcggggcgacgggg

SEQ ID NO: 386105 - DNA, 573 bp, Homo sapiens
  misc_feature: GZ8MTXP02F6JPK.39.21.B10.1.454.CMB.2.raw
  modified_base (338)..(338): a, c, t, g, unknown or other
  modified_base (384)..(384): a, c, t, g, unknown or other
  modified_base (446)..(446): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggcttttcttgtggctattttaaaaggtgtccagtgtgaggtgcagctgttggagtctgggggaggcttggtacaggccgggggggtccctgagactctcctgtgcagcctctggattcaccttcagcagctatgccatcgacctgggtcccgccaggcctccgaggggagggctgggaggtgggtctcgtctagttagnggaagtggtgcttagtacaaactcgcagccctcgtgaacgggcccncttcgaccatcctaccagagactacttaccaagacgacactctagtatctgacaaatgaacngcctaggagtacgacgacggacaccggtcctagtattattcggtagacggaaagttggggagggggtaggtcgggggtactacgtccgtgggtccgttttggaccgttacggtcggggacgaacggg

SEQ ID NO: 386106 - DNA, 638 bp, Homo sapiens
  misc_feature: GZ8MTXP02HMMDY.39.21.B10.1.454.CMB.2.raw
  modified_base (251)..(251): a, c, t, g, unknown or other
  modified_base (298)..(298): a, c, t, g, unknown or other
  modified_base (483)..(483): a, c, t, g, unknown or other
  modified_base (494)..(494): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagcgtggtcttttctagtggctattttaaaaggtgtccagtgtgaggtgcagctgttggagtcgtgggggagcgttggtacagccgggggggtcctgagactctcctgtgcagcctntggacttcacccttgacgcagtctatcgccatcgaccgtgggtcccncctaggcctaccgaggggaaggtacgtggaggtcgggtactcgtcttagttaggtggtaaaggtggtgtacttaagtaaccaaaacgtcgacacgtcccgttacggtcgggaacggggtcctaccgttccaacctacgtcctacccgagtacgacttactaccaagacgactacgtctgtactcnacaatagaacngacctagagcgacgacgaaccgcggtacctatatttacgttaggacgtaggtaaaacgtgggggtacgggggtaacgggtgggggtaccttacggtccgttggggttacgtttcggaacgttcggtacggggtaccgtacgggg

SEQ ID NO: 386107 - DNA, 686 bp, Homo sapiens
  misc_feature: GZ8MTXP02I5LPH.39.21.B10.1.454.CMB.2.raw
  modified_base (403)..(403): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggtctttttcttgtggctattttaaaaggtgtccagtgtgaggtgcagctgttggagtcgtgggggaggcttggtacaggccggggggtccctggagactctcctgtgcagcctctggattccaccttcagcagctatgccatcgaccgtcggtcccgccgaggcctaccgaggggaaggacgtggagtgggtctcgtactagttaggtggaagtggtgtacttaagtaaccaaacgtacgcacgccctccgtggaacgggcccncgttccacctatcctaccaagacgactactaccgaaagacgactaccttacgtagttaactcgtacgaaccgtaaaattacggaaaaccacggtacccttagggaacggttaccggacccgggaaacggtaaccgaacccgggtaccctttaaagttaacgtttaagtttaggtacggtaacggtaaaaggttgggggtacggggggtagggtacgggggtacttacggtccgttgggttaccggttttaggaccgttacggttcgggggaccgtaacggggg

SEQ ID NO: 386108 - DNA, 601 bp, Homo sapiens
  misc_feature: GZ8MTXP02JLD8E.39.21.B10.1.454.CMB.2.raw
  modified_base (261)..(261): a, c, t, g, unknown or other
  modified_base (287)..(287): a, c, t, g, unknown or other
  modified_base (444)..(444): a, c, t, g, unknown or other
tcagtcgcactagtcacgaccggtgctcgatttagtgtcgtcgcaggagagaggagcccagccctgggatttcaggtgttttcatttggtgatcaggactgaacagagagaactcaccatggagtttgggctgagctggctttttcttgtggctattttaaaaggtgtccagtgtgaggtgcagctgttggagtcgtgggggagcttggtacaggccggggggtcctgagactctcctgtgcagcctctggattcaccttnagcagctatgccatgacctgggtccnccaggctccgaggggaggactggagtggtctcggtctagttagtggaagtggtgtcttaatacaaactcgcacgccctccgtggaacgggccgcttccgacctatcctaccagacgactactaccaagacgcactctgtatctagacaaatgaaacncgacgtagacgcgaccgacggaccgaccgtaccttaatacgttacgttacggtacgacggtaaaggtgggggtacgggggtacgggtacggggtacgtaccggttccggttcggttacggtttacggaccgttacgggtacggggaccggtacgggg

SEQ ID NO: 386109 - DNA, 572 bp, Homo sapiens
  misc_feature: GZ8MTXP02I838G.39.21.B10.1.454.CMB.2.raw
  modified_base (334)..(334): a, c, t, g, unknown or other
  modified_base (349)..(349): a, c, t, g, unknown or other
  modified_base (385)..(385): a, c, t, g, unknown or other
  modified_base (434)..(434): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtctgggggaggcttggtacaggccggggggtccctgagactctcctgtgcagcctctggattcaccttcagcagctatgccatgacctgggtccgccaggctccgaggggaaggcgtggaggtggtctcgtctagttagnggaagtggtgcttanacaatcgcagcctcgtgaacggccgcttccacatcnccagacgtactacttccaagcgacaccgtctgtatctgacaaatgaacngcctagagtgaccgaggacaccggtcctagttatacgttcgtagacgtaaaggtggggtagggggtacggtacgggggccttaacggtccggttaggttcgttttacggaccgttacggtcgggggtaccaacggggg

SEQ ID NO: 386110 - DNA, 535 bp, Homo sapiens
  misc_feature: GZ8MTXP02JV9DD.39.21.B10.1.454.CMB.2.raw
  modified_base (287)..(287): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtctgggggagctggtacagccgggggggtccctgagactctcctgtgcagcctctggattcaccttcagcagctatgccatgacctgggtccnccaggcctccgaggggaaggactggagtgggtctcgtctagttagtggaaagtggtgcttagacaaactcgcagcctccgtgaacgggccgcttcaccatctccagagactattccaagagcactctgtatctgacaaatgacagctgagtgcgagacacggcctatattactgtgacgaaagtggtagggggtagtcgggggactcgtccgtggtcgttttcgactacggtcggggaccgtaagggg

SEQ ID NO: 386111 - DNA, 657 bp, Homo sapiens
  misc_feature: GZ8MTXP02IOAPJ.39.21.B10.1.454.CMB.2.raw
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggtcttttcttgtggctattttaaaaggtgtccagtgtgaggtgcagctgttggagtcgtgggggaggcttggtacagggccgggggggtccctggagactctcctgtgcagcctctggattccaccttcagccagctatcgccagtcgaccgtgggtcccgccgaggctccgaggggaaggacgtgggaggtggtctcgttctagttaggtaggtaagtggtactcttaataaccaaactacgcacgcccgtcgtgggaacgggtccgcttccacctatcctcccagacgactactaccaagacgctactctagtatcctagacaaaagtcgaaactgacccttggacgtacggacccggaaggacccgaccgggtaacccttagttaacgttaatttcggtaggaaacggtaaagttagggggttacggggggtaggggttacggggggtaccttaccggtcccggttgggttaccggttttacgaacggtttccggtcgggggaccgtaccggggg

SEQ ID NO: 386112 - DNA, 592 bp, Homo sapiens
  misc_feature: GZ8MTXP02H6JQC.39.21.B10.1.454.CMB.2.raw
  modified_base (255)..(255): a, c, t, g, unknown or other
  modified_base (297)..(297): a, c, t, g, unknown or other
  modified_base (415)..(415): a, c, t, g, unknown or other
  modified_base (461)..(461): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtggggggaggcttggtacaggccgggggggtccctggagactctcctgtgcagccctntggattcaccttcagcagctatgccatcgaccgtgggtcccnccgaggctccgaggggaacgggctgggaggtgggtctcgtcttagtttaggtggtaaggtggtgcgtttactaacaaacgtcgcacgccctcgtcgggaacgggccctcgttccaccntcctcccgagacgactactaccgaaagacgacactctgtactcgtnacaaatgaaactgccgtagagtcgccgacggacaaccggcctaagtacttctgtgacgaaagtggggtacgggggagtcggggacttacgtcgttcggtacgtttacgacgtacggtcggggaccgagggg

SEQ ID NO: 386113 - DNA, 752 bp, Homo sapiens
  misc_feature: GZ8MTXP02JXB5A.39.21.B10.1.454.CMB.2.raw
tcagtcgcactagtcacgaccggtgctcgatttagtgtcgtcgcaggagagaggagcccagccctgggattttcaggtgttttcatttggtgatcaggactgaacagagagaactcaccatggagtttgggctgagcgtggcttttcttgtggctattttaaaaggtgtccagtgtgaggtgcagctgttggagtcgtgggggaggcttgggtacagggcccgggggggtccctggagactctcctgtgcagcctctggattcaccttcagcagctatcgccatcgacccgtcggggtccccgccgacggccgtccgaaggggaagggacgtgggaggtgggtcttcgtcttagttaggtggaagttggtgtactttaactaactaaaccgtacgccacgtcccgttccggtgggaaccggggtcccgtaccttaccgaccctaacttcctacccgaagaacgtaccttaacgttacccgaaaggaccgtacctaacccttcgttacgttaactcttacggaaacctaaaagttaccggaaaccaacggtccccgttaagggaacggtacgacccggggaaacgggaacccgtacccgggtacccttaaagtttactttagttggtacggtaacggtaaaaggtggggggtaggggggttacggggtcggggggttaacccttacggttcccggttgggggttaccgtttttacgggaaccgtttccggggtcgggggaccgtaaccggggg

SEQ ID NO: 386114 - DNA, 581 bp, Homo sapiens
  misc_feature: GZ8MTXP02HVNWA.39.21.B10.1.454.CMB.2.raw
  modified_base (333)..(333): a, c, t, g, unknown or other
  modified_base (389)..(389): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacaggccgggggggtcctgagactctcctgtgcagcctctggattcaccttcagcagctatgccatgacctgggtccgccaggctccgaggggaggactggagtgggtctcgtctattagnggaagtggtgcttatacaaactacgacagccctcggtgaaggggccgcttccaccntctcccagagactattacaagagcactctgtatctgacaaatagaaacgtagccgttaggagtggacccgagggaaccaccgggacccctataacttaagttacgtgacgtaaaagtgggtaggggggtaggtcgggggtctaacgtccgtgggtcggtttttcgacgttacggtcggggtacccgaagggg

SEQ ID NO: 386115 - DNA, 620 bp, Homo sapiens
  misc_feature: GZ8MTXP02GG0PI.39.21.B10.1.454.CMB.2.raw
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggcttttcttgtggctattttaaaaggtgtccagtgtgaagtgcagttgttggattcgtgggggaggcgttggtacaggccgggggggtcctggagactctcctgtgcagcttcaggattcagtcttagcagctacgcatgagctggtccgcaggctccgaggggaaggactggaggtggtctcgaggtattgggtgcgtagtggtgacgaccccaacattacacggcacgtaacgtcccggtaggaaacggggtcccggtttacacccgtaagtcctaccgaagaacgacaaacgttaccaaaacggtaaaccacccctcgttacctacgttacgaacctaaaattacgaaaccaacctaggaagacggaccggaagacccgaccggtaccctaatactactaacgtaacgaaaagtcgaccgtacggatacgtacaccgtatacgtagggaactgtacgtacgatctacggtcgggtccg

SEQ ID NO: 386116 - DNA, 853 bp, Homo sapiens
  misc_feature: GZ8MTXP02JSINO.39.21.B10.1.454.CMB.2.raw
  modified_base (253)..(253): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggagcttggtacgacggccggggggtccctgacgactctcctgtgcagcctntggacttccaccttcagcagtctatcgccatcgaccgtcgggtccccgccgacggcctccgaaggggaacggtacgtgggaggtgggtcctcgttcgtaagtttaggtagggtaaaggttggggtacgtacgtttaacgtaaacccgtaaaacgtaccgaccgtaacggtcccccgttaccgggtacggggaaaccgggggtcccccgtacccgtttaccccgaacccgtacgttaccccgttaaccccgaaacggtaaaccggtaaaccctttaaacgttacccgaaaacggtaccgtaccctaaccgttcgttaacggttaccttaccgtacggtaaacctaaaacgttacgaaaaccgtacggtacccgtagggtacgtaccggacccgggaacgggaacccgaaccccgggttaccctttaagtttaacgtttaacgtttcgggtaacggtaaccgggttaaaacgggttggggggttacgggggggtaacggggttaccggggggtaccgtttaacccggttccgggttacggggtttaccggttttttacgggacccgtttaaccggggttccgggggacccggtaaccggggg

SEQ ID NO: 386117 - DNA, 632 bp, Homo sapiens
  misc_feature: GZ8MTXP02F67XE.39.21.B10.1.454.CMB.2.raw
  modified_base (373)..(373): a, c, t, g, unknown or other
  modified_base (409)..(409): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggtctttttcttgtggctattttaaaaggtgtccagtgtgaggtgcagctgttggagtcgtgggggaggcgttgggtacagggcccggggggggtccctggacggacctctccgtgtgcagtcctcgtggattccaccttcagcagctatcgccatcgaccgtgggtcccgccgaggcctaccgaggggaacggcgtggagtgggtctcgtctagttgtaggagtggtgacttanaacaactacgacacgtccctcgtaggaacgggcccnccgttaccacctacgtcctaccagacgtactactacaagagcactctagtactctagacctaaatagaaaccagtacccgtaggacgtcggaccgaacggaccgaccggtccctagttacttattacggtgacggtaaaggtggggtagggggtaggtcgggggccttaacggtccgttcgggttacgtttacggaccgttacggcgggggaccgtacggggg

SEQ ID NO: 386118 - DNA, 571 bp, Homo sapiens
  misc_feature: GZ8MTXP02F7KV4.39.21.B10.1.454.CMB.2.raw
  modified_base (291)..(291): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggcttttcttgtggctattttaaaaggtgtccagtgtgaggtgcagctgttggagtctgggggaggcttggtacaggccgggggggtccctggagactctcctgtgcagcctctggattcaccttcagcagctatgccatcgacctgggtccnccaggctccgagggagggactgggagtggtctcgtctattaggtggaagtggtgtcttatacaaactacgcacgcctcgtgaagggccgcttccaccatctccagagactataccaagagctactctgtatactgacaaatgaacacgcctggagtcgaccggaaggacaccggtccctattacttagttagtagtacgaaagtggggtgggggaggtcgggggcttaccgtccgttgggtacgttttcggacgttacgggtcggggaccgtaacggggg

SEQ ID NO: 386119 - DNA, 655 bp, Homo sapiens
  misc_feature: GZ8MTXP02G01QP.39.21.B10.1.454.CMB.2.raw
  modified_base (492)..(492): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagcgtggtcttttcttgtggctaattttaaaaggtgtccagtgtgaggtgcagctgttggagtcgtgggggaggtcgttggtacgacgggccggggggtccctggagacctctcctgtgcagcctctggtacttcctaccttcagcagtcctatcgccagtcgtaccgtcgggtcccgccgacggcctacccggaagggggaacgggacgtggggaggttcgggtcttcgtcgttagttaggtggtaagttggtgtacttaagtaacaaactcgactacgccgtcgaggaacggtccgtccttaccacctactcctaccaagactacctataccgaaagacgctaactcgtgttaacncgtagaaacctaagtacgaacgagtacctaggacgtccgacggacgaaccgaccggtacctattaacgttgtagtcggaaacgtaaggtgggggagggggtacgttcggggacttacgtccggttggttacgtttacgacggttcggtacggggcgaacgggg

SEQ ID NO: 386120 - DNA, 818 bp, Homo sapiens
  misc_feature: GZ8MTXP02H7LHE.39.21.B10.1.454.CMB.2.raw
tcagtcgcactagtcacgaccggtgctcgatttagtgtcgtcgcaggagagaggagcccagccctgggatttttcaggtgttttcatttggtgatcaggactgaacagagagaactcaccatggagtttgggctgagctggtcttttttcttgtggctaattttaaaaggtgtccagtgtgaggtgcagtctgttggagtcgtgggggagtcgttggtacgacgggccggggggtccctggacgactcctccgtgtcgcacgtcctcgtggtacttcaccttcagcagctatcgccatcgacccgtgggtcccgaccgacggcgtacccggaaaggggtaacgggacgttggggaggttcggggttccttccggttactttaaggttacggtagggtaaaggttggtgtactttaacgaaacctaaaaccgtccgacaacggtccttaccggtacggggaaccgggtccgtacctttaccgaaccctacgtcctaacccgagtaacgacttaaccgttaccaaagggtacactacccttagttaccgtagtacccttaggaaaccaaaagttacgggaaaacctacggtccccttaggggtagtaacccgggaccgggaaacggacccgtaaacccgggttacccctttaaagtttaaccgtttacggtttaaggtaccgggttaaacggtaaaacgggtttcggggggtaaagggggttacggggtacgggggttaccctttaacgggttccggttacggtttacgggtttttaccgtaaccgtttccgggggtacgggacccgggttaaaccgggg

SEQ ID NO: 386121 - DNA, 751 bp, Homo sapiens
  misc_feature: GZ8MTXP02GTUUS.39.21.B10.1.454.CMB.2.raw
  modified_base (309)..(309): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggtctttttctgtggtctattttaaaaggtgtccagtgtgaggtgcagctgttggagtcgtgggggaggtcgttggtacgacgggccgggggggtccctgagtactctcctgtgcacgcctgtggtattcctaccttcagcagctatcgccagtcgaccgtcggggtcccnccgacggcctaccggaaggggtaacgggaagtgggaggtgggtctcggttacttagttaggtaggaaagttcggtagtacttaacgtaaccaaaacgttacgacgtacgtcccgttacggtgggaaccgggtccgtccttaccgaacctactcctaccgaagtacgtaaccttacgtacccgaaagacgtacctaaccttgtacgttactccgttaggaaacctaaaagtacggaaaccgacggtacccgttagggacggtccgaaccgggaaccgggaacccgtaacccggtacccctttaaagttaacctttagttacggtacggtaacgggtaaacggttagggggacgggggttaggggtacgggggtacttaccggtaacgggttcgggttacggtttacggacggtttaccgggtcgggggaccggtaaccggggg

SEQ ID NO: 386122 - DNA, 578 bp, Homo sapiens
  misc_feature: GZ8MTXP02FXBRH.39.21.B10.1.454.CMB.2.raw
  modified_base (379)..(379): a, c, t, g, unknown or other
  modified_base (440)..(440): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggcttttcttgtggctattttaaaaggtgtccagtgtgaggtgcagctgttggagtcgtgggggaggcttggtacaggccgggggggtccctggagactctcctgtgcagcctctggattcaccttcagcagctatgccatgacctgggtccgccaggctccgaggggacggactgggagtgggtctcgtctagttagtggaagtggtgcttatacaactagcagcctcgtgaacgggccncttcacctatcctccagacgactacttaccaagagcactctagtatctgacaaatgaaacngcctgagtcgccggaggaccgtaccggccctattacttaagttcgtagacgtaaaagtggggtacgggggtaggtcgggggacttaccgtccgtagggtcgttttacggacgttcggtacgggggtccgtaacggggg

SEQ ID NO: 386123 - DNA, 736 bp, Homo sapiens
  misc_feature: GZ8MTXP02IWYXM.39.21.B10.1.454.CMB.2.raw
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggtctttttcttgtggctaattttaaaaggtgtccagtgtgaggtgcagctgttggagtcgtgggggagcttgggtacgacgggccggggggtccctggagacctctccgtgtgcacgcctcgtggacttccaccttcacgcagtctatcgccatcggaccgtcggggtcccgccgacggcctaccggaggggaacggtcgtgggaggtcggtctcgtacttagttaggtggtagtggtagtacttaataaccaaactcgacacgtcccgtcgtgggaccggccgtccttccacctatcctaccaagtactacttactacgaagacgactaccttcgtatactcgtacgaaactaaaagtcgaaaacgtcgtacccgtaggaacgtccggaacccggacggaacccgtaaccggttacccttaaagttacgtttagtttacggacggtaaaacgggttaaaggggttcggggggttaagggggggtacggggtttacgggggtaccctttaaccggggttcccggggtttggggtttacccgggtttttacggaacccgggtttaaccggggccgggggtaacccggttaaccggggg

SEQ ID NO: 386124 - DNA, 784 bp, Homo sapiens
  misc_feature: GZ8MTXP02GFWL3.39.21.B10.1.454.CMB.2.raw
  modified_base (268)..(268): a, c, t, g, unknown or other
  modified_base (358)..(358): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacagggccgggggggtccctggagactctcctgtgcagcctcgtggattcaccttnagcagctatgccatcgaccgtcgggtccgccaggctaccgaggggaaggctggagtggtctcgtctagttagtggaagtggtgtacttanaacgaaactacgcacgcccttcgtgggaacggccgtcttaccgacctatcctacccgaagacgtaacttacgttaccaaaggacgtaccgtaccttacgtacgttactaccgtaggtaaaccctaaaattaacggtaaaccgaaccggttacccgttaagggaaacgggttacccgggaacccgggttaaaaccggggaacccgtaaaccccgggggttaacccctttaaagtttaaaccgtttttaaacgtttacggggtaaaccgggtaaacggttaaaaacggggttcggggggttaaggggggggttaaacgggggtcggggggtaaccctttaacgggttccccgggtttagggggtttaccgttttttacggggaacccggtttaccgggttacggggggaaccccgggtaaacgggggg

SEQ ID NO: 386125 - DNA, 741 bp, Homo sapiens
  misc_feature: GZ8MTXP02GXHZ6.39.21.B10.1.454.CMB.2.raw
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacaggccgggggggtcctggagactctcctgtgcagcctctggattcaccttcagcagctatgccatcgaccgtcgggtacccgccgtaggcctccgaggggaagggactgggaggtgggtctcgtctagttaggtggaaagttggtgtcttaagtacaaactcgcacgtccttccggtggaacgggccgtacgttccacccgtaatcctaccctaagaacgtaaccttaagttacccaaaggtaacgtacctaaccgttccttaaggttaacttccttaggaaacctaaaaccgttaggtaaaaccgacggtaccccgttagggacggtaccggacccgggtaacggaacccgacccggtaccccgttaaattaaccgtttagtttaccggtacggtaacggtaaaacggttcgggggttacgggggggtaagggttccggggggtacccttaacgggtcccgttaacggggttccggtttttacggacccggtttacgggttaccgggggaccggttaaaccggggg

SEQ ID NO: 386126 - DNA, 785 bp, Homo sapiens
  misc_feature: GZ8MTXP02GTNHX.39.21.B10.1.454.CMB.2.raw
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggcttttcttgtggctattttaaaaggtgtccagtgtgaggtgcagctgttggagtcgtgggggaggcttgggtacgaggccgggggggtccctggagactctcctgtgcagcctctggattcaccttcagcagctatgccatcgaccgtgggtccgccgaggcctaccgaggggaaacggacgtgggaggtggggtctcggtactagttaggtggtaaagtggtcgtactttataaaccgaaactacggcaggccccgttaccggtcgggaacggggcccgtacttacccgaacctattcctacccgaagtacgtaaccttaacgttacccaaaaggtgtaccaaccttccgttagttaacttccgttaggaaacctaaaaagttacgggaaaacccacgtacccgtttagggaaggttaccggacccgggtaaacggggaaacccgtacccggggtaacccctttaaatttaaaaccgtttaaacgtttgggttaaccggtaacgggtaaaaacgggtttcgggggtaagggggggggttaacgggttacgggggggccttttaaccggtcccggttttcggggttaccggttttttacggaacccggtttaaccggggtcgggggttacccggtaaaccggggg

SEQ ID NO: 386127 - DNA, 680 bp, Homo sapiens
  misc_feature: GZ8MTXP02JNB2D.39.21.B10.1.454.CMB.2.raw
  modified_base (388)..(388): a, c, t, g, unknown or other
  modified_base (508)..(508): a, c, t, g, unknown or other
  modified_base (523)..(523): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgaactggctttttcttgtggctattttaaaaggtgtccagtgtgaggtgcagctggttggagtcggtggggggaggtcgttgggtacgacgggcccgggggggtccctggacgacctctccgtgtgcacgcctcgtggtacttccaccttcgagcacgctatcgactatcgaccgtcggtcccgcgacggcctaccggagggaacggcgtggaggtcggtctcgtacgttagttaggtggaggtggtgtacttanaaccccaaacgtcgactaccgccgtaccggacggacggggccctcgttacccacctacttcccgtaaccgacgtaacgtaactaccttaccgaagacgacctacttccgtagtactcganactaaatcggaaacncgtccgtagacgtcgaaccgtacggacctacggtacctaattacgtagtcgtaggaacgtaagggtcgggggtagggggtacggtcgggggtaccttaccggtcggtaacggtttcgttacggttaccgaggtcccgggtacggggacggtacccgg

SEQ ID NO: 386128 - DNA, 683 bp, Homo sapiens
  misc_feature: GZ8MTXP02JACCE.39.21.B10.1.454.CMB.2.raw
  modified_base (243)..(243): a, c, t, g, unknown or other
tcagtcgcactagtcacgaccggtgctcgatttagtgtcgtcgcaggagagaggagcccagccctgggattttcaggtgttttcatttggtgatcaggactgaacagagagaactcaccatggagtttgggctgagctggcttttctgtggctattttaaaaggtgtccagtgtgaggtgcagctgttggagtcgtgggggaggcttggtacaggccggggggtcctggagactctctgtgcngcctcgtggacttcaccttcagtcagctatcgccagtcgaccgttcgggccccgaccgtacggcctacccggagggggaaacgggtaccgtaggggtaggttcggggtccttacggttaccttaaggtttaggtagggtaaagggttggtacggtacctttaacgtaaaaccgtaaaacgttaccgactaacggtcccgttcggtaggggaaacggggtccctacggttcccaaccctacgtccttacccgagaccgtaactataccgaagacgcacctcgtatacgtactagacaaagtgaaacacgtccgtaggatccggacgtacggccaaccggccttaatgttaacttgtacgaggtaaacggtggggtagggggtatcgggggtcttaccggtccgtagggttcgtttcgaacgttcggtcgggtacgacgggg

SEQ ID NO: 386129 - DNA, 533 bp, Homo sapiens
  misc_feature: GZ8MTXP01CEHW8.22.86.H09.1.454.CMB.2.raw
  modified_base (240)..(240): a, c, t, g, unknown or other
  modified_base (264)..(264): a, c, t, g, unknown or other
  modified_base (274)..(274): a, c, t, g, unknown or other
  modified_base (357)..(357): a, c, t, g, unknown or other
  modified_base (396)..(396): a, c, t, g, unknown or other
  modified_base (403)..(403): a, c, t, g, unknown or other
tcagacatacgcgtcacgaccggtgctcgatttagtgctatagacttgggtttgggaggagagaccctccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaanagcacccaggcaaagccccagacncatcatttangctgtacaataagcggcccctcagggggtcccctgatcgcttctctggctccaagtctcggcaacacggccctccctgacccntcctctgggctccaggctgaagatgagctgattattacngctgctntattgcgagcgcctacgtcgttggtcgtcggacggacggaccaagctcgaaccgtcgttacggtcacgacccgaaggccgttccgcccccgtggtcctaacctcctccgttcccctaacccgttccgtcg

SEQ ID NO: 386130 - DNA, 584 bp, Homo sapiens
  misc_feature: GZ8MTXP01AYME0.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtgggtggcaattatatggtatgatggaaagtaataaagactatgtggactcgtgaagggccgattcaccatctccagagacaactcaaagaacactctcgttctcaaatgaacaagcctgagaggcgaggacacggcagtgtatactgtgcgagagatcgacatgactaacggggaaatcgttttagattactcgtcgggggccaaggggacaacgtggtccaaccggttctcgtttccaacggcccttacccgaacccgtaaacggggtcccccaacgttcccgggttcccttccccccggtcgggccccgtccccgttcggcccttcccgaacgggtaacccg

SEQ ID NO: 386131 - DNA, 523 bp, Homo sapiens
  misc_feature: GZ8MTXP01DSKOV.22.86.H09.1.454.CMB.2.raw
  modified_base (426)..(426): a, c, t, g, unknown or other
  modified_base (508)..(508): a, c, t, g, unknown or other
  modified_base (512)..(512): a, c, t, g, unknown or other
  modified_base (515)..(515): a, c, t, g, unknown or other
  modified_base (521)..(521): a, c, t, g, unknown or other
  modified_base (523)..(523): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggggctgggagtggggtggcaattatatggtatgatggaaagtaataaagactatgtggactcgtgaaagggccgattcaccatctccagagacaactccaaagaacactctgtttctcaaatgaacaagcctgagaggcgaggacacgggcaagtgtatactgtgcgagagatcgacatagactaacggggaaancttttagatctcgtgggggcccaaaggggacaactggtcaccgtctcttcagcctcaccaagggcccattcggcttccccgngccnccngctcgngn

SEQ ID NO: 386132 - DNA, 532 bp, Homo sapiens
  misc_feature: GZ8MTXP01BDXM7.22.86.H09.1.454.CMB.2.raw
  modified_base (515)..(515): a, c, t, g, unknown or other
  modified_base (527)..(527): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtggcaattatatggtatgatggaagtaataaagactatgtggactcgtgaagggccgatcaccatctccagagacaactcaaagaacactctcgtttctacaaatgaacaagcctgagaggcgaggacacggcagtgtattactgtgcgagagatcgacatgacgtaacgggaaagtcgttttagattctcgtggggccaaaggggacacgtggtccaccgtctctcagcctccacgaacgggcccagttccggttccttcccctggccnccctgcctccgnggccg

SEQ ID NO: 386133 - DNA, 571 bp, Homo sapiens
  misc_feature: GZ8MTXP01A8Z0R.22.86.H09.1.454.CMB.2.raw
  modified_base (257)..(257): a, c, t, g, unknown or other
  modified_base (363)..(363): a, c, t, g, unknown or other
  modified_base (393)..(393): a, c, t, g, unknown or other
tcagacatacgcgtcacgaccggtgctcgatttagtgctatagacttgggtttgggctgagcgtggtttcgtcgttagctctttaagaggtgtccagtgtcaggtgcagctggtggagtcgtggggggaggcgtggtccagcctgggaggtccctgagactctcctgtgcagcgtctggattcaccttcagtggctatggcatgcactggctccgccaggctccgggcaagggggctgggagtgggtggctaattanatggtatgatggaagtaataaagactatgtggactccgtgaaagggccgattcaccatctcagagacaactccaagaacactctcgttctacaaattacagcctgngaggcgaggacacgggcagtgtattatggngcgagagagtacgacagagacgtaacggtaagtagttagtagtcgtcgtacggacggaacggacgacgtacgtcgtaccgtctctctcgtccgttacccgaccgaaccggacccgtaccgttccgttcccgttccccgtcccggtcccgtcccgtccgtccgttccgtaacggcgccg

SEQ ID NO: 386134 - DNA, 561 bp, Homo sapiens
  misc_feature: GZ8MTXP01ECCI3.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtggcaattatatggtatgatggaaagtaataaagactaatgtggactccgtgaaagggccgattcaccatctccagagacaactccaaagaacactctgttctcaaatgaacaagcctgagaggcgaggacacggcagtgtattactgtgcgagagatacgacatgaactaacgggaaagtcgtttttaggattctcgtgggggcccaaaggggacaacgtggtccaccgttctcttcagccctccgaccgaaacgggcccaacgttccgggttcccttcccccgtggccgcccctcgccttcccgaagggaaccg

SEQ ID NO: 386135 - DNA, 519 bp, Homo sapiens
  misc_feature: GZ8MTXP01EA6J5.22.86.H09.1.454.CMB.2.raw
  modified_base (229)..(229): a, c, t, g, unknown or other
  modified_base (389)..(389): a, c, t, g, unknown or other
  modified_base (406)..(406): a, c, t, g, unknown or other
  modified_base (408)..(408): a, c, t, g, unknown or other
  modified_base (468)..(468): a, c, t, g, unknown or other
  modified_base (473)..(473): a, c, t, g, unknown or other
  modified_base (485)..(485): a, c, t, g, unknown or other
  modified_base (509)..(509): a, c, t, g, unknown or other
tcagacatacgcgtcacgaccggtgctcgatttagtgctatagacttgggtttgggctgagcgtgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggnaaggggctgggagtgggtgcaattatatggtatgatggaaagtaataaagatatgtggactcgtgaaggccgattcaccatctccagagacaactccaaagaacactctctttcacaaatgaacaagcctgagaggcgaggacagggctagtgtattacngtgacgagagatcgaananagagtaagtaagtagttgtagtcgtcgtcggacgacggacgacgtcgtcgtactctctcncgccnccaccgacgccncgttcgttcctcccgtcgccgccncgctcgcgcg

SEQ ID NO: 386136 - DNA, 514 bp, Homo sapiens
  misc_feature: GZ8MTXP01E4G8H.22.86.H09.1.454.CMB.2.raw
  modified_base (307)..(307): a, c, t, g, unknown or other
  modified_base (333)..(333): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggatcaccttcagtggctatggcatgcactggctccgcaggctcgggnaaggggctggagtgggtgccaattanagtggtatgatgggaaagtaaataaagactatgtggactccgtgaagggccgattcaccatctccagacgacaactaccaaagaacactctgtttaccaccaaatgaaacagcctagagagggcggaaggacacgggcaggtgtaattacgttgttggcgagaagatcgataagttgaacg

SEQ ID NO: 386137 - DNA, 550 bp, Homo sapiens
  misc_feature: GZ8MTXP01EBDRE.22.86.H09.1.454.CMB.2.raw
  modified_base (543)..(543): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtggggtggactaattatatggtatgatggaaagtaataaagactatgtggactccgtgaaaggccgattcaccatctccagagacaactccaaagaacactctcgttctacaaatgaacaagctgagaggcgagacacggcagtgtattactgtgcgagagatcgacatagactaacgggaaagtcgtttagattcgtcgtggggaccgaagggacaacgtcggtccaccgtctcttcacgccctaccaccgaacgggccccacgttccggttcccttcccccgtggcccgccctcgcctccgnggaaccg

SEQ ID NO: 386138 - DNA, 547 bp, Homo sapiens
  misc_feature: GZ8MTXP01EL3NQ.22.86.H09.1.454.CMB.2.raw
  modified_base (540)..(540): a, c, t, g, unknown or other
tcagacatacgcgtcacgaccggtgctcgatttagtgctatagacttgggtttgggctgagctgggtttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggagtggggtggcaattatatggtatgatggaagtaataaagactatgtggactcgtgaaggcgatcaccatctccagagacaactccaaagaacactctgtttccacaaatgaacaagcctgagaggcgaggacacgggcagtgtattactgtgcgagagatcgacatgaactaacgggaaagtcgttttagattcgtcgtggggcccaaggggcaacgtggtccaccgtctcttcacgccctccgaccgaacgggcccacgttccggttccttcccccgtggcccgccctgacctcccgnggaaccg

SEQ ID NO: 386139 - DNA, 576 bp, Homo sapiens
  misc_feature: GZ8MTXP01CXG99.22.86.H09.1.454.CMB.2.raw
  modified_base (241)..(241): a, c, t, g, unknown or other
  modified_base (265)..(265): a, c, t, g, unknown or other
  modified_base (321)..(321): a, c, t, g, unknown or other
  modified_base (361)..(361): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaanagcacccaggcaaagccccagacncatcatttatgctgtacaataaagcggcccctcgagggggtccctgatcgctttcnctggctccaagtctggccaacacggccctccctagacccntctcgtggggctccgaggctagaagatggaggtctgtaattattactgtctgctcatttgcgaggcgtacctacgtacgttggggtgttacgggacgggaacgggtaccaaggtcctaggaacccgttccgttagggtccaacggtccccgaagggccttccgcccccgtcgggtcctaaccgttcctccggttcccctaaccccgttcgtcccg

SEQ ID NO: 386140 - DNA, 535 bp, Homo sapiens
  misc_feature: GZ8MTXP01C45VK.22.86.H09.1.454.CMB.2.raw
tcagacatacgcgtcacgaccggtgctcgatttagtgctatagacttgggtttgggctgagctggggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgcaggctccgggcaaggggctggagtggggtggcaattatatggtatgatggaagtaataaagactatgtgactcgtgaaggccgattcacatctccagagacaactccaaagacactctgtttcacaatgaacaagctgagaggcgaggacacggcagtgtattactgtgcgagagatcgacatgacgtacgggaaatgtttagatctcgtagggccaagggcacgtgtcaccgtctcttcacgccctccaccgaaacgggcccttaacgttccgggttcccttccccgtcggtcccgccctcggcctccgaaggcccg

SEQ ID NO: 386141 - DNA, 792 bp, Homo sapiens
  misc_feature: GZ8MTXP01AOFDV.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggcctccgcgaggcgtccgggcgaaggggctgggaggtgggtgactaaattatagtggtatgagtaggaaataaagtaaagtactagtggtaggactccggtaggaaacggggccgtattccaacctatcctaccaaggacgaaacaacctaccgaaagaaacctaccttactttaccgttttaccctaacctaaaagtacgaaaccgtaacgtacccgtaagggaaacgggaacggggaccgggaaacggggaacccggaaccggggtactaagggtttagttaaacgtttaaccgttgggtacggaccggtaaaggaagtaacgtaccggaactaagttacggaaaccggttaaacgggggtaaaacgtttccggttttttaaggaacgtttccgttaccgggttacgggggaaccccgaaagggggtaacctaaccggttcgggtaccctaacccggttccttcctttaaccgaaccggttcccctaccccgaaaccggaaacccggggtccccttacggttcccgggttccccttcccccggtgggccccgtcccgtcgcccgtaacccgaacggaacccg

SEQ ID NO: 386142 - DNA, 590 bp, Homo sapiens
  misc_feature: GZ8MTXP01BLXYT.22.86.H09.1.454.CMB.2.raw
  modified_base (238)..(238): a, c, t, g, unknown or other
  modified_base (261)..(261): a, c, t, g, unknown or other
  modified_base (358)..(358): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctgtaccangcaccaggcaaacgccccagacncatcatttatgctgtacaataacgccggcccctcgacgggggtcccctgactcgcttctctggctccagtctcggcaacacggccctccctgacccntctcgtcgggcctcgaggctgaagatggaggctgtattattactgtctgctctatttcgcgtacggccgtcctacgtacgttggggtcgttcggggacgggtacggggacccgaaggtccgtcggtaaccccggttcgttacgggtccgacggaccccgaacgggcccgttcggcccccccgtcgggtccaacccgttcccgtccggttcccccggtcccttccccgtcccg

SEQ ID NO: 386143 - DNA, 537 bp, Homo sapiens
  misc_feature: GZ8MTXP01B64H4.22.86.H09.1.454.CMB.2.raw
  modified_base (254)..(254): a, c, t, g, unknown or other
  modified_base (393)..(393): a, c, t, g, unknown or other
  modified_base (410)..(410): a, c, t, g, unknown or other
  modified_base (475)..(475): a, c, t, g, unknown or other
  modified_base (512)..(512): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctggggaggtccctgagactctcctgtgcagcgtctggattcacctttcagtggctatggcatgcactggctccgcaggctcggcaaggggctgggagtgggtggcaattanatggtatgatggaaagtaataaagactatgtggactccgtgaaagggccgattcaccatctccagagacaactccaaagaacactctcgtttcacaaatgaacaagcctgagagggcgaggacacggcagtgtattacngtgcgagagatcgacangaacgtacgggaaagtcgtttgatccgtcgtgggccaaggggactacgtggtccaccgtctctcncgcctccacgacgggcccagttccgttccttccccgnggccgccctgcctccgaaggaaccg

SEQ ID NO: 386144 - DNA, 560 bp, Homo sapiens
  misc_feature: GZ8MTXP01D5YN6.22.86.H09.1.454.CMB.2.raw
  modified_base (398)..(398): a, c, t, g, unknown or other
  modified_base (407)..(407): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaaataaagactaatgtggactccgtgaaagggccgattcaccatctccagagaacaactccaaagaacactctcgtttctacaaatgaacaagcctgagaggcgaggacacgggcagtgtattacngtgcgaganatcacagagaacgtaacggaagttcgtttagacttcgtacggacggggaccgaaggactacgtcggtccaccgtctctccacgcccacccgaccgacggcccttcgttcccgttcccttccccgcggcccgccccgcttccgaacggccgccg

SEQ ID NO: 386145 - DNA, 515 bp, Homo sapiens
  misc_feature: GZ8MTXP01BS1OO.22.86.H09.1.454.CMB.2.raw
  modified_base (241)..(241): a, c, t, g, unknown or other
  modified_base (340)..(340): a, c, t, g, unknown or other
  modified_base (357)..(357): a, c, t, g, unknown or other
  modified_base (494)..(494): a, c, t, g, unknown or other
  modified_base (513)..(513): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaanagcacccaggcaaacgcccccagactcatcatttatgctgtacaataagcgccctcgaggggtccctgatcgctttctctgcctcaagtctcggcaacncggccctccctgacccntctcgtcgggctccggggctagaaagatgaggtctgtattattactgtctgctcatttgcgaggggcgcctactacgttgggtgtcggcggagggaccagctcgccgtctaggcacgccgagcttcgcccttcggcnctctcgtcccacctcttcncg

SEQ ID NO: 386146 - DNA, 626 bp, Homo sapiens
  misc_feature: GZ8MTXP01EN46C.22.86.H09.1.454.CMB.2.raw
  modified_base (312)..(312): a, c, t, g, unknown or other
  modified_base (318)..(318): a, c, t, g, unknown or other
  modified_base (390)..(390): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggggctgggagtgggtggcaattatatggtatgatggaaagtaaataaagactatgtggactcgtgaaggccgatcacatcnccaganacaactcaagaacactctcgttcacaaatgaacaagcctgagaggcgaaggacacgggcagtagtattacgngtgacgagaagatacgaacagtagaaacgtaaacggggaaagttccggtttttagaacgttccgtacgtacggggggacccaaagggggtacctaaccgtgggtaccctaacccggttcttccgttcgaacgttcccctacccaaacccggtaaacggggccccttaacgttcccgggttcccccttcccccggtgggccccgtccccgttcggcccttccccgaagggtaacccg

SEQ ID NO: 386147 - DNA, 556 bp, Homo sapiens
  misc_feature: GZ8MTXP01DFGLG.22.86.H09.1.454.CMB.2.raw
  modified_base (389)..(389): a, c, t, g, unknown or other
  modified_base (528)..(528): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaataaagactatgtggactcgtgaaaggccgatcacatctccagagaacaactccaaagaacactctgtttcacaaatgaaacaagcctgagaggcgaggacacgggcagtgtattacngtgcgagagatcgacatgaacgtacgggaaaagtcgtttttagaagttctacgtgggggacccaaaggggaccacgtgtccaccgtctcttcacgccctacccacgaaacgggcccacgttccggttcccttcccccgnggccgcccctgcctcccgaagggaaccg

SEQ ID NO: 386148 - DNA, 499 bp, Homo sapiens
  misc_feature: GZ8MTXP01C6O6P.22.86.H09.1.454.CMB.2.raw
  modified_base (329)..(329): a, c, t, g, unknown or other
  modified_base (455)..(455): a, c, t, g, unknown or other
  modified_base (474)..(474): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggatcacttcagtgctatggcatgcactggctccgcaggctcgggcaggggctggagtggtgcaagttanagtggtatgatggaaataaataaagactagtgtgactcgtgagggcatcacatctcagagacaactacaagaacactcttcgtttacaccaaatgaacacggcctagacgaggcgaaggacacggnagtgtattacgttgttcgngagtaagatcgataagttgtaacgg

SEQ ID NO: 386149 - DNA, 524 bp, Homo sapiens
  misc_feature: GZ8MTXP01ETMGZ.22.86.H09.1.454.CMB.2.raw
  modified_base (420)..(420): a, c, t, g, unknown or other
  modified_base (502)..(502): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtgacaattatatggtatgatggaagtaataaagactatgtggactccgtgaaagggccgattcaccatctccagagacaactccaagaacactctgtttctcaaatgaacaagcctgagaggcgaggacacggcagtgtattactgtgcgagagatcgacatgactaacggggaaancgttttgatctcgtggggcccaaaggggcacgtggtcaccgtctcttcagcctccacaacgggcccagttccggcttccccnggccgccctgctccgaaggccg

SEQ ID NO: 386150 - DNA, 521 bp, Homo sapiens
  misc_feature: GZ8MTXP01CS4ZA.22.86.H09.1.454.CMB.2.raw
  modified_base (388)..(388): a, c, t, g, unknown or other
  modified_base (500)..(500): a, c, t, g, unknown or other
  modified_base (503)..(503): a, c, t, g, unknown or other
  modified_base (515)..(515): a, c, t, g, unknown or other
tcagacatacgcgtcacgaccggtgctcgatttagtgctatagacttgggtttgggctgagcgtgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgcaggctccgggcaaggggctgggagtgggtggcaattatatggtatgatggaagtaataaagactatgtggactccgtgaaggcgattcaccatctccagagacaactccaagaacactctcgtttctcaaatgaacaagcctgagagggcgaggcacggcagtgtattacngtgcgagagatcgacatgacgtagggaaatcgtttagattcgtcgtgggccgaaggacacgtggtccacggtctcttcacgcctcacgaacggccacgttcgccttccccgngcnccctgcctccgngaaccg

SEQ ID NO: 386151 - DNA, 569 bp, Homo sapiens
  misc_feature: GZ8MTXP01BTIXG.22.86.H09.1.454.CMB.2.raw
  modified_base (192)..(192): a, c, t, g, unknown or other
  modified_base (231)..(231): a, c, t, g, unknown or other
  modified_base (322)..(322): a, c, t, g, unknown or other
  modified_base (329)..(329): a, c, t, g, unknown or other
  modified_base (370)..(370): a, c, t, g, unknown or other
tcagacatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccngcagtgatgttggtgttataactatgtctctgtaccaangcacccagtcaaacgcccccagactcatcatttatgctgtacaataagccggccctcgacggggtccctgatcgcttctctgctcaagtcngcaaccncggcctccctgaccaatctcgtgggcctccgagctagaagntgagctgattattactgctgctctatttgcgtaggccgtcttacgtacgttggggtggttccgggcgggacgggaccaaggtccgtacggacccgtccgtaacgggtcacggacccgaacgggtccgtccggcccccgttcgggttaccctaacgtcccgttcccgttcccccgtccccttcccgtccgaaccggtccg

SEQ ID NO: 386152 - DNA, 592 bp, Homo sapiens
  misc_feature: GZ8MTXP01B17RI.22.86.H09.1.454.CMB.2.raw
  modified_base (396)..(396): a, c, t, g, unknown or other
tcagacatacgcgtcacgaccggtgctcgatttagtgctatagacttgggtttgggctgagcgtggctttcctacgttgctcttttaagaggtgtccagtgtcaggtgcagctggtggagtctgggggagcgtggtccagcctgggaggtccctgagactctcctgtgcagcgtctggatttcaccttcagtggctatggcatgcactggctccgccaggctccgggcaagggggctgggagtgggtggcaattatatggtatgataggaaagtaataaagactatgtggactcgtgaagggccgattcaccatctccagagacaactccaaagaacactctgtttacaccaaatgaaaacagcctgagaggcgaggacacggcagtgtattacgngtgagagtagactacgacagtagtaacgtaacggtaagggttacgtttagtacgtacgtacggtcgggaccggaacggacgtacgtcgtaccgtaccgtctctcttaccgtccttacccgtaaccgaaccggacccgttaccgttcccgttcccgttccccgtccggtcccgtcccgttccgtccgttccgtaacg

SEQ ID NO: 386153 - DNA, 514 bp, Homo sapiens
  misc_feature: GZ8MTXP01BCF6E.22.86.H09.1.454.CMB.2.raw
  modified_base (394)..(394): a, c, t, g, unknown or other
  modified_base (422)..(422): a, c, t, g, unknown or other
  modified_base (511)..(511): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggatttcaccttcagtggctatggcatgcactggctccgcaggctccgggcaagggggctgggagtggggtggcaattatatggtatgatggaagtaataaagactatgtggactccgtgaaagggccgattcaccatctccagagacaactccaagaacactctcgtttctcaaatgaacaagccctgagaggccgaggacacggcagtgtattacngtgcgagagatgacatgatacgggaaancgtttgatctcgtgggccaagggacacgtggtcaccgtctcttcagcctccacgaacggcccattcggctcccctgcgccctgctccgnggc

SEQ ID NO: 386154 - DNA, 600 bp, Homo sapiens
  misc_feature: GZ8MTXP01BSEOX.22.86.H09.1.454.CMB.2.raw
  modified_base (271)..(271): a, c, t, g, unknown or other
  modified_base (354)..(354): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcgtctggactcaccttnagtggctatggcatgcactgggcctccggccgagggccgtcccgggggcaagggggtctgggagtggggtcggactaagttanagtggtataggatggaaactaaataaagctagtcggtggacctccgtagaacggccgtattcacctagtctaccagacgaacaactaccaaagaacctacttcttacgtttacacctaaagtacgaaacacgacccgtaggacggaagggccggaaacgggacgacgggtacttaaggttagttaacgttacgttgggttacgaacggaaggaagtacgttaccgacgtaagttcggtaaaccggg

SEQ ID NO: 386155 - DNA, 596 bp, Homo sapiens
  misc_feature: GZ8MTXP01EK4T9.22.86.H09.1.454.CMB.2.raw
  modified_base (210)..(210): a, c, t, g, unknown or other
  modified_base (220)..(220): a, c, t, g, unknown or other
  modified_base (252)..(252): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgtggtttcgcgttaggctcttttaagaggtgtcagtgtcaggtgcagctggtggagtctgggggnggcgtgtcgngcgtggacggtccgtgagctctccgtgtgcgngcgtcgtggtactctacttcgagtggtctagtgcagtcgcgacgtcgccgtccgccgacggccggtcccgggacggacggggtcggtgggtaggtgggtaggtacgtaagttagtagtagtagtaagtagtaaggtaaagtaaagtaaagtaagtagtaggtagtacgtacgtaggacggacgtacgtacactactactacgacgaacgaacaactaaccaacaacgtacttacttacgttactaactaacgtacgaacgacgcgtagaggacggaggaacggacgacgacgttagtagtagttagttgttagaagagaagagacgacgtaagttaacgtaacg

SEQ ID NO: 386156 - DNA, 673 bp, Homo sapiens
  misc_feature: GZ8MTXP01AS64A.22.86.H09.1.454.CMB.2.raw
  modified_base (361)..(361): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaacagcacccaggcaaacgccccagactcatcatttatgctgtcaataagcggccctgacggggtccctgactcgcttctcgtggctccaagtctcggaccacgaccggccctccctgacccntccgtcgtcggggcctccgagggcttaggaagtagtggaacggtcttaggtatttaacttactggtcttggtcttctaagttttcgacggtacgggtcccgtcccgttaccgtaccggtttgggggtcgggtttccggggaccggggtaacggggtaacccgaaacggtccgtacgggtaaccccggttaccgttacggggtccgaaccggtaccccgaaagggttcccgttcccggttccccccgttccggggtaccctaacccgtttcccgttcccggtttccccctaaccccgttccccttaaccccgg

SEQ ID NO: 386157 - DNA, 545 bp, Homo sapiens
  misc_feature: GZ8MTXP01D38AO.22.86.H09.1.454.CMB.2.raw
  modified_base (315)..(315): a, c, t, g, unknown or other
  modified_base (389)..(389): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggagtgggtgcaattatatggtatgatggaagtaataaagactatgtgactcgtgaaaggccgattcacatctcaganacaactcaaagaacactctcgttctacaaatcgaacaagcctgagaggcgaggacacggcagtgtatactgtgngagagatcgacagtagactaacgggaaatcgtttagatcgtcgtgggccaagggacacgtgtccaccgtctcgtcacgcctccaaccgaaccgggcccttacgttcccggttcccttcccccgtcggcccgtcccgtcgcctccgaacggaacccg

SEQ ID NO: 386158 - DNA, 654 bp, Homo sapiens
  misc_feature: GZ8MTXP01D3739.22.86.H09.1.454.CMB.2.raw
  modified_base (394)..(394): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtggcaattatatggtatgatggaaagtaataaagactatgtggactccgtgaaagggccgattcaccatctccagagacaactaccaagaacactctcgttctacaaatgaacaagcctgagaggcgaggacacgggcagtgtattacngtgcgagagatcgacagtagaacgtaacggggaaagtcggtttttagaacgttcgtaccggttagggggacccgaaagggggtaccgtaaacgttcgggtacccgtaacccggttccttcccgtttccaacggttccccttaccccgaaacccggaaaaccgggggtcccccttaacggttccccgggttcccctttccccccccggttcgggccccgtcccccgtttcgggcccctttcccggaaccggggtaacccgg

SEQ ID NO: 386159 - DNA, 530 bp, Homo sapiens
  misc_feature: GZ8MTXP01CABS3.22.86.H09.1.454.CMB.2.raw
  modified_base (523)..(523): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcacctttcagtggctatggcatgcactggctccgcaggctccgggcaaggggctgggagtgggtggcaattatatggtatgatggaagtaataaagactatgtggactccgtgaagggccgattcaccatctccagagacaactccaagaacactctcgtttctcaaatgaacaagcctgacgaggcgaggacacggcagtgtattactgtgcgagagatcgacatgacgtacgggaaagtcgtttggatctcgtgggccaagggacacgtggtcacgtctcttcagcctccaccgaacgggcccagttccggttcttccccctggccgccctgcctccgnggaaccg

SEQ ID NO: 386160 - DNA, 570 bp, Homo sapiens
  misc_feature: GZ8MTXP01D057M.22.86.H09.1.454.CMB.2.raw
  modified_base (388)..(388): a, c, t, g, unknown or other
tcagacatacgcgtcacgaccggtgctcgatttagtgctatagacttgggtttgggctgagctgggtttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtgggtgcaattatatggtatgatggaaagtaataaagactaatgtggactcgtgaaagggccgattcaccatctccagagacaactccaaagaacactctgtttcacaaatgaacagctgagaggcgaggacagggcagtgtattacngtgcgagagatcgacagtgaactaacgggaaagtcgttttagattccgtacgtggggacccaaaggggacctacgtcgggtaccaccgttctacttcaacgccctacccaaccgaaacgggccccttacgttccggttccttccccccgtggcccgcccctggccctccgaacgggtaaccg

SEQ ID NO: 386161 - DNA, 562 bp, Homo sapiens
  misc_feature: GZ8MTXP01EG53L.22.86.H09.1.454.CMB.2.raw
  modified_base (239)..(239): a, c, t, g, unknown or other
  modified_base (263)..(263): a, c, t, g, unknown or other
  modified_base (356)..(356): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctggtaccanagcacccaggcaaagccccagacncatcatttatgctgtcaataagcggccctcgagggggtccctgatcgctttctctggctccaagtctcggacaacacggccctccctgacccntctcgtcgggctccgagggctagaagatgaggctgatttattactgctgctctatttgcgaggtcgacctacgtacgttggggtcgttcgggacgggacgggacccaaaggtcgtcggaaccggttcgttaacgggtcgacgacccgaacggccgttccggcccccgtcggtcctaaccgtctccgttccctaacccgttcctccg

SEQ ID NO: 386162 - DNA, 677 bp, Homo sapiens
  misc_feature: GZ8MTXP01BDC4B.22.86.H09.1.454.CMB.2.raw
  modified_base (226)..(226): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgcaggctccggnaaggggctgggagtgggtggcaattatatggtatgataggaaagtaataaagactaatgtggactccgtgaagggccgattcaccatctccagacgacaactaccaaagaacactctcgtttctacaaatcgaacaagcctgagaggcgaggacacggcagtgtattactgtgacgagaagatcgacatagaacgtaacgggtaaagtcgtttttagacgttccgtcggttacgggggacccaaagggggacctaaccggttcgggtacccgtaacccggttccttaccgtttaacccgaacggttcccccgttaccccgaaaccccggaaaccgggggtacccccttaacggtttcccccgggtttacccccgttttccccccccggttccggggcccccgttcccccggttccggttccccgtttccccgggaaacgggtaaccccggg

SEQ ID NO: 386163 - DNA, 579 bp, Homo sapiens
  misc_feature: GZ8MTXP01ECH0G.22.86.H09.1.454.CMB.2.raw
  modified_base (258)..(258): a, c, t, g, unknown or other
  modified_base (380)..(380): a, c, t, g, unknown or other
  modified_base (393)..(393): a, c, t, g, unknown or other
  modified_base (407)..(407): a, c, t, g, unknown or other
tcagacatacgcgtcacgaccggtgctcgatttagtgctatagacttgggtttgggctgagcgtgggttttcctcgttagctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggagtggggtggcaattanatggtatgatggaagtaataaagactatgtggactcgtgaagggccattcaccatctccagacgacaactcaagaacactctcttctacaaatgaacaagcctgagaggcgaggacacgggntagtgtatagtgngagagagatacganagtagaacgtaacggtaagttacggtttagtagtcgtacggtacgggacggaacggacgtacgtcgtccgtaccgtcctctctacgcccgtacccgaaccgaaccggtacccgttaccgttcccggttcccgttccccgtccggtcccgtcccgtccgccgtccgcggaacg

SEQ ID NO: 386164 - DNA, 542 bp, Homo sapiens
  misc_feature: GZ8MTXP01CYS3Y.22.86.H09.1.454.CMB.2.raw
  modified_base (309)..(309): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggagtccctgagactctcctgtgcagcgtctggatcaccttcagtggctatggcatgcactggcctccgcaggctccgggnaagggggctgggagtgggtggacctaattatagtggtatagatggaaagtaaataaaagctagtggtaggactccgtagaagggccgattccaccatcctaccagacgaacaactaccaaagaaccacttcttagtttacctacctaaatcgaaacacgcctagagacggcgaaggacgttacggcagttagtattacgttgttcgaagagaagatcgactaagttgtaacgg

SEQ ID NO: 386165 - DNA, 508 bp, Homo sapiens
  misc_feature: GZ8MTXP01C3N7X.22.86.H09.1.454.CMB.2.raw
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggatcacttcagtggctatggcatgcactggctccgcaggctccggggcaagggggctgggagtgggtggcctaattatatggtatgatggaaagtaataaagactagtgtggactcgtagagggcgatcacatctcagagacaactaccaagaactactctgtttacctaccaaatcgaacagcctagaggaggcgaaggacacggcagtgtattacgttgttgcgagaagatcgactaagttgtaacg

SEQ ID NO: 386166 - DNA, 540 bp, Homo sapiens
  misc_feature: GZ8MTXP01DI4LJ.22.86.H09.1.454.CMB.2.raw
  modified_base (367)..(367): a, c, t, g, unknown or other
  modified_base (384)..(384): a, c, t, g, unknown or other
  modified_base (480)..(480): a, c, t, g, unknown or other
  modified_base (533)..(533): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaagggggctgggagtggggtggcaattatatggtatgaatggaaagtaataaagactatgtggactccgtgaaagggccgattcaccatctccagagacaactccaagaacactctgttctacaaatgaacaagcctgganagggcgaggacacgggnagtgtattactgtgcgagagatcgacatgacgtaacgggaaagtcttttgattcgtcgtggggcccaaggggactacgtggtcacgtctcttaacncgcctccgacgaacgggcccagttccgttctccccgtgccgccctgcctccgnggaaccg

SEQ ID NO: 386167 - DNA, 573 bp, Homo sapiens
  misc_feature: GZ8MTXP01D0VC6.22.86.H09.1.454.CMB.2.raw
  modified_base (311)..(311): a, c, t, g, unknown or other
  modified_base (386)..(386): a, c, t, g, unknown or other
  modified_base (545)..(545): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtgcaattatatggtatgatggaaagtaaataaagactatgtggactcgtgaaaggccattcacatcncagagacaactccaaagaacactctcgttctacaaatgaacaagcctgagaggcgagacacggcagtgtattacngtgcgagagatacgacagtgaacgttaacgggaaatcttttaggattcgtcgtagggggacccaaaggggacctaacgtcgggtacctaacccggtcttccttcgaacgttcccctaccgaaaccgaaacgggccccaagttccggttcccttccccgnggccgcccctggccctccgaaggaaccg

SEQ ID NO: 386168 - DNA, 538 bp, Homo sapiens
  misc_feature: GZ8MTXP01A9QFN.22.86.H09.1.454.CMB.2.raw
  modified_base (512)..(512): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggggctgggagtggggtggcaaattatatggtatgatggaaagtaataaagactaatgtggactccgtgaaagggccgattcaccatctccagagacaactccaaagaacactctcgtttctcaaatgaaacaagcctgagaggcgaggacacgggcagtgtattactgtgcgagagatcgacatgaactacgggaaagtcgtttgatctcgtggggccaaggggacactggtcaccgtctcttcacgcctcaccgaagggcccagttcggttccttccccnggccgccctgcctccgaacggaaccg

SEQ ID NO: 386169 - DNA, 526 bp, Homo sapiens
  misc_feature: GZ8MTXP01BFSCO.22.86.H09.1.454.CMB.2.raw
  modified_base (240)..(240): a, c, t, g, unknown or other
  modified_base (337)..(337): a, c, t, g, unknown or other
  modified_base (353)..(353): a, c, t, g, unknown or other
  modified_base (374)..(374): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctctggtaccaanagcacccaggcaaacgccccagctcatcatttatgctgtcaataagcggccctcgaggggtccctgatcgcttctctggctccaagtctcggcaacncggccctccctgaccntctctgggctcgaggctgaanatgaggctgattattactgctgctctatttgcgaggctcctagacgttgggtgttcgggacggacgggacccaagccgtgaacccgtcgttacgggtcacgcccgaaggcttcgcccctcggtctaaccgtctcgttcccgccttccgtccg

SEQ ID NO: 386170 - DNA, 543 bp, Homo sapiens
  misc_feature: GZ8MTXP01DG233.22.86.H09.1.454.CMB.2.raw
  modified_base (520)..(520): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtgggtggcaattatatggtatgatggaaagtaataaagactatgtggactccgtgaaagggccgattcaccatctccagagacaactcaaagaacactctgttcacaaatgaacaagcctgagaggcgaggacacggcagtgtattactgtgcgagagatcgacatgaactaacggggaaagtcgtttttagattcgtcgtggggacccaaagggacacgtggtccaccgtctcttcacgccctaccaccgaacgggcccagttccggttccttcccccgnggccgccctgcctccgaaggccg

SEQ ID NO: 386171 - DNA, 515 bp, Homo sapiens
  misc_feature: GZ8MTXP01BDTWA.22.86.H09.1.454.CMB.2.raw
  modified_base (379)..(379): a, c, t, g, unknown or other
  modified_base (383)..(383): a, c, t, g, unknown or other
  modified_base (385)..(385): a, c, t, g, unknown or other
  modified_base (392)..(396): a, c, t, g, unknown or other
  modified_base (401)..(401): a, c, t, g, unknown or other
  modified_base (403)..(403): a, c, t, g, unknown or other
  modified_base (411)..(411): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagccccagactcatcatttatgctgtcaataaagcggccctcaggggtccctgatcgcttctctggctccaagtctggcaacacggcctccctgacccaatctctgggctccaggctgaagatnaggntnatatatnnnnntatgngngcgctacncgtggtgtcggcggaggacgaacgcgcgaacgtccgttacgtcgacgaccgaacgcgttccgccccgtccgtcctaacctctcgttcccgtcccgttccgtccg

SEQ ID NO: 386172 - DNA, 577 bp, Homo sapiens
  misc_feature: GZ8MTXP01CXHMP.22.86.H09.1.454.CMB.2.raw
  modified_base (258)..(258): a, c, t, g, unknown or other
  modified_base (303)..(303): a, c, t, g, unknown or other
tcagacatacgcgtcacgaccggtgctcgatttagtgctatagacttgggtttgggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctacactggaaccagcagtgatgttggtagttataactatgtctcnggtaccaacagcacccaggcaaacgcccccagactcatcatttangctgtcaatagccgcctcgacggggtcccccctgatcgcttctctggctcaagtctcggcaacacgccctccctgaccatctctgggactccgaggctagaagagtgaggcgtgtatttattacgtgtctgtcttactatttcggctacgggtccgtaacccttacgttaccggtttggggttcggtttcggggccggggttaacggggacccaacgggtccgtacgggtaacccgttcccgtacgggttacctaaccggccccgtaaaccggg

SEQ ID NO: 386173 - DNA, 562 bp, Homo sapiens
  misc_feature: GZ8MTXP01AWOS4.22.86.H09.1.454.CMB.2.raw
  modified_base (322)..(322): a, c, t, g, unknown or other
  modified_base (492)..(492): a, c, t, g, unknown or other
  modified_base (555)..(555): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaaataaagactatggtggactccgtgaagggccgattcaccatctcaganacaactccaagaacactctcgtttcacaaatgaacacgcctgagaggcgaggacacggacagtgtattacgtgtgacgagagatcgacatagaacgtaacggggtaaatcgttttagacttcgtacgtcgggggaccaaaggggactacgtcggtaccaccgtctcttcncggcctaccgaccgtaacgggcccacgttccggttccctccccgtgcccgtccctgcctccgngggaacc

SEQ ID NO: 386174 - DNA, 581 bp, Homo sapiens
  misc_feature: GZ8MTXP01DIYRO.22.86.H09.1.454.CMB.2.raw
  modified_base (192)..(192): a, c, t, g, unknown or other
  modified_base (277)..(277): a, c, t, g, unknown or other
  modified_base (345)..(345): a, c, t, g, unknown or other
  modified_base (475)..(475): a, c, t, g, unknown or other
  modified_base (560)..(560): a, c, t, g, unknown or other
  modified_base (568)..(568): a, c, t, g, unknown or other
  modified_base (570)..(570): a, c, t, g, unknown or other
  modified_base (572)..(572): a, c, t, g, unknown or other
  modified_base (576)..(576): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtncagcgtggtggagtcgtgggggagcgtggtccaggccgtggggagtccctgacgactctcctgtgcagcgtctggactcaccttnagtggctagtggcatcgcacgtggcctccgccgaggccgtccgggacgaagggggctgggaggtgggngacctaaagttatagtgggtaataagaagtaagggaaaagtaaaagtaaaggatagtggtagggaccttaccgggagaagggacccattaccacaattccgaacaacggaacaaccaaactaccgaaaanaactacttacttacgtttaccaaaccaaagtaagaacaacgaccgtagagagacggaagacgacgagagtagtattagttgttgngagaaganananaagngtaag

SEQ ID NO: 386175 - DNA, 637 bp, Homo sapiens
  misc_feature: GZ8MTXP01AFI3M.22.86.H09.1.454.CMB.2.raw
  modified_base (400)..(400): a, c, t, g, unknown or other
tcagacatacgcgtcacgaccggtgctcgatttagtgctatagacttgggtttgggctgagcgtgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggggctgggagtggggtggctaattatatggtatgatggaaagtaataaagactatgtggactccgtgaagggccgattcaccatctccagagacaactcaaagaacactctcgttctacaaatgaaacaagccctgagaggcgaggacacggcagtgtattactgcgngagagatcgacatagaacgtaacggggtaaatcttttaggaattcgtacggttaggggacccgaaaggggacctaacgttcgggtacctacccggttcttcccttaacgaaccggttccccttaccccgaaccggtaaaccggggcccccttaacggttccccggggttccccttttccccccggtggggtcccccccgtcccggtaccggttcccgtaacccggaacgggtaaccg

SEQ ID NO: 386176 - DNA, 488 bp, Homo sapiens
  misc_feature: GZ8MTXP01DCFQJ.22.86.H09.1.454.CMB.2.raw
  modified_base (308)..(308): a, c, t, g, unknown or other
  modified_base (434)..(434): a, c, t, g, unknown or other
  modified_base (436)..(436): a, c, t, g, unknown or other
  modified_base (470)..(470): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctggggaggtccctgagactctcctgtgcagcgtctggatcaccttcagtggctatggcatgcactggctccgcaggctccgggnaaggggctgggagtgggtggccaattatagtgtatgatggaaataataaagctatgtgactcgtgaggcgatcacatctcagagacaactacaagaacactctgttcaccaatgaacagcctgagngngaagacacggcagtgtattacgttgttagcgagngatcgactaagttgaacg

SEQ ID NO: 386177 - DNA, 489 bp, Homo sapiens
  misc_feature: GZ8MTXP01ERW6Z.22.86.H09.1.454.CMB.2.raw
  modified_base (307)..(307): a, c, t, g, unknown or other
  modified_base (325)..(325): a, c, t, g, unknown or other
  modified_base (468)..(468): a, c, t, g, unknown or other
  modified_base (481)..(481): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggatcaccttcagtggctatggcatgcactggctccgcaggctccgggnaagggggctggagtgggngccaattatatggtatgatggaaataaataaagactatgtgactcgtgaaggcgatcacatctcagagacaactacaagacactctgttcaccaaatgaacagcctgagaggcgaagacacggcagtgtattacgttgttcgngagaagatcgacngttgaacg

SEQ ID NO: 386178 - DNA, 515 bp, Homo sapiens
  misc_feature: GZ8MTXP01CJWJI.22.86.H09.1.454.CMB.2.raw
  modified_base (241)..(241): a, c, t, g, unknown or other
  modified_base (277)..(277): a, c, t, g, unknown or other
  modified_base (361)..(361): a, c, t, g, unknown or other
  modified_base (403)..(403): a, c, t, g, unknown or other
  modified_base (494)..(494): a, c, t, g, unknown or other
tcagacatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtgttataactatgtctcctggtaccaanagcacccaggcaaacgcccccagactcatcatttangctgtcaataagcggccctcgaggggtcccctgactcgctttctctggctccaagtctcggcaacacggccctccctagacccntctcgtgggctccaggctagaagatggaggctgattattacngctgctcatttgcgaggcgcctacgcgttgggtgttcggcggaggaccagctgaaccgtcttaggtcacgcccaggccttcgcccctgtcnctctcgttcccgccttctccg

SEQ ID NO: 386179 - DNA, 608 bp, Homo sapiens
  misc_feature: GZ8MTXP01D4YWT.22.86.H09.1.454.CMB.2.raw
  modified_base (255)..(255): a, c, t, g, unknown or other
  modified_base (392)..(392): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcacctttcagtggctatggcatgcactggctccgccaggctccgggcaaggggctggagtggggtggcaattanatggtatgatggaagtaaataaagactatgtggactccgtgaaggccgattcaccatctccagagacaactccaaagaacactctcgtttctacaaatgaacaagcctgagaggcgaggacacggcagtgtattacngtgcgagagatcgacagtagaacgtaacggggaaagtcgttttaggattccgtcgtagggggacccgaaggggacaacgttcggtacctaccggttccttccgttcaacggttcccttaccccgaaaccgaaacgggggccccttacgttcccgggttcccctttcccccccgtgggtccccgtccccttcgggcccttcccgaagggtaaccccg

SEQ ID NO: 386180 - DNA, 528 bp, Homo sapiens
  misc_feature: GZ8MTXP01AOZW6.22.86.H09.1.454.CMB.2.raw
  modified_base (510)..(510): a, c, t, g, unknown or other
  modified_base (525)..(525): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaaagtaaataaagactatgtggactccgtgaaagggccgattcacatctccagagacaactccaaagaacactctcgtttcacaaatgaacaagcctgagaggcgaggacacggcagtgtattactgtgcgagagatcgacatagacgtacgggaaagtcgtttaggattcgtcgtggggaccaaggggacacgtggtcaccgtctcttcagcctccacgacgggcccagttccggttctccccngtccgcctgcctcgnggc

SEQ ID NO: 386181 - DNA, 599 bp, Homo sapiens
  misc_feature: GZ8MTXP01D5BDV.22.86.H09.1.454.CMB.2.raw
  modified_base (393)..(393): a, c, t, g, unknown or other
  modified_base (564)..(564): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctggagtgggtggcaattatatggtatgatggaaagtaataaaagactaatgtggactccgtgaagggccgattcaccatctccagagacaactccaaagaacactctcgtttctacaaatgaacaagcctgagaggacgagacgacggcagtgtattacngtgcgagagatcgacagtagaacgtaacgggaaagtcgtttttagagttacgtcggtagggggacccaaaggggcctaaacgttcggtacctaccggttctccgttaacacggccctacccgaaccgaaacggggtccccttaacgttcccgggttcccctttcccccggnggccccgtccctcggccttccccgaagggaacccg

SEQ ID NO: 386182 - DNA, 559 bp, Homo sapiens
  misc_feature: GZ8MTXP01CC7BN.22.86.H09.1.454.CMB.2.raw
  modified_base (383)..(383): a, c, t, g, unknown or other
  modified_base (390)..(390): a, c, t, g, unknown or other
tcagacatacgcgtcacgaccggtgctcgatttagtgctatagacttgggtttgggctgagctgggttttcctcgttgctctttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtgactcgtgaaggccgattcaccatctacagagacaactccaagaacactctcgtttctacaaatcgaacaagcctgagaggcgaggacacggcagtntattacngtagcgagacgatcgacagtagaacgtaacgggtaaatcgttttagattccgtacgtggggaccaaggggactacgtcggtacctaccgtctcttcacgccctaccaccgaacggcccttacgttccggttcccttccccgtggcccgccctggcctccgaaggaaccg

SEQ ID NO: 386183 - DNA, 622 bp, Homo sapiens
  misc_feature: GZ8MTXP01E0ZB4.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtggctaattatatggtatgatggaaagtaataaagactatgtggactccgtagaagggccgattcaccatctccagagacaactaccaagaacactctcgtttcacaaatgaacagcctgagaggcgagacgacggcagtgtattactgtgcgagagatacgacatgaacgtaacgggtaaagttcgttttagagttccgtcggtacgggggaccaaaggggacctaacgttcgggtacctaccggttccttccttccgacgttccccgtacccgaaacccgaaccggggtccccttacggtttccccgggttcccctttccccccggtgggtcccccgtccccgttcggaccccttaacccggaacgggtaacccg

SEQ ID NO: 386184 - DNA, 486 bp, Homo sapiens
  misc_feature: GZ8MTXP01ARRDZ.22.86.H09.1.454.CMB.2.raw
  modified_base (314)..(314): a, c, t, g, unknown or other
  modified_base (318)..(318): a, c, t, g, unknown or other
  modified_base (325)..(325): a, c, t, g, unknown or other
  modified_base (338)..(338): a, c, t, g, unknown or other
  modified_base (353)..(353): a, c, t, g, unknown or other
  modified_base (384)..(384): a, c, t, g, unknown or other
  modified_base (388)..(388): a, c, t, g, unknown or other
  modified_base (390)..(390): a, c, t, g, unknown or other
  modified_base (407)..(407): a, c, t, g, unknown or other
  modified_base (409)..(409): a, c, t, g, unknown or other
  modified_base (418)..(418): a, c, t, g, unknown or other
  modified_base (420)..(420): a, c, t, g, unknown or other
  modified_base (458)..(458): a, c, t, g, unknown or other
tcagacatacgcgtcacgaccggtgctcgatttagtgctatagacttggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcgtctggatcaccttcagtggctatggcatgcactggctcgcaggctccgagcgaggtcngagnggtcganatatatgtaatangagaagtaaataaanatatgtagactcgtagaggacgatcacatcncaananacacacaacgaacactntntactacaananacactcgagagagaagagacgacgagagtagttagttnttgtgagaagagagactaacgaagtaag

SEQ ID NO: 386185 - DNA, 552 bp, Homo sapiens
  misc_feature: GZ8MTXP01BF5XA.22.86.H09.1.454.CMB.2.raw
  modified_base (307)..(307): a, c, t, g, unknown or other
  modified_base (501)..(501): a, c, t, g, unknown or other
  modified_base (527)..(527): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcacatggagtttgggctgagctgggttttcctcgttgcttcttttaagaggtgtccagtgtcaggtgcagctggtggagtcgtgggggagcgtggtccagcctgggacgtccctgagctctcctgtgcagcgtctggatcacttcagtgctagtgcatgcactggcctccgcaggcgtccgggnaaggggctggaggtgggtgacctaagttatagtggtatgattaagggaaataaataaacggacttagtggtagacctccggtaggaacgggccgattccaacacttcgaccaaggaacaacctaaactaccaaacgaactactcgttacttctaaccaaatcgaacacgtctagagcggacgaaggacacgganaggttatattacgttgcggaagaagngatacgactgttaacggtaaacggg

SEQ ID NO: 386186 - DNA, 599 bp, Homo sapiens
  misc_feature: GZ8MTXP01DUZ5V.22.86.H09.1.454.CMB.2.raw
  modified_base (270)..(270): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagcctgggagtccctgagactctcctgtgcagcgtctggatcaccttnagtggctatggcatgcactggcctcccgcaggcgtcccgggacgaagggggctgggagtggggtaggacctaaatttagtagtggtaatgaattgggaaataaataaaggactagtggtaggactcgtagaacggccgattcaccatcacagacgacaactaccaaagaactacttcttacgtttacaacctaaatcgaaactacgcctaggaacggacgggcggtaaacggccgaaaccggggcttaaggttacgggttaatttaccggttgggttaggaaccggaaggaacggtaaacgtacggttaactaagttaacggtaaacgg

SEQ ID NO: 386187 - DNA, 576 bp, Homo sapiens
  misc_feature: GZ8MTXP01BURV8.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctgggagtggggtggcaattatatggtatgatggaaagtaataaagactatgtggactccgtgaagggccgattcaccatctccagagacaactccaaagaacactctcgttcacaaatgaacaagcctgagaggcgaggacacggcagtgtattactgtgcgagagatacgacatagaacgtaacggggaaagtcgttttagattcgtcgtacggggaccgaagggaccaacgtcggtcctacccggtcttccttcaacgccctacccgaccgaacgggccccaacgttcccggttcccttcccccgtcggtcccgccccgtcgccctccgaacggaaccg

SEQ ID NO: 386188 - DNA, 555 bp, Homo sapiens
  misc_feature: GZ8MTXP01D1CJH.22.86.H09.1.454.CMB.2.raw
  modified_base (549)..(549): a, c, t, g, unknown or other
tcagacatacgcgtcacgaccggtgctcgatttagtgctatagacttgggtttgggctgagctgggtttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtggcaattatatggtatgatggaaagtaaataaagactatgtggactccgtgaagggccgattcacatctccagagacaactaccaaagaacactctcgtttacctacaaatgaaacaagcctggagagggcgaggacacggcagtgtattactgtgcgagagatcgacatgaactaacggggaaatcgttttagagttctacggtggggaccaaggggacacgtcggtctaccgtctcttcacgccctccacgaacgggcccttacgttccgttcccttccccgtgccgccctggcctccgnggaacc

SEQ ID NO: 386189 - DNA, 591 bp, Homo sapiens
  misc_feature: GZ8MTXP01AJTIA.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaagggggctgggagtggggtgacaattatatggtatgatggaaagtaaataaagactatggtggactccgtgaagggccgattccacatctcagagacaactccaaagaacactctcgtttcacaaatgaacaagcctgagaggcgagggacacgggcagtgtattactgtgcgagagatcgacagtagacgtaacgggaagtcgttttgatcgtacgtcggggaccaaggggacctacgtcggtacacccgttcttccttcgacgcccttaccccgaaccgtaaaccggggccccttaacgttccggttccccgttccccccgtgggcccgtccccgttcgccgtaacccgaaggggaacccg

SEQ ID NO: 386190 - DNA, 547 bp, Homo sapiens
  misc_feature: GZ8MTXP01D6N35.22.86.H09.1.454.CMB.2.raw
  modified_base (359)..(359): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaagggggctgggagtggggtgacaattatatggtatgatggaaagtaataaagactatgtggactcgtgaaggccgatcacatctccagagacaactccaaagaacactctactttctacaaatgaacaanccctgagaggcgaggacacgggcagtgtatactgtgcgagagatcgacatgaactaacgggaaagtcgttttggattcctcgtaggggcccaaggggacacgtggtccaccgtctcttcacgcctccaccgaacgggccccacgttccggttcctcccccgtggccgccctcgctcccgaaggaaccg

SEQ ID NO: 386191 - DNA, 553 bp, Homo sapiens
  misc_feature: GZ8MTXP01A9DNO.22.86.H09.1.454.CMB.2.raw
  modified_base (546)..(546): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtcccctgagactctcctgtgcagcgtctggattcaccttcagtggctatggcatgcactggctccgccaggctccgggcaagggggctgggagtggggtggcaattatatggtatgatggaaagtaataaagactatgtggactccgtgaagggccgattcaccatctccagagacaactccaaagaacactctcgtttctaccaaatgaacaagcctgagagggacgaggacacggcagtgtattactgtgcgagagatcggacagtgacgtaacgggaaagtcgttttagattcgtcgtggggaccaaaggggacacgtggtcaccgtcctcttcacgcctccaccgaacgggcccagttccggttccttccccgtggccgccctcggcctccgnggaaccg

SEQ ID NO: 386192 - DNA, 542 bp, Homo sapiens
  misc_feature: GZ8MTXP01EQ3CN.22.86.H09.1.454.CMB.2.raw
  modified_base (253)..(253): a, c, t, g, unknown or other
  modified_base (536)..(536): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattanatggtatgatggaaagtaataaagactaatgtggactccgtgaaagggccgattcaccatctaccagagacaactccaaagaacactctgtttctacaaatgaacaagcctgagaggcgaggacacgggcagtgtattactgttcgagagaatcgacatgactaacgggaaagtcttttagggattcgtcgtggggaccaaggggacacgtgggtctaccgtctcttcaacgccttaccaccgaagggcccattccggttcttccccgtgccgcctgccttcnggcgcc

SEQ ID NO: 386193 - DNA, 615 bp, Homo sapiens
  misc_feature: GZ8MTXP01DPYF0.22.86.H09.1.454.CMB.2.raw
  modified_base (355)..(355): a, c, t, g, unknown or other
  modified_base (590)..(590): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaagggggctgggaggtggggtggacaattatatggtatgatggaagtaataaagactatgtggactcgtgaaagggccattcaccatctccagagaacaactccaaagaacactctcgttctacaaatnaacacgcctgagaggcgaagacacggcagtgttattacgtggtgacgagaagatcggacagtagacgtaaaggggaaacgtcgtttttagagttcgtacgtgggggacccaagggggtacctaacgttcggggtcctaacccggttcttccgtttcaacggttccccttacccgacccgtaaacggggccccttacgttcccgggttcccttccccccggtgggcccgtccccgngttacccgtccgaacgggtaacccg

SEQ ID NO: 386194 - DNA, 656 bp, Homo sapiens
  misc_feature: GZ8MTXP01B9M36.22.86.H09.1.454.CMB.2.raw
  modified_base (154)..(154): a, c, t, g, unknown or other
  modified_base (252)..(252): a, c, t, g, unknown or other
  modified_base (272)..(272): a, c, t, g, unknown or other
  modified_base (316)..(316): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgtggtttcncgttagctcttttaagaggtgtccagtgtcaggtgcagctggtggagtcgtgggggagcgtggtccagccgtggggacggtccctgagactctcctgngcagcgtctggatcaccttnagtgctagtggcatgcacgtggcctaccgcaggccgtcccgggnaagggggctgggagtggggtgactaattagtagtggtatgtaagttaagggaaaagttaaagtaaacgtataagtgggtacggaaccgttccggtaaggaaacggggtccgtattaccgaacctactacctaccgaacggaacgaaaccaaacctacccgaaagtaaccgtacttacgtttaccgttttacccaaacccgtaaattaccggaaactaaccggtcccgtaggaacggagggacgggtaaacggaacgaccggggacttaaggttaggttacttaacggttcgttacggaagggagtaacggtaacgtacgacgtaacgttaacggtaacgg

SEQ ID NO: 386195 - DNA, 510 bp, Homo sapiens
  misc_feature: GZ8MTXP01BQQIL.22.86.H09.1.454.CMB.2.raw
  modified_base (311)..(311): a, c, t, g, unknown or other
  modified_base (336)..(336): a, c, t, g, unknown or other
  modified_base (355)..(355): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccaggcctggggaggtccctgagactctcctgtgcagcgtctggatcaccttcagtggctatggcatgcactggctccgcaggctccgggnaagggggctggagtgggtgcaattnatggtatgatggaaataanaaagctatgtgactcgtgaggcgattcacatctcagagacaactcaagaacactctgtttacaccaaatcgaaacagcctaggagacgggcgaaggacttacgggcagttgtaattacgttgttgaacgagaagactcggactaagttcgaacgg

SEQ ID NO: 386196 - DNA, 627 bp, Homo sapiens
  misc_feature: GZ8MTXP01B0K0O.22.86.H09.1.454.CMB.2.raw
  modified_base (412)..(412): a, c, t, g, unknown or other
tcagacatacgcgtcacgaccggtgctcgatttagtgctatagacttgggtttgggctgagcgtggttttcctcgttagctcttttaagaggtgtccagtgtcaggtgcagctggtggagtctggggggaggcgtggtccagcctggggaggtccctgagactctcctgtgcagcgtctggattcaccttcagtggctatggcatgcactggctccgccaggctccgggcaaggggctgggagtggggtgcaattatagtggtatgataggaaagtaaataaagataatggtggactccggtgaaacggggccattcaccatctccagacgacaactccaaagaacactctcgtttacacaaatgaaacaagcctggagagggcgagggacacgggcagtgtaattcgtggngagagagactacgactagtagaacggttaacgggtaacttcgtttagacgttcgtacgggtacggggaaccgtaaagggtacctacggtcggtacctacccgttccttcgtaaccgaccgttcccgtacccgaccggtaaccgggtccccttacggttccccggttccccgttccccggcggtccccgtcccgtcgacccgtccggaacggtccg

SEQ ID NO: 386197 - DNA, 496 bp, Homo sapiens
  misc_feature: GZ8MTXP01BUE5M.22.86.H09.1.454.CMB.2.raw
  modified_base (303)..(303): a, c, t, g, unknown or other
  modified_base (327)..(327): a, c, t, g, unknown or other
  modified_base (347)..(347): a, c, t, g, unknown or other
  modified_base (357)..(357): a, c, t, g, unknown or other
  modified_base (401)..(401): a, c, t, g, unknown or other
  modified_base (474)..(474): a, c, t, g, unknown or other
  modified_base (481)..(481): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtcctgagctctcctgtgcagcgtctggatcacttcagtgctatggcatgcactggctccgcaggcctcgggnagggggctggagtgggtgcaattnagtggtatgatggaaataanaaagctatgngactcgtgaggcgatcacatctacagagacaactaccaagaacnctactcgttactaccaaatcgaacacgcctggagaggcgaagacgacggcagtgtattacgttgttcgaaganaatcganagtgaacgtaacggg

SEQ ID NO: 386198 - DNA, 545 bp, Homo sapiens
  misc_feature: GZ8MTXP01CINT4.22.86.H09.1.454.CMB.2.raw
  modified_base (377)..(377): a, c, t, g, unknown or other
  modified_base (409)..(409): a, c, t, g, unknown or other
  modified_base (446)..(446): a, c, t, g, unknown or other
  modified_base (522)..(522): a, c, t, g, unknown or other
  modified_base (527)..(527): a, c, t, g, unknown or other
  modified_base (539)..(539): a, c, t, g, unknown or other
tcagacatacgcgtcacgaccggtgctcgatttagtgctatagacttgggtttgggctgagcgtgggttttcctcgttgctcttttaagaggtgtccagtgtcaggtgcagctggtggagtcgtgggggaggcgtggtccagcctgggaggtccctgagactctcctgtgcagcgtctggattcaccttcagtggctatggcatgcactggctccgcaggctccgggcaaggggctgggagtggggtgctaattatatgttatgataggaaataataaagactatgtggactcgtgaaggccatcacatctccagacacaactccaaagaacactctctttcacaaatgaacaagctgagaggcgaggactacgggntagtgtattacgtgtgacgagagatacgatanagaacgtaagggtaaattcgttttagattcgtacggngggaccaagggactacgtcggtcctaccttctcttcacgcctaccacgacggccttacgttccgttcccttcccgnggccncccgtgcctcgnggaacc

SEQ ID NO: 386199 - DNA, 541 bp, Homo sapiens
  misc_feature: GZ8MTXP01DS7Y8.22.86.H09.1.454.CMB.2.raw
  modified_base (503)..(503): a, c, t, g, unknown or other
  modified_base (507)..(507): a, c, t, g, unknown or other
  modified_base (527)..(527): a, c, t, g, unknown or other
  modified_base (534)..(534): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggatcaccttcagtggctagtggcatgcactggcctccgcaggctccgaggcagggggctggagtgggtgactaattagtagtggtaaatgaagtagggaaagtaaataaagacttaagtgggtaggaccgtccggtaggaacgggccgtattaccactatctaccagaacgacaaactcccaaaggaacctactcttacgtttacacctaaatgaaacagcctaggagaggcgaggacacggnagtnttagttcagtgacgaagagnttcgaangtaacgg

SEQ ID NO: 386200 - DNA, 729 bp, Homo sapiens
  misc_feature: GZ8MTXP01DXKBD.22.86.H09.1.454.CMB.2.raw
tcagacatacgcgtcacgaccggtgctcgatttagtgctatagacttgagctctgggagaggagcccagcactagaagtcggcggtgtttccatttggtgatcagcactgaacacagaggactcaccatggagtttgggctgagctgggttttcctcgttgctcttttaagaggtgtccagtgtcaggtgcagctggtggagtcgtggggggagcgtggtccagccgtgggagtccctgagctctcctgtgcagcgtctggatcaccttcagtgctatggcatgcacgtggcctccgcaggcctccggggcaagggggctgggagtggggtgacctaatttagtagtgggtatggaagttaaggggaaaagtttaaaactaaaaggtacttaagtgggttacggggtaaacccgttccggttagggaaacggggtacccgtaacgtttacccgaaacccgtaacgttcccttacccgaaggaaaccggaaaccaaaaccgttacccaaaacggtaaaccgtaactttaccgtttacgtttttaccctaaacccgtaaaattacggaaaacctaacggacccgttaagggaacgggaacggggacccgggtaaagggaacccggaccggggaacgttaaacgggtttacgggtttaaatttaaccggttcgggttaggaaccggtaaggaacgaacgttaccggaactaagttaacgggttaaaaccggg

SEQ ID NO: 386201 - DNA, 619 bp, Homo sapiens
  misc_feature: GZ8MTXP01ES7IM.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgcgggaggcgtggtccagcctgggaggtccctgagactctcctgtgcagcgtctggattcaccttcagtggctatggcatgcactggctccgccaggctccgggcaaggggctgggagtgggtggcaattatatggtatgatggaaagtaataaagactatgtgactccgtgaagggccgattcaccatctccagatacactcaaagaacactcctgtttacaccaaatcgaaacagcctagaagaggcgaggacacggacagtgtattacgtgtgcgaagagagtacgacagtagaacgtaacgggaaaggtctttttagacttcgtcggtcggggacccgaaagggacctaacgtcgggtacctaacccggttcttcctttacgaccggtccccttacccgaaaccccgaaacggggttcccccttacggttccccgggttcccctttcccccccgtgggccccgtcccccgttcggtcccttcccggaaccggg

SEQ ID NO: 386202 - DNA, 774 bp, Homo sapiens
  misc_feature: GZ8MTXP01BIDJ0.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctggggaggcgtggtccagcctgggaggtccctgagactctcctgtgcagcgtctggattccaccttcagtggctagtggcatgcacgtggcctccgcgaggccgtccgggacgaaggggctgggaggtgggtgactaaattatagtggtatgaagtaggaaaagtaaataaaagtactagtggtcggaacctccggtaggaaacggggccctaatttccaacctattcctaccgaaaggaaccaaacctaaacctaccaaaagaaacctacttcgttacgtttaccaacctaaaagtacgaaaccaacggtccctaagggaaacgggaacggggaccggaaacggggaacccgacgggggtactaaagggttagttaactttaacgtgggttacggaacggtaaaggaaggtacgttaccgaaacgtaagtacggtaaaccggttaaacggggtaaagtttcgtttttaaggaacgtttccgtacggggtacggggaaccccgaaaggggtacctaaccggttcgggtaccctacccggtttctccgttaacgaccgttaccccgtacccgaaccggtaaaccggggccccttacggttcccggttcccctccccgtgggccccgtccccgtggacccgtcgaacgggaaccc

SEQ ID NO: 386203 - DNA, 558 bp, Homo sapiens
  misc_feature: GZ8MTXP01EO55Q.22.86.H09.1.454.CMB.2.raw
  modified_base (309)..(309): a, c, t, g, unknown or other
  modified_base (340)..(340): a, c, t, g, unknown or other
  modified_base (361)..(361): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggagtccctgagactctcctgtgcagcgtctggatcaccttcagtggctatggcatgcactggctccgcaggctcccgggngaggggctgggaggtggggtgaccaatttanagtggtatgatggaaataaanaaagctagtggtgactcgtagaacgggcgtattcacatctacagacgacaactacaaacgaacacttcgttactttacctaaccaaagtcggaaactacgcctaggaacgagggccgaaggaaccgacgggcgttagttggttaacttacgttggttggcggaagtaacggtaatcggactaacgttggtaaaccgg

SEQ ID NO: 386204 - DNA, 529 bp, Homo sapiens
  misc_feature: GZ8MTXP01BU956.22.86.H09.1.454.CMB.2.raw
  modified_base (309)..(309): a, c, t, g, unknown or other
  modified_base (336)..(336): a, c, t, g, unknown or other
  modified_base (379)..(379): a, c, t, g, unknown or other
  modified_base (473)..(473): a, c, t, g, unknown or other
  modified_base (501)..(501): a, c, t, g, unknown or other
  modified_base (507)..(507): a, c, t, g, unknown or other
  modified_base (512)..(512): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagcctggggagtccctgagctctcctgtgcagcgtctggatcaccttcagtggctatggcatgcactggctccgcaggctcccgggnaaggggctgggagtgggtgacaattanagtggtatggaatgggaaataaagtaaagactagtgagctcgngaagggcattcacatctcagacgacaactcaaagaacacgttcttgtttaccacctaaagtcgaaacgacgcctaggagacggcggaaggaacncgggacaggtgttaattagttggttcgngagaanacgtnactaagttcgaaaccgg

SEQ ID NO: 386205 - DNA, 531 bp, Homo sapiens
  misc_feature: GZ8MTXP01BV7OP.22.86.H09.1.454.CMB.2.raw
  modified_base (512)..(512): a, c, t, g, unknown or other
  modified_base (517)..(517): a, c, t, g, unknown or other
  modified_base (528)..(528): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctggggggaggcgtagtccagcctgggaggtccctgagactctcctgtgcagcgtctggattcaccttcagtggctatggcatgcactggctccgccaggctccgggcaaggggctgggagtggggtggcaattatatggtatgatggaaagtaataaagactatgtggactccgtgaagggccgattcaccatctccagagacaactccaagaacactctcgttctacaaatgaacagcctgagaggcgaggacacggcagtgtattacgtgtgcgagagatcgacagtgacgtagggaaagtcttttagattcgtcgtggggcctaagggacacgtgtccaccgtctcttcacgcctcccacgacgggcccagttccggttcctccccgnggccnccctgcctcgngcg

SEQ ID NO: 386206 - DNA, 715 bp, Homo sapiens
  misc_feature: GZ8MTXP01AF2YT.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgcaggctccgggcaaggggctgggagtggggtgcaattatagtggtatgataggaaagtaaataaagactatgtggactcgtagaacggccgattcacatctaccagacgaacaactaccaaacgaactactcttacgtttaccacctaaagtacgaaacaagtaccctggaaggaacgggaccggaacgggaaccgacgggactaaggttagttaattacgtggtacggacgtaaggagacgtacgaactaagtacggtaaacggtaaacggggtaaacgttcgtttttacggacgtttaccgtacgggttacgggggaaccgaaacgggggtaccttaaccggttcgggtaccctaacccggttccttaccgttccaaccggttacccctacccgaaaccggtaaacccggggtccccttaaccggttcccggtttccccttcccccggtcgggaaccccttccccgtcgttaccccgtaacccggaacggtaaccccgg

SEQ ID NO: 386207 - DNA, 568 bp, Homo sapiens
  misc_feature: GZ8MTXP01EA7FU.22.86.H09.1.454.CMB.2.raw
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactccgtgaagggccgattcaccatctccagagacaactcaaagaacactctcgtttctacaaatgaaacaagcctgagaggcgaggacacggcagtgtattactgtgcgagagatcgacatgaacgtaacgggaaagtcgtttaggattcgtcgtggggaccgaagggacacgtcggtcaccgtctccttcaacgccctaccgaccgaaacgggtcccttaacgttcccgggttccttccccccgtggcccgtcccctcggaccttcccgaacgggaaccg

SEQ ID NO: 386208 - DNA, 526 bp, Homo sapiens
  misc_feature: GZ8MTXP01A94J6.22.86.H09.1.454.CMB.2.raw
  modified_base (298)..(298): a, c, t, g, unknown or other
  modified_base (332)..(332): a, c, t, g, unknown or other
  modified_base (497)..(497): a, c, t, g, unknown or other
  modified_base (509)..(509): a, c, t, g, unknown or other
  modified_base (520)..(520): a, c, t, g, unknown or other
tcagacatacgcgtcacgaccggtgctcgatttagtgctatagacttgggtttggggggaagaggaagactgacggtcctgccacaggtggtgctgggcacggtgggcactcgacacaacatttgcgctcaactgtcttgtctcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggattcacttcagtgctanggcatgcacgtggctcccgcgaggccgtccgggnaagggggctgggaggtggggtggactaagttaatagtgggtatggatagggaaagtaataaagactatgtggactcgtagaggcgattcacatctccagacgacaactacaaagacactcgtctttactaccaaatgaacagcctaagagaggcgagacaggcgngttgtaatacgngtgcgagaagngtaacg

SEQ ID NO: 386209 - DNA, 562 bp, Homo sapiens
  misc_feature: GZ8MTXP01AE90N.22.86.H09.1.454.CMB.2.raw
  modified_base (342)..(342): a, c, t, g, unknown or other
tcagacatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtcccctgagactctcctgtgcagcgtctggattcaccttcagtggctatggcatgcactggctccgcaggctccgggcaaggggctggagtgggtgcaattatatggtatgatggaagtaataaagactatgtggactccgtgaagggccattcaccatctccagacgacaactccaagaacactctcgttcncaaatgaacaagcctgagaggcgaggacacggcagtgtattactgtgcgagagactcgacagtgaactacgggaaatcgttttagagttcgtcgtaggggccgaaaggggactacgtcggtccaccgttctcttcacgccctaccgaccgaacgggccccttacgttcccgggttccctttcccccgtggcccgccccgttcgcctcccgaaggaacccg

SEQ ID NO: 386210 - DNA, 556 bp, Homo sapiens
  misc_feature: GZ8MTXP01ER7Q7.22.86.H09.1.454.CMB.2.raw
  modified_base (308)..(308): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcgtctggatcacttcagtggctatggcatgcactggcctccgcaggcctcccgggnaagggggctgggaggtggggtggcctaaagttatagtggtaatgaatgggaaagtaaactaaagacttagtggtaggactccggtagaagggccgattcacctatctaccaagacgacaaactaccaaagaacacttcttgttaccaccaaatcgaaacacgcctaggaagacggcggaaggacgacgggcttagtagttaacttacgttgttggcgaagaagacgtcggaactaagttgtaaaccgg

SEQ ID NO: 386211 - DNA, 496 bp, Homo sapiens
  misc_feature: GZ8MTXP01CASSG.22.86.H09.1.454.CMB.2.raw
  modified_base (279)..(279): a, c, t, g, unknown or other
  modified_base (308)..(308): a, c, t, g, unknown or other
  modified_base (335)..(335): a, c, t, g, unknown or other
  modified_base (442)..(442): a, c, t, g, unknown or other
  modified_base (469)..(469): a, c, t, g, unknown or other
  modified_base (482)..(482): a, c, t, g, unknown or other
tcagacatacgcgtcacgaccggtgctcgatttagtgctatagacttgagctctgggagaggagcccagcactagaagtcggcggtgtttccattcggtgatcagcactgaacacagaggactcaccatggagtttgggctgagcgtgggttttcctcgttagctcttttaagaggtgtccagtgtcaggtgcagctggtggagtctgggggagcgtggtccagcctgggaggtccctgagactctcctgtgcagcgtctggatcacttcagtggctanggcatgcactggctcgcaggctcccgggnaagggggctgggagtgggtgcaattanagtggtatgatggaaataataaagctatgtaggactcgtgaaggcgattcacatctccagagacaactacaagaacactctgttactacaaatgaactagcctgagnggcgaaggacgacggcagtgtattagngttgcgagaagancgataagttgtaag
